United States Patent 8,664,475 (PLANTS WITH INCREASED YIELD) - sequence listing, part 4

SEQ ID NO: 7208 - DNA, 1449 bp, Nocardia farcinica
  CDS (1)..(1449): transl_table=11
atgaccgcagctgtcactcaagacaacacgagccggaccggcgccgccgcaggccgcgtcgtccgggtcatcggccccgtcgtggacgtcgagttcccgcgtggcgcgattcctgagctgttcaacgctctgcacgccgacatcacgctgacctcggtggccaagacgctgaccctcgaggtcgcccagcacctcggcgacaacatcgtccgcaccatctccatgcagccgaccgacggcctggtccgcggcgcgaccgtcaccgacaccggcaagccgatctcggtgcccgtcggcgacgtcgtcaagggccacgtcttcaacgccctcggcgactgcctggacacccccggcctgggccgcgacggcgagcagtggggcatccaccgcaagccgccgagcttcgatcagctcgagggcaagaccgagctgctcgagaccggcatcaaggtcatcgacctgctgaccccgtacgtgaagggcggcaagatcggtctgttcggtggcgccggtgtcggcaagaccgttctgatccaggagatgatcacccgtatcgcgcgggagttctccggcacctcggtgttcgccggcgtcggcgagcgcacccgtgagggcaccgacctgcacctggagatggaggagatgggcgtcctccaggacaccgccctcgtcttcggccagatggacgagccgccgggcacccgtatgcgcgtggcgctgtccgcgctgacgatggcggagtacttccgcgacgtccagcaccaggacgtgctgctgttcatcgacaacatcttccggttcacccaggccggttccgaggtctcgaccctgctgggccgcatgccctcggccgtcggttaccagccgaccctggccgacgagatgggtgagctgcaggagcgcatcacctcgacccgtggccggtccatcacctcgctgcaggccatctacgtgcccgccgacgactacaccgacccggcgccggcgaccaccttcgcccacctggacgcgacgaccgagctctcccgcccgatttcgcagaagggcatctaccccgccgtcgacccgctgacctcgacctcgcgcatcctcgaggcctcgatcgtcggcgaccggcacttcgcggtggccaacgaggtgaagcggatcctgcagaagtacaaggagctgcaggacatcatcgccatcctcggcatggacgagctctccgaggaggacaaggtcctcgtcggccgcgcccgtcgcctggagaagttcctcggccagaacttcatcgtggccgagaagttcaccggtcagccgggttcggtcgtgccgctcgagcagaccatcgacgacttcgatcgcgtctgcaagggcgagttcgaccactaccccgagcaggcgttcaactcctgcggtggtctcgacgacgtcgagaaggccgccaagaagatcgccggaaagtag

SEQ ID NO: 7209 - protein, 482 aa, Nocardia farcinica
MTAAVTQDNTSRTGAAAGRVVRVIGPVVDVEFPRGAIPELFNALHADITLTSVAKTLTLEVAQHLGDNIVRTISMQPTDGLVRGATVTDTGKPISVPVGDVVKGHVFNALGDCLDTPGLGRDGEQWGIHRKPPSFDQLEGKTELLETGIKVIDLLTPYVKGGKIGLFGGAGVGKTVLIQEMITRIAREFSGTSVFAGVGERTREGTDLHLEMEEMGVLQDTALVFGQMDEPPGTRMRVALSALTMAEYFRDVQHQDVLLFIDNIFRFTQAGSEVSTLLGRMPSAVGYQPTLADEMGELQERITSTRGRSITSLQAIYVPADDYTDPAPATTFAHLDATTELSRPISQKGIYPAVDPLTSTSRILEASIVGDRHFAVANEVKRILQKYKELQDIIAILGMDELSEEDKVLVGRARRLEKFLGQNFIVAEKFTGQPGSVVPLEQTIDDFDRVCKGEFDHYPEQAFNSCGGLDDVEKAAKKIAGK

SEQ ID NO: 7210 - DNA, 1446 bp, Novosphingobium aromaticivorans
  CDS (1)..(1446): transl_table=11
atggccaccgtgctctcctctaccggcaagatcagccaggtcatcggcgccgtcgtcgacgtgaccttcgacggcgaactgcccgcgattctctcggcgctcgaaaccgacaacaacggcaaccgcctcgttctcgaagtcgcacagcacctcggcgagaacaccgttcgcaccatcgcgatggactcgaccgacggcctgacccgcggccagccggtgaccaacaccggcgcgcagatctcggtgccggtcggccccaagaccctcggccgcatcatgaacgtcatcggcgagccgatcgacgagcgtggcccggtcggcgcggaacagaccgccccgattcacgccaaggctccggaattcatcgagcagtcgaccgaagccgcgatcctcgtgaccggcatcaaggtcatcgaccttctcgctccctatgcgcgcggcggcaagatcggcctgttcggcggcgccggcgtgggcaagaccgtgctcatccaggagctgatcaacaacatcgccaagggccacggcggcgtgtcggtcttcgcgggcgtcggcgaacgcacccgtgaaggcaacgacctctatcacgagttcctcgacgccggcgttatcgccaaggacgccgacggcaacccgaccccggacggctcgaaggtcgccctcgtgttcggccagatgaacgaaccgccgggcgcccgtgctcgcgtcgcgctctcgggcctgaccatggcagaatacttccgcgaccaggaaggccaggacgttctgttcttcgtcgacaacatcttccgcttcacccaggcgggttcggaagtgtcggctctgctcggccgtattccttcggcggtgggctaccagccgacgctggccaccgacatgggccagctgcaggaacgcatcacctcgaccaccaagggctcgatcacctcggtgcaggcgatctacgtccccgcggacgaccttaccgacccggcgccggccacctcgttcgcccacttggacgcaacgaccacgctgaaccgcgcaatctcggaactcggcatctacccggcggtcgacccgctcgactcgacctcgcgcgttctcacccccgccgtcgtcggacaggagcactacgagaccgcccgccgcgttcaggaaacgctgcagaagtacaagtcgctgcaggacatcatcgcgatcctcggcatggacgagctttctgaagaagataagctcaccgtcgcccgcgcccgcaagatccagcgcttcctgtcgcagccgttccacgtcgccgaagtgttcaccggcatccccggcaagttcgtccaggtcgaagacaccgtccgctcgttcaaggcggttgtcgacggcgagtacgaccaccttccggaagccgcgttctacatggtcggcggcatcgacgaagcggtcgagaaggccaagaagctggctgccgaagcctga

SEQ ID NO: 7211 - protein, 481 aa, Novosphingobium aromaticivorans
MATVLSSTGKISQVIGAVVDVTFDGELPAILSALETDNNGNRLVLEVAQHLGENTVRTIAMDSTDGLTRGQPVTNTGAQISVPVGPKTLGRIMNVIGEPIDERGPVGAEQTAPIHAKAPEFIEQSTEAAILVTGIKVIDLLAPYARGGKIGLFGGAGVGKTVLIQELINNIAKGHGGVSVFAGVGERTREGNDLYHEFLDAGVIAKDADGNPTPDGSKVALVFGQMNEPPGARARVALSGLTMAEYFRDQEGQDVLFFVDNIFRFTQAGSEVSALLGRIPSAVGYQPTLATDMGQLQERITSTTKGSITSVQAIYVPADDLTDPAPATSFAHLDATTTLNRAISELGIYPAVDPLDSTSRVLTPAVVGQEHYETARRVQETLQKYKSLQDIIAILGMDELSEEDKLTVARARKIQRFLSQPFHVAEVFTGIPGKFVQVEDTVRSFKAVVDGEYDHLPEAAFYMVGGIDEAVEKAKKLAAEA

SEQ ID NO: 7212 - DNA, 1395 bp, Oceanobacillus iheyensis
  CDS (1)..(1395): transl_table=11
atgagcaaaggacgcgttacacaattaatgggaccagtagtcgatgtacgttttgaagacgctgaactcccagcagtaaataatgctttagttgtccgtagtgacagtggtgaagaactaacactagaagtagctcttcatttaggtgacaatagtgtacgtaccatcgctatgtcttcaacagatggtttcaaacgtggtgcagaggtggaaaaccttggtcgtccaatctcagtaccagttggtgacgtaacactaggccgtgtatttaacgtattaggtgaaaaaatcgatttagacgaacctttagaagagggagttcgtcgcgatccgattcaccgtgaagcaccagactttgaaaacttatctacagaaacagaaattttagagacaggtattaaagtagttgacctgttagcaccatatatcaaaggtggtaaaattggactgtttggtggagctggtgtaggtaaaaccgtattaatccaggaattaattaataatatcgcacaagaacatggtggtatttctgtattcgcgggtgttggtgaacgtactcgtgaagggaatgacctttactatgaaatgagcgattctggagttattgctaaaacagcgatggtatttggacaaatgaacgagccacctggtgcacgtatgcgtgtagcattaactggcttaaccatggcagaatacttccgtgatgagcaaggacaggatgtattattgttcgttgataatatcttccgtttcacacaagcaggttctgaggtatccgcactacttggtcgtatgccatcagcggtaggttatcaacctactctagctacagaaatgggacaattacaagagcgtattacatctacagacaaaggttctgtaacatctattcaagcaatttatgtaccagcggatgactatacggatccggcgcctgctacaacatttgctcacttagatgcaacaacaaaccttgatcgtaaattatctgagcaaggtatctaccctgcggtggatcctttagagtctacctcacgtgcactcgatccagaagtagttggaaaagagcactatgaagtagcaactgaggtacagcaaacactacaaaaatatcgtgaacttcaagatattatcgcaatattaggtatggatgagttaagtgatgaagataaattagtcgttgctcgtgcgcgtcgaattcagttcttcctatcacaaaacttccacgtagcggagcaatttactggacaacctggatcttatgttcctgttcaagagactgtaaaaggatttaaagagattcttgaaggtaaatatgacgatcttccagaggatgctttccgtctagttggacgtattgaagaagtagtagaaaaagcaaaaggaatggaataa

SEQ ID NO: 7213 - protein, 464 aa, Oceanobacillus iheyensis
MSKGRVTQLMGPVVDVRFEDAELPAVNNALVVRSDSGEELTLEVALHLGDNSVRTIAMSSTDGFKRGAEVENLGRPISVPVGDVTLGRVFNVLGEKIDLDEPLEEGVRRDPIHREAPDFENLSTETEILETGIKVVDLLAPYIKGGKIGLFGGAGVGKTVLIQELINNIAQEHGGISVFAGVGERTREGNDLYYEMSDSGVIAKTAMVFGQMNEPPGARMRVALTGLTMAEYFRDEQGQDVLLFVDNIFRFTQAGSEVSALLGRMPSAVGYQPTLATEMGQLQERITSTDKGSVTSIQAIYVPADDYTDPAPATTFAHLDATTNLDRKLSEQGIYPAVDPLESTSRALDPEVVGKEHYEVATEVQQTLQKYRELQDIIAILGMDELSDEDKLVVARARRIQFFLSQNFHVAEQFTGQPGSYVPVQETVKGFKEILEGKYDDLPEDAFRLVGRIEEVVEKAKGME

SEQ ID NO: 7214 - DNA, 1497 bp, Oryza nivara
  CDS (1)..(1497)
atgagaaccaatcctactacttctcgtcccggggtttctacaattgaagaaaaaagtacagggcggatcgatcaaattattggacccgtgctggatgtcacttttcccccgggcaagttaccttatatttataatgctttggtagtcaagagtcgagacactgacggtaagcaaattaatgtaacttgtgaggtacaacaattattaggaaataatcgagttagagctgtagctatgagtgctacagatgggttgatgagaggaatggaagtgattgacacgggagctcctctcagtgttcctgtcggtggagctactcttggacgaattttcaacgttcttggggagcctgttgacaatttgggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgagcgcttcttatcacaaccgttttttgtggcagaagtttttaccggttctccgggaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatga

SEQ ID NO: 7215 - protein, 498 aa, Oryza nivara
MRTNPTTSRPGVSTIEEKSTGRIDQIIGPVLDVTFPPGKLPYIYNALVVKSRDTDGKQINVTCEVQQLLGNNRVRAVAMSATDGLMRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNLEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEASTKAINLEEENKLKK

SEQ ID NO: 7216 - DNA, 1374 bp, Pasteurella multocida
  CDS (1)..(1374): transl_table=11
atggcaactggaaaaattgtacaaatcatcggtgcggttattgacgttgaattcccacaagatgcagtaccaaaagtatatgatgccttaaatgttgaaacaggtttagtgcttgaagttcaacaacaattaggtggtggtgtagttcgctgtatcgcaatgggatcatctgatggattaaaacgcggtttaagcgtaacaaatacgaataacccaatttctgttccagtgggaacgaaaacattgggtcgtatcatgaacgtattgggtgaaccaatcgatgagcaaggtgaaatcggtgcagaagagaattggtctattcaccgtgcgccaccaagttatgaagaacaatctaacagtactgaacttttagaaacgggaattaaagttatcgacttagtttgtccgtttgcgaaagggggtaaagtaggtttattcggtggtgcgggtgttggtaaaaccgtcaatatgatggaattaatccgtaacatcgcaattgagcactcaggttactctgtctttgcgggggtaggtgagcgtacgcgtgaaggtaacgacttctatcatgagatgaaagactctaacgtattagataaagtgtctcttgtttatggtcaaatgaacgagccaccaggtaaccgtttacgtgtggcattaacaggcttaaccatggcggaaaaattccgtgatgaaggtcgtgatgtcttattcttcgttgataatatttatcgttatacccttgctggtacagaagtttctgcattattaggtcgtatgccatctgcggtaggttatcaaccaacccttgcagaagaaatgggtgttctgcaagagcgtattacctcaaccaaaacaggttctattacttctgttcaagccgtttacgtgcctgccgatgacttaactgacccatcgccagcaaccacgtttgcgcacttagactcaacagttgtattaagccgtcaaatcgcgtcattaggtatttatcctgcagtggatccattagaatcaacttctcgtcagttagatccattagtcgtgggtgaagaacactacaacgttgcacgtggtgtacaaacaaccttacaacgttataaagaattgaaagatattattgcaattcttggtatggatgagttatctgaagaagataaattagtggttgcacgtgcacgtaagatcgaacgtttcttatcacaaccgttcttcgttgcggaagtatttaatggtacgccaggtaaatatgttccattaaaagaaacaattcgtggctttaaaggtattttagacggtgaatatgaccatatcccagaacaagcgttctatatggcgggtaccatcgacgaagtattagaaaaagcgaaaaaattgtaa

SEQ ID NO: 7217 - protein, 457 aa, Pasteurella multocida
MATGKIVQIIGAVIDVEFPQDAVPKVYDALNVETGLVLEVQQQLGGGVVRCIAMGSSDGLKRGLSVTNTNNPISVPVGTKTLGRIMNVLGEPIDEQGEIGAEENWSIHRAPPSYEEQSNSTELLETGIKVIDLVCPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLESTSRQLDPLVVGEEHYNVARGVQTTLQRYKELKDIIAILGMDELSEEDKLVVARARKIERFLSQPFFVAEVFNGTPGKYVPLKETIRGFKGILDGEYDHIPEQAFYMAGTIDEVLEKAKKL

SEQ ID NO: 7218 - DNA, 2374 bp, Pisum sativum
  CDS (460)..(1935)
gagtctcttatttttttttttattttggaatatcattttctaatctaaataataaaaaagatattcttgaccttgacagtgatctatgttgtatatgtaaatcctagatgtaaaaatcggcagaattttcccaataaaaagaaaaattggtaaaaatgatatgctaagtataaatcctatgctgaggaaataaaaaagaaggaccaatgagatagaaaaacggaatcataaacaaagttcaggttctaattccatagataatatagtattgtctataatctagatgactgggttgaccttgaaaattcaatcattgaaattttaaaacaattgaattgattggatggtaccaagaaaatcgattattaacttacatttattattcaatatcattaaccacttgctttgttatcgaacattttttttttttttcaaaaaaaaaaaccgatattttgcaatatgacaataactcctcccccttctgatactgaggtttctgtacttgaaaacaaaaatctggggcgtatcacgcaaataatcggtccggtactcgatgtagtttttccaccagggaagatgccttatatttacaacgctctgatagttcaaggtcgagatacggttggcaaacaaattaacgtaacttgtgaagtacagcaattattaggaaataatcgaattagagctgtagctatgagtgctacagatggtctaaagagaggaatggaagtgattgacacgggagctgctctaagtgttccagtcggcggagcaaccctaggtcgaattttcaacgtgcttggagagcctattgataatttgggtcctgtagatactcgcacaacatctcctattcatagatctgcgcctgcttttatacagttagatacacaattatccatttttgaaacaggaattaaagtagtcgatcttttagctccttatcgccgtggcggaaaaataggacttttcggtggagctggggtaggtaaaacagtactcattatggaattgatcaataacattgccaaagctcatggaggtgtatccgtatttggcggagtaggtgagcgtactcgtgagggaaatgatctttatatggaaatgaaagaatccagagtaattaatgaaaaaaatattgcggaatcaaaagtagctctagtctacggtcaaatgaatgaaccccccggagctcgtatgagagttggtttaactgccctaactatggcagaatatttccgagatgtcaatgagcaggacgtccttctatttatcgacaatatcttccgttttgtccaagccggatccgaagtatctgccttattgggccgaatgccttccgctgtgggttatcaacctaccctgggtactgaaatgggtactttacaagaaagaattacttctaccaaagaagggtctataacttctattcaagcagtttatgtacctgcagacgatttgaccgatcctgctcctgccacgacatttgcacatttggatgcaactactgtactatcaagaggattagctgccaaaggtatctatccagcagtagatcctttagattcaacgtcaaccatgctccaacctcgtatcgtcggtgaagaacattatgaaactgcgcaaagagttaaacaaacgttacagcgttacaaagaacttcaggacatgatagctattcttgggttggacgaagtatccgaagaggatcgcttaaccgtagcaagagcacgaaaaattgaacgtttcttctcacaaccttttttcgtagcagaagtatttaccggttctccagggaaatatgttggtctagcagaaacaattagaggatttcaattgattctttctggagaattagatagtcttcctgaacaagccttttatttggtgggtaatatcgatgaagctactgcgaaggctacgaacttaacttagaaatggagaacaaattcaagaaatgacttttaatctttgtgtactgacccccaatcgaattgtttgggattccgaagtgaaagaaattattttatctactaatagtggacaaattggggtattacaaaatcatgcgcctattgccacagctttagatataggtattttgagaatacgccttaaggaccgatggttaacgatggctctgatgggcggttttgctagaataggcaataatgagatcactattttagtaactgatgcagaaagcgctagtgacattaatccacaagaagcacaacaaactcttcaaatagcagaagcgaacttaaataaggctgaaggcaagagagaaacaattgaagcaaatctatctctccggcgagctaagacacgagtagaggctatcgtagagactatcaagaggatctcctaacaa

SEQ ID NO: 7219 - protein, 491 aa, Pisum sativum
MTITPPPSDTEVSVLENKNLGRITQIIGPVLDVVFPPGKMPYIYNALIVQGRDTVGKQINVTCEVQQLLGNNRIRAVAMSATDGLKRGMEVIDTGAALSVPVGGATLGRIFNVLGEPIDNLGPVDTRTTSPIHRSAPAFIQLDTQLSIFETGIKVVDLLAPYRRGGKIGLFGGAGVGKTVLIMELINNIAKAHGGVSVFGGVGERTREGNDLYMEMKESRVINEKNIAESKVALVYGQMNEPPGARMRVGLTALTMAEYFRDVNEQDVLLFIDNIFRFVQAGSEVSALLGRMPSAVGYQPTLGTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDMIAILGLDEVSEEDRLTVARARKIERFFSQPFFVAEVFTGSPGKYVGLAETIRGFQLILSGELDSLPEQAFYLVGNIDEATAKATNLT

SEQ ID NO: 7220 - DNA, 1428 bp, Phaeodactylum tricornutum
  CDS (1)..(1428)
atggtaaaaactaatttaaacaaaggttacgttactcaaattattggtcctgtattagacattaaattttcagaaggaaatttaccaccgatctatagtgcaatcaaaattatcttggatgataataccgaaacaattgttgaagtacaacaattattaggtgataataaggtacgtgcagtgtctatgcgttcaacagatggtttaaaacgtggtgtagaagcaattgatttaggcactccaattaatgttccagtcggtactccaacgttaggtcgaatttttaatgtaattggtgagcctgtcgatgagcaaggcgaagttaaatatgatgaaactttaccaattcatcgtgatgctccagcattcactgagttagaaacaaaaccatcaatttttgaaactggtattaaagtagttgatttattagcaccatatcgacgtggtggcaaaattggtttatttggtggagctggcgtaggtaaaacggtattaattatggagttaattaataatattgcaaaagctcatggtggtgtatctgttttcggtggtgtcggtgaacggacgcgcgaaggaaatgatttatacgaagaaatgaaagaatctggtgtaattaatgaaaaaaactttgcggaatctaaagtagctttagtctatggtcaaatgaatgaaccaccaggggcacgtatgcgtgttggtttaacagctttaacaatggctgagtattttcgcgatgtaaataagcaagatgtattattatttattgataacattttccgctttactcaagctggttcagaagtatcagcattattaggtcgtatgccatcagcggtaggctatcaaccaacattagctactgaaatgggtgcattgcaagagcgaattacatcaacaacgcaaggttcgattacatcaattcaagctgtatacgtaccagcagatgatttaacagatcctgctccagcgacaacattcgcacatttagatgcgacaactgtgttatcccgcggtttagcagcgaaaggtatttatcctgctgtagatccgttagattcaacttcaacgatgttacaagtgggtattgttacagaagagcattatgctacagcagaaaacgtaaaagaaacattacaacgctataaagaattacaagacattattgcaattttaggtatcgatgaattatcggaagaagatcgtttaactgttgcacgtgcacgtaaagtagaacgctttttatctcaaccatttttcgttgctgagatttttactggttcaccaggtgaatacgttagtttagaggatacaattaagggtttcttaatggtattaaacggtgaattagatgatttaccagaacaagcgttttatcttgtaggtaatattgatcaagcaattgcaaaagcagaaactctaaaataa

SEQ ID NO: 7221 - protein, 475 aa, Phaeodactylum tricornutum
MVKTNLNKGYVTQIIGPVLDIKFSEGNLPPIYSAIKIILDDNTETIVEVQQLLGDNKVRAVSMRSTDGLKRGVEAIDLGTPINVPVGTPTLGRIFNVIGEPVDEQGEVKYDETLPIHRDAPAFTELETKPSIFETGIKVVDLLAPYRRGGKIGLFGGAGVGKTVLIMELINNIAKAHGGVSVFGGVGERTREGNDLYEEMKESGVINEKNFAESKVALVYGQMNEPPGARMRVGLTALTMAEYFRDVNKQDVLLFIDNIFRFTQAGSEVSALLGRMPSAVGYQPTLATEMGALQERITSTTQGSITSIQAVYVPADDLTDPAPATTFAHLDATTVLSRGLAAKGIYPAVDPLDSTSTMLQVGIVTEEHYATAENVKETLQRYKELQDIIAILGIDELSEEDRLTVARARKVERFLSQPFFVAEIFTGSPGEYVSLEDTIKGFLMVLNGELDDLPEQAFYLVGNIDQAIAKAETLK

SEQ ID NO: 7222 - DNA, 1497 bp, Populus alba
  CDS (1)..(1497)
atgagaatcaatcctactacttctggtcctggagtttccgcgcttgaaaaaaagaacctgggacatatcgctcaaatcattggcccagtgctagatgtagtttttcccccgggcaagatgcctaatatttacaacgctctggtagttaagggtcgagatactgtcagtcaacaaattaatgtcacttgtgaagtacagcaattattaggaaataatcgagttcgagctgtagctatgagtgctacagatggtctaatgagaggaatggaagtgattgacacgggagctcccctaagtgttccagtcggcggggcgactctaggacgaattttcaacgtgcttggagaacctgttgatgatttaggtcctgtagatactgggacaacatcccctattcatagatctgcgcctgcctttatacagttagatacaaaattatctatttttgaaacaggaattaaagtcgtagatcttttagccccttatcgccgtggaggaaaaatcggactatttgggggcgctggagtaggtaaaacagtactaattatggaattaatcaacaacattgcgaaagctcatgggggtgtatccgtatttggcggagtaggtgaacgtactcgtgaaggaaacgatctttacatggaaatgaaagaatccggagtaattaatgaagaaaatattgcagaatcaaaagtggctctagtttatggtcagatgaacgaaccaccgggagctcgtatgagagttggtttgactgccctaactatggcggaatatttccgagatgttaatgaacaagacgtacttctatttatcgacaatatctttcgtttcgtccaagcaggatccgaagtatccgccttattgggtagaatgccctctgctgtgggttatcaacccacccttagtaccgaaatgggtactttacaagaaagaattacttctaccaaagaagggtccataacttctattcaagcagtttatgtacctgcggacgatttaaccgaccctgctcctgccacgacatttgcgcatttagatgctactactgtactatcaagaggattagctgctaaaggtatctatccagcagtcgaccctttagattcaacatcaactatgctccaacctcagatcgttggtgaggaacattatgaaactgcgcaaagagttaagcaaactttacaacgttacaaagaacttcaagacattatagctatccttgggttggacgaattatccgaagaggatcgcttaactgtagcaagagcacgaaaaattgagcgtttcttatcacaaccctttttcgtagccgaagtatttaccggttccccgggaaaatatgtcggtctagcagaaacaattagagggtttaaattgatcctttccggagaattagatagtcttcctgagcaggccttttatttggtaggtaacattgatgaagctactgcgaaggctacgaacttagaaatggagaacaacttgaagaaatga

SEQ ID NO: 7223 - protein, 498 aa, Populus alba
MRINPTTSGPGVSALEKKNLGHIAQIIGPVLDVVFPPGKMPNIYNALVVKGRDTVSQQINVTCEVQQLLGNNRVRAVAMSATDGLMRGMEVIDTGAPLSVPVGGATLGRIFNVLGEPVDDLGPVDTGTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLKK

SEQ ID NO: 7224 - DNA, 1455 bp, Propionibacterium acnes
  CDS (1)..(1455): transl_table=11
atgactgcgacaacaattacccccgagacgaaggacgaggtggtcggcgttgggcgagtcgtccgcgttatcggccccgtcgtcgacgtcgagtttccggccggtcagctgccggagattctcaacgccctgcacgtcgatgctgaggtgatgggagagactcatgccatcaccctcgaggtggccttgcacattggcgagaatgtcgtgcgagccatctccctcaaaccgactgacggtatgcgccgcggcactgaggtgcgcgacaccggtgccccgattagcgtgccagtgggtgacgtcactaagggtcacgtctggaatgtgacaggtgacgttcttaacgccgatccctccacaatcgaggtgactgagcgttggccgatccaccgggatcccccggccttcgatgaccttgagcccgagaccgagatgctggagaccggtattaaggtccttgacttgctgactccttacgtcaagggcggcaagattggcctctttggcggcgctggtgtgggtaagacggtgctcattcaggagatgatttaccgtatcgcccacaacttcggcggtacctcggttttcgccggtgtcggtgaacgtacccgtgagggtaacgacctcatcaacgagatggacgaggccggtgtgctcaaggacaccgctctggtattcggccagatggacgagcccccgggcacgcgtttgcgcatcgctttgaccggtttgacgatggctgagtacttccgcgatgttcagaaccaggacgtgctgttgttcatcgacaacatcttccggttctcccaggctggttctgaggtttcaaccctgctaggtcgtatgccctcggcggtgggctaccagcccaacttggccgacgagatgggccaattgcaggagcgaatcacctcgacccgtggccactccatcacctcgatgcaggccgtctacgtccccgctgacgattacaccgacccggctccggcgacgaccttcgcccatctggatgccaccacggagctttctcgtgagattgcctctcgtggcctgtacccggctgtggacccactgacgtcgacctctcgtatcctcgacccgctgtacgtaggccaggagcattacgacaccgctactcaggtcaaacagattctgcagcgcaacaaggagcttcaggacatcatcgctattctcggtgtggatgagctgagcgaagaggacaaggtcactgtggcgagggcccgccgcatccagcagttcctgtcccagaacacgtacactgccgagaaattcactggcgtcgctggatcgacggttccgattgccgacacagttgagggattccagatgatctgccgtggcgacgttgaccacattcccgagcaggccttcttcaacgttggcagcatggacatggtgatggagaactgggacaagatgaagaaggagggctga

SEQ ID NO: 7225 - protein, 484 aa, Propionibacterium acnes
MTATTITPETKDEVVGVGRVVRVIGPVVDVEFPAGQLPEILNALHVDAEVMGETHAITLEVALHIGENVVRAISLKPTDGMRRGTEVRDTGAPISVPVGDVTKGHVWNVTGDVLNADPSTIEVTERWPIHRDPPAFDDLEPETEMLETGIKVLDLLTPYVKGGKIGLFGGAGVGKTVLIQEMIYRIAHNFGGTSVFAGVGERTREGNDLINEMDEAGVLKDTALVFGQMDEPPGTRLRIALTGLTMAEYFRDVQNQDVLLFIDNIFRFSQAGSEVSTLLGRMPSAVGYQPNLADEMGQLQERITSTRGHSITSMQAVYVPADDYTDPAPATTFAHLDATTELSREIASRGLYPAVDPLTSTSRILDPLYVGQEHYDTATQVKQILQRNKELQDIIAILGVDELSEEDKVTVARARRIQQFLSQNTYTAEKFTGVAGSTVPIADTVEGFQMICRGDVDHIPEQAFFNVGSMDMVMENWDKMKKEG

SEQ ID NO: 7226 - DNA, 2050 bp, Prochloron didemni
  CDS (1)..(1452): transl_table=11
atggtagcgacaacagaaacaacaaacattggtaaaattacccaaatcatcggccctgtagtggatgcggagtttccatctggcaaaatgccccgaatctacaatgccttgagagttgaaggcaaaaatgccgccggacaagatgtagccgtaacctgcgaggtgcagcagttgctgggagacaaccaagtacgggctgtttccatgagcagcacggacggtctggtgcggggaatggaaattaccgatactggcgcacccattaacgttcctgtgggcaaggctaccctgggtcggattttcaatatcttgggggaaccagtagataatcagggtcctgtgtatactgctgaaacttctcctattcaccgagctgcccctaaatttaccgatttagacaccaagcccactgtatttgagactgggatcaaggttatcgacttgctgactccctatcgtcgcggcggtaaaatcggcctgtttggcggtgctggtgtgggcaaaaccgttatcatgatggagctaatcaacaatattgccatcaaccacggtggagtctccgtcttcggcggtgtgggagagcgcactcgtgaagggaatgacctttacaatgaaatgattgaatcgaaggttattaacgctgataacctcaacgagtctaaaattgctctagtttacggtcagatgaatgaaccccctggtgcgagaatgcgggtaggtctatctgctctgactatggctgagtatttccgggatgtgaacaagcaagatgtgttgctgttcatcgacaatatttttcgctttgttcaagctggttctgaggtatctgccctgttaggtcgcatgccttctgctgtgggttaccagcctactctgggtactgacgtgggagatttgcaagagcggattacttctactaaggaaggttctattacctctattcaagcggtttacgttcctgcggacgatttaaccgaccccgctcctgctactacttttgctcacttagacggtactacggtgctgtctcggggtttggcttctaagggtatttatcctgctgtagatcctttagactccaccagcaccatgttacaggcgggaattgtgggtgaagaccactacaataccgctcgtgcagtgcagtctaccttgcagcgctataaagaactgcaagatattattgccattttgggtctggatgaattgtcggaagaagaccgcttgatagtagatcgggctcggaaggtggagcgtttcttgtctcagcctttctttgtggcggaagtatttactggcgcacctggcaagtacgtttctctggaagatactatcaaaggcttcaagatgattctgtctggggaattagatgacctgccagaacaggcattctacttggtaggagatattcaggaagctaaggctaaagctgaaaaactcaagcaagattaagatccccctatccccccttgatccccccttggtcccccccagtgggggggaaacaggggggagaaaacaaccccccttatttaaggggggagaagaggttggtttgtcagttactgcttggtaaaaacaaacaacaaacaaccaataacaaaaaacaaacaacaaataacaaacaaccaaaaatgactttaactttgcgggtaattaccccagataagacagtttgggacgatagtgtagaagaaattgtcctgcccagtactacgggacaggtaggggttttgacaggtcacgctcctctgttaacggctttggatactggggtgatgcgagttcgtcctggcaaagattggcaggcgatcgccctcatgggtggatttgctgaagtagagaacaacgaggtgaaagttctagtgaatggtgcggaagtgggagatagtatcgataaagaaactgctcgcactgagttccaacaagcggaacaaaatctcgctcgagccaatcaaggagacaaccgccaagagctaattcaagcaacccaagagttcaagaaagcaagagcccgctttcaagctgctgggggcatgacttaaggcaa

SEQ ID NO: 7227 - protein, 483 aa, Prochloron didemni
MVATTETTNIGKITQIIGPVVDAEFPSGKMPRIYNALRVEGKNAAGQDVAVTCEVQQLLGDNQVRAVSMSSTDGLVRGMEITDTGAPINVPVGKATLGRIFNILGEPVDNQGPVYTAETSPIHRAAPKFTDLDTKPTVFETGIKVIDLLTPYRRGGKIGLFGGAGVGKTVIMMELINNIAINHGGVSVFGGVGERTREGNDLYNEMIESKVINADNLNESKIALVYGQMNEPPGARMRVGLSALTMAEYFRDVNKQDVLLFIDNIFRFVQAGSEVSALLGRMPSAVGYQPTLGTDVGDLQERITSTKEGSITSIQAVYVPADDLTDPAPATTFAHLDGTTVLSRGLASKGIYPAVDPLDSTSTMLQAGIVGEDHYNTARAVQSTLQRYKELQDIIAILGLDELSEEDRLIVDRARKVERFLSQPFFVAEVFTGAPGKYVSLEDTIKGFKMILSGELDDLPEQAFYLVGDIQEAKAKAEKLKQD

SEQ ID NO: 7228 - DNA, 1461 bp, Prochlorococcus marinus
  CDS (1)..(1461): transl_table=11
atggtagcaactccatcaacttcttcacaaactaaaggcgtagtacgtcaggtaattggcccagttctagatgtagaatttccagctggtaaattgcccaaaatattaaatgctttaagaattgaagcaaaaaatcctgctggacaagaaatagcgctcactgctgaggtccaacagctccttggtgatcatagagtcagggcagtggcaatgagtggcacagacggccttgtaaggggtatggaggcagtcgacacaggtgccccaatatctgtaccggtaggagaagcaaccttaggaagaatatttaatgttttaggagaaccagtagatgaacaaggtccagtaaaaactaaagatactgcgccaattcatagagctgctccaaagttaactgacctagaaactaagccaaaagtgtttgaaaccggaattaaagttatcgaccttttagctccttacagacaaggaggaaaagtcggattatttggaggcgctggtgttgggaagactgttcttattcaagagttaataaataacattgcaaaggaacatggtggagtttctgtttttggcggcgtaggagaaagaaccagagaagggaacgatttatatgaagaatttaaagaatcaggggttatcaatgctgatgatttaactcaatcaaaagttgccttatgttttggacagatgaatgagccacctggtgcaagaatgagagtaggcttatcagcacttacaatggccgaacattttagagatgtaaataaacaagacgttctactttttgttgataacatttttagatttgttcaagctggttctgaagtatcggctttacttggaagaatgccttcagctgttgggtaccaaccaactcttgggactgatgttggtgaattgcaagagaggattacatctacattagaaggctcaataacatctattcaggctgtttatgtacctgcagatgatctaactgatcctgctccagcaacaacctttgcacatttagacgctactactgtgcttgcaagagctcttgcagctaagggaatttatcccgcagttgacccattagactcaacaagtactatgcttcaaccatcagttgttggcgatgagcattacaaaacagccagagcggttcaatcaactttgcaaagatataaagaattacaagacattattgcaattcttggtttggatgagctttctgaagaggatagattaacagttgacagggctagaaaaattgaaaaattcctttcccaacctttcttcgtagcagaaatatttactgggatgtcaggtaaatacgtcaaattagaagaaaccatagctggtttcaacatgattttgtcaggcgaattagatgatttaccagaacaggcattttacttggttggtaacattgatgaagtcaaagcaaaggctgaaaaactaaagtcagaaaaataa

SEQ ID NO: 7229 - protein, 486 aa, Prochlorococcus marinus
MVATPSTSSQTKGVVRQVIGPVLDVEFPAGKLPKILNALRIEAKNPAGQEIALTAEVQQLLGDHRVRAVAMSGTDGLVRGMEAVDTGAPISVPVGEATLGRIFNVLGEPVDEQGPVKTKDTAPIHRAAPKLTDLETKPKVFETGIKVIDLLAPYRQGGKVGLFGGAGVGKTVLIQELINNIAKEHGGVSVFGGVGERTREGNDLYEEFKESGVINADDLTQSKVALCFGQMNEPPGARMRVGLSALTMAEHFRDVNKQDVLLFVDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPSVVGDEHYKTARAVQSTLQRYKELQDIIAILGLDELSEEDRLTVDRARKIEKFLSQPFFVAEIFTGMSGKYVKLEETIAGFNMILSGELDDLPEQAFYLVGNIDEVKAKAEKLKSEK

SEQ ID NO: 7230 - DNA, 1467 bp, Prochlorococcus marinus
  CDS (1)..(1467): transl_table=11
atggctgctgctgctactgcgtctaccggaacaaagggtgttgtccgtcaggttattggcccagttttggatgttgagttccctgctgggaaactacctaaaatccttaatgcacttaggattgaagggaagaatcctgctggacaagatgtagctctaacagcagaagtgcaacaactgcttggtgaccaccgtgttagagcagttgcaatgagtggaactgatggtctggtacgaggaatggaagcaatagatactggatctgcaatatcagtgcccgttggtgaagcaacacttggaaggatatttaatgttcttggagaacctgtagacgagcaaggtcccgtaaagaccaaaacaacttctcctattcatagagaagccccaaaacttactgatttagaaacaaagccaaaagtatttgagacaggtataaaagtcattgatttgctagctccttataggcaaggagggaaagtaggcctttttggaggtgcaggagtaggtaaaactgtgttgattcaagaactaatcaataatattgctaaggaacatggaggggtttccgtttttggaggagttggagaaagaactcgagaagggaatgatctttatgaggaattcaaagagtcaggagttattaatgcagacgatttaactcaatcaaaggtagcgctttgttttggccaaatgaatgagcctcctggagcaagaatgagagtaggcctgtctgcattaacgatggctgagcattttcgtgacgtaaataaacaagatgttttgttatttgttgacaatattttccgttttgttcaagcaggttctgaggtttcggctctgctcggtcgaatgccatcagctgttggataccaaccaacattgggtactgatgttggagaacttcaagaaagaattacctcaactttagaaggctcaatcacttcaattcaagctgtgtacgtaccagcagatgacctaactgaccctgcacctgcaacaactttcgctcacttagatgcaacaacagttcttgctagggccttagcagctaaaggtatttatccagcagtggatcctttagattcaacaagtacaatgcttcaaccatctgttgttggtgacgagcattatcgaactgccagagccgttcaatcaaccctacaaagatataaagagcttcaagacattattgcgattctaggccttgatgaactttctgaagacgataggcgcactgttgacagagcaaggaaaattgaaaagtttttatctcagccattcttcgtagcagaaatctttactggtatgtcagggaaatacgtcaagttagaagatacaattgcaggttttaatatgattctttctggtgaattagatgatttacctgaacaggcattttatcttgttggaaacattactgaagtaaaagaaaaagcccaaaaaattagtgctgatgcaaagaaatag

SEQ ID NO: 7231 - protein, 488 aa, Prochlorococcus marinus
MAAAATASTGTKGVVRQVIGPVLDVEFPAGKLPKILNALRIEGKNPAGQDVALTAEVQQLLGDHRVRAVAMSGTDGLVRGMEAIDTGSAISVPVGEATLGRIFNVLGEPVDEQGPVKTKTTSPIHREAPKLTDLETKPKVFETGIKVIDLLAPYRQGGKVGLFGGAGVGKTVLIQELINNIAKEHGGVSVFGGVGERTREGNDLYEEFKESGVINADDLTQSKVALCFGQMNEPPGARMRVGLSALTMAEHFRDVNKQDVLLFVDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPSVVGDEHYRTARAVQSTLQRYKELQDIIAILGLDELSEDDRRTVDRARKIEKFLSQPFFVAEIFTGMSGKYVKLEDTIAGFNMILSGELDDLPEQAFYLVGNITEVKEKAQKISADAKK

SEQ ID NO: 7232 - DNA, 1467 bp, Prochlorococcus marinus
  CDS (1)..(1467): transl_table=11
atggccgctgcagctaccgccaccgccggcaccaagggcgtcattcgtcaggtgattggcccggttctggatgtggaattccctgccggcaagctgcccaagatcctcaatgcccttcgcattgagggcaagaacccatccggtcaggatgttgccatcactgccgaagtgcagcaactcctcggcgaccatcgagtgcgtgcggtctccatgagcagcacggatggtctggttcgtggcatggaagccctcgacaccggcgctgcaatttccgtgcccgttggtgaagccactctgggcaggatcttcaacgtgctcggcgaaccagttgatgagcagggtcctgttacaaccgatgcaactgccccgattcacagaccatcaccaaaactcactgagctagagaccaaaccaacagtttttgaaactggcatcaaggtgattgatctcctggctccttaccgtcaaggcggcaaggttggcctcttcggtggtgccggtgttggcaagaccgtgctgattcaggagctgatcaataacatcgccaaagaacacggtggtgtgtctgtctttggtggtgtgggcgagcgcactcgtgaaggcaacgacctctacgaggaattcaaagaatccggagtgatcaactccgacgacctatcgaagtcgaaggtagctctttgcttcgggcagatgaatgagccccctggcgcccggatgcgcgttgggctttcagctctcaccatggctgagcacttccgcgacgtgaacaagcaagacgtgctgctgttcatcgacaacatcttccgttttgtgcaagccggatcagaagtttctgctttgttgggtcgcatgccttccgccgtgggttaccagcccacccttggcaccgacgttggtgcacttcaagagcgcatcacatcaaccctagagggatcgattacctcgattcaggccgtctacgttcccgctgatgacctcaccgaccccgcaccagccacaacatttgcccacttagacgccacaactgtgctggctcgtgcattggccgccaagggcatttacccagctgtggatcctttggattccaccagcaccatgcttcagccatcagttgttggtgatgagcattaccgcacagcacgaagcgtgcaggccacactccagcgctacaaggaactgcaagacatcattgccatccttggtctcgacgaactctcagaagatgatcgccgcacagtagatcgagcccgcaagattgagaagttcctttcccagcctttctttgtcgccgagatttttaccggcatgtccggcaagtacgtcaagctggaagaaaccatcgccggcttcaatatgatcatgtccggtgaactagaccatctccctgagcaagccttctacctggttggcaacatcgacgaggtcaaagctaaggccgagaagatggcttcagaagcaaagggttga

SEQ ID NO: 7233 - protein, 488 aa, Prochlorococcus marinus
MAAAATATAGTKGVIRQVIGPVLDVEFPAGKLPKILNALRIEGKNPSGQDVAITAEVQQLLGDHRVRAVSMSSTDGLVRGMEALDTGAAISVPVGEATLGRIFNVLGEPVDEQGPVTTDATAPIHRPSPKLTELETKPTVFETGIKVIDLLAPYRQGGKVGLFGGAGVGKTVLIQELINNIAKEHGGVSVFGGVGERTREGNDLYEEFKESGVINSDDLSKSKVALCFGQMNEPPGARMRVGLSALTMAEHFRDVNKQDVLLFIDNIFRFVQAGSEVSALLGRMPSAVGYQPTLGTDVGALQERITSTLEGSITSIQAVYVPADDLTDPAPATTFAHLDATTVLARALAAKGIYPAVDPLDSTSTMLQPSVVGDEHYRTARSVQATLQRYKELQDIIAILGLDELSEDDRRTVDRARKIEKFLSQPFFVAEIFTGMSGKYVKLEETIAGFNMIMSGELDHLPEQAFYLVGNIDEVKAKAEKMASEAKG

SEQ ID NO: 7234 - DNA, 1467 bp, Prochlorococcus marinus
  CDS (1)..(1467): transl_table=11
atggccgcttctgctaccgctactgttggaactaagggtgttgttcgccaagtaattggtcctgttttagatgttgaattcccagctggcaagctgccttcaattcttaatgcattaaggattgaaggcaaaaatcctgctggtcaagatgttgcactgactgctgaagttcaacaattattaggtgatcatcgggttagagccgttgctatgagcggaactgatggattagttagaggtatggaagctttagacacaggagctccaatttctgtacctgttggtgaagccacccttggaagaattttcaacgtccttggagaacctgtagatgagcaaggcgaccttaagaacgtaactacctctccaatacatcgatcagccccaagccttacagatttagaaacaaaaccaaaagtatttgagactggtatcaaagttatcgatttgctggctccataccgtcagggtggaaaagttggattatttggtggggctggagtaggtaaaacagttctaattcaagagctcataaacaatattgccaaagagcatggtggcgtatcagtttttggtggagtgggagaaagaactagagaaggtaacgatttatatgaagaatttaaagagtctggtgtgattaattctgaagatctaaccaagtcaaaattagctttgtgctttggtcaaatgaatgagcccccaggcgcaagaatgagggtgggcctatctgccttgactatggctgagcatttccgtgacgtaaataagcaagatgttcttctgttcatcgataatatcttcagatttgttcaggctggatcagaagtatctgctttgctagggcgtatgccatctgctgttggatatcagccaaccttaggaactgacgtgggagagcttcaagaaaggattacctctacccttgaaggatctatcacctcaattcaggctgtttatgtacctgctgacgacttaacggaccctgcacctgctactacttttgctcacttagacgcaactacagttttagcaagagctcttgcagccaagggaatttatcctgctgttgatccacttgactcaaccagcacaatgttacagccgtctgttgtaggagatgagcattaccgcacggccagagctgttcaatcaacacttcagagatataaggaattgcaagatattattgcgattttgggattggacgaactatcagaagaggataggaagacagttgatcgtgcccgcaaaattgagaaattcttatctcaaccattctttgttgctgaaatatttacaggtatgtcaggtaaatacgtcaaattagaagatacgattaaaggtttcaatatgattctttcaggtgaacttgaccaactccctgagcaagctttctatcttgttggaagcattgatgaagtgaaagctaaagcagaaaaaatagcatctgaagcaaaagcttaa

SEQ ID NO: 7235 - protein, 488 aa, Prochlorococcus marinus
MAASATATVGTKGVVRQVIGPVLDVEFPAGKLPSILNALRIEGKNPAGQDVALTAEVQQLLGDHRVRAVAMSGTDGLVRGMEALDTGAPISVPVGEATLGRIFNVLGEPVDEQGDLKNVTTSPIHRSAPSLTDLETKPKVFETGIKVIDLLAPYRQGGKVGLFGGAGVGKTVLIQELINNIAKEHGGVSVFGGVGERTREGNDLYEEFKESGVINSEDLTKSKLALCFGQMNEPPGARMRVGLSALTMAEHFRDVNKQDVLLFIDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPSVVGDEHYRTARAVQSTLQRYKELQDIIAILGLDELSEEDRKTVDRARKIEKFLSQPFFVAEIFTGMSGKYVKLEDTIKGFNMILSGELDQLPEQAFYLVGSIDEVKAKAEKIASEAKA

SEQ ID NO: 7236 - DNA, 1377 bp, Pseudomonas aeruginosa
  CDS (1)..(1377): transl_table=11
atgagtagcggacgtatcgttcaaatcatcggcgccgtgatcgacgtggaattcccgcgcgatgccgtgccgagcatctatgaagccctgaaggttcagggcgttgaaaccaccctggaagtccagcagcagctgggcgacggcgtggttcgttccattgcgatgggttccaccgaaggcctcaagcgtggcctgaacgtggacagcactggtgctgccatctccgtgccggtcggtaaagcgaccctgggccggatcatggacgtactgggtaacccgatcgacgaagccggtcccatcggcgaagaagagcgctggggcatccaccgcgaagctccgtcctatgccgaccaggctggcggcaacgagctgctggaaaccggcatcaaggtgatcgacctggtctgcccgttcgccaagggcggcaaggtaggcctgttcggcggcgccggcgtgggcaagaccgtcaacatgatggaactgatccgtaacatcgccatcgagcacagcggttattccgtgttcgcgggtgtgggcgagcgtactcgtgagggtaacgacttctaccacgagatgaaggactccaacgtactggacaaggtagccctggtatacggccagatgaacgagccgccgggcaaccgtctgcgcgtcgcactgaccggcctgaccatggccgagaagttccgtgacgaaggccgtgacgttctgttgttcatcgacaacatctaccgttacaccctcgccggtaccgaagtatccgcactgctgggccgtatgccgtccgcggtgggctatcagccgaccctggccgaagagatgggcgttctgcaggagcgcatcacctccaccaagaaaggctcgatcacctcgatccaggccgtatacgttcccgcggacgacctcaccgacccgtccccggcgaccaccttcgcccacctggacgcgaccgtcgtactgtcccgtgacatcgcctcgctgggtatctaccccgcggtcgacccgctggactccacctctcgccagctcgatccgctggtgatcggccaggatcactacgacaccgctcgcggcgtccagtatgttctgcagcgctacaaggagctgaaggacatcatcgcgatcctgggcatggacgaactgtccgaagccgacaagctgctggtggcgcgcgctcgtaagatccagcgcttcctgtcccagccgttcttcgtagcggaagtcttcaccggctcgccgggcaagtacgtttccctgaaggacaccatcgctggcttcaagggcattctcaacggcgactacgatcacctgccggagcaggcgttctacatggtcggcggtatcgaagaagcagtcgagaaagccaaaaaactgtaa

SEQ ID NO: 7237 - protein, 458 aa, Pseudomonas aeruginosa
MSSGRIVQIIGAVIDVEFPRDAVPSIYEALKVQGVETTLEVQQQLGDGVVRSIAMGSTEGLKRGLNVDSTGAAISVPVGKATLGRIMDVLGNPIDEAGPIGEEERWGIHREAPSYADQAGGNELLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGRDVLLFIDNIYRYTLAGTEVSALLGRMPSAVGYQPTLAEEMGVLQERITSTKKGSITSIQAVYVPADDLTDPSPATTFAHLDATVVLSRDIASLGIYPAVDPLDSTSRQLDPLVIGQDHYDTARGVQYVLQRYKELKDIIAILGMDELSEADKLLVARARKIQRFLSQPFFVAEVFTGSPGKYVSLKDTIAGFKGILNGDYDHLPEQAFYMVGGIEEAVEKAKKL

SEQ ID NO: 7238 - DNA, 1377 bp, Pseudomonas fluorescens
  CDS (1)..(1377): transl_table=11
atgagtagcggacgtatcgttcaaatcatcggcgccgttatcgacgtggaatttccacgcgacagcgtaccgagcatctacgacgccttgaaggttcaaggcgccgaaaccactctggaagttcagcagcagctgggcgacggcgtggtgcgtaccattgcgatgggctccaccgaaggcttgaagcgcggtctggacgtcaacaacactggcgcagccatctccgtaccggtcggtaaagcgaccctgggccggatcatggacgtactgggcaacccaatcgacgaagccggtcctatcggtgaagaagagcgttggggcatccaccgtccagcaccttccttcgcagaacaggcaggcggcaacgacctgctggaaaccgggatcaaggtaattgacctggtttgcccgttcgccaagggcggtaaagtcggtctgttcggtggtgccggtgtaggcaagaccgtaaacatgatggaactgatccgtaacatcgccatcgagcacagcggttattccgtgttcgccggtgtgggtgagcgtactcgtgagggtaacgacttctaccacgagatgaaggactccaacgttctggacaaagtggcactggtctacggccagatgaacgagccgccgggaaaccgtctgcgcgtagccctgaccggcctgaccatggccgagaagttccgtgacgaaggtaacgacgttctgctgttcgtcgacaacatctaccgttacaccctggccggtaccgaagtatccgcactgctgggccgtatgccttccgcagtaggctaccagccgaccctggctgaagagatgggcgttctgcaagaacgtatcacttcgaccaagcaaggctcgatcacctcgatccaagcggtatacgtacctgcggacgacttgaccgacccgtcgccagcgaccaccttcgcccacttggacgccaccgtcgttctgtcccgtgacatcgcttccctgggtatctacccagcggtagacccactggactcgacctcccgtcagctggacccgaacgtgatcggcaacgaacactacgagaccgctcgcggcgttcagtacgtactgcagcgttacaaagagctgaaggacatcattgcgatcctgggtatggacgagctgtcggaaaccgacaagcagttggtatcccgcgctcgtaagatccagcgcttcttgtcgcagccgttcttcgtggctgaagtcttcactggttctccaggcaaatacgtttccctgaaagacaccatcgctggcttcaaaggcatcctcaacggtgactacgaccacctgccagaacaagcgttctacatggtcggcggcatcgacgaagcgatcgagaaagccaagaaactgtaa

SEQ ID NO: 7239 - protein, 458 aa, Pseudomonas fluorescens
MSSGRIVQIIGAVIDVEFPRDSVPSIYDALKVQGAETTLEVQQQLGDGVVRTIAMGSTEGLKRGLDVNNTGAAISVPVGKATLGRIMDVLGNPIDEAGPIGEEERWGIHRPAPSFAEQAGGNDLLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKQGSITSIQAVYVPADDLTDPSPATTFAHLDATVVLSRDIASLGIYPAVDPLDSTSRQLDPNVIGNEHYETARGVQYVLQRYKELKDIIAILGMDELSETDKQLVSRARKIQRFLSQPFFVAEVFTGSPGKYVSLKDTIAGFKGILNGDYDHLPEQAFYMVGGIDEAIEKAKKL

SEQ ID NO: 7240 - DNA, 1377 bp, Pseudomonas fluorescens
  CDS (1)..(1377): transl_table=11
atgagtagcggacgtatcgttcaaatcatcggcgccgttatcgacgtggaatttccacgcgacagcgtaccgagcatctacgacgccttgaaggttcaaggcgccgaaaccactctggaagttcagcagcagctgggcgacggcgtggttcgtaccattgcgatgggctccaccgaaggcttgaagcgcggtctggacgtcaacaacactggcgcagccatctccgtaccggtcggtaaagcgactctgggccggatcatggacgtactgggcaacccgatcgacgaagctggcccgatcggcgaagaagagcgctggggtatccaccgcgccgctccttccttcgctgaacaagccggtggcaacgagctgctggaaacaggcatcaaggttatcgacctggtttgcccgttcgccaagggcggtaaagtcggtctgttcggtggtgccggtgtaggcaagaccgtaaacatgatggaactgatccgtaacatcgccatcgagcacagcggttattccgtgttcgccggtgtgggtgagcgtactcgtgagggtaacgacttctaccacgagatgaaggactccaacgttctcgacaaggtagccctggtctacggtcagatgaacgagccaccgggaaaccgtctgcgcgtagcgctgaccggtctgaccatggccgagaagttccgtgacgaaggtaacgacgttctgctgttcgtcgacaacatctatcgttacaccctggccggtaccgaagtatccgcactgctgggccgtatgccttcggcagtaggttaccagccgaccctggctgaagagatgggcgtgctgcaagagcgcatcacttcgaccaagcaaggttcgattacttcgatccaggccgtatacgtaccagcggacgacttgactgacccgtcgccagcgaccacgtttgctcacctggacgccaccgtcgttctgtcccgtgacatcgcttctctgggtatctacccggcggtagacccactggactcgacttcgcgtcagctggacccgaacgtgatcggcaacgatcactacgagaccgctcgtggtgttcagtacgtgctgcagcgttacaaagagctgaaggacatcatcgcgatcctgggtatggacgagctgtcggaagccgacaagcagttggtaaaccgtgctcgtaagatccagcgcttcttgtcgcagccgttcttcgtggctgaagtcttcaccggtgcttcgggtaaatacgtttccctgaaagacaccattgctggcttcaaaggcatcctcaacggtgactacgaccacctgccagaacaagcgttctacatggtcggcggcatcgaagaagcgatcgagaaagccaagaaactgtaa

SEQ ID NO: 7241 - protein, 458 aa, Pseudomonas fluorescens
MSSGRIVQIIGAVIDVEFPRDSVPSIYDALKVQGAETTLEVQQQLGDGVVRTIAMGSTEGLKRGLDVNNTGAAISVPVGKATLGRIMDVLGNPIDEAGPIGEEERWGIHRAAPSFAEQAGGNELLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKQGSITSIQAVYVPADDLTDPSPATTFAHLDATVVLSRDIASLGIYPAVDPLDSTSRQLDPNVIGNDHYETARGVQYVLQRYKELKDIIAILGMDELSEADKQLVNRARKIQRFLSQPFFVAEVFTGASGKYVSLKDTIAGFKGILNGDYDHLPEQAFYMVGGIEEAIEKAKKL

SEQ ID NO: 7242 - DNA, 1377 bp, Pseudomonas putida
  CDS (1)..(1377): transl_table=11
atgagtagcggacgtatcgttcaaatcatcggcgccgtcatcgacgtggaattcccacgtgacgtcgtgccgagtgtatacaacgcgcttaaagtacaaggcgcggaaaccaccctggaagttcagcagcagctgggcgacggcgtggttcgtaccattgcgatgggctcgaccgaaggcctgaagcgcggtctggatgtcgtcgacaccggcgctgccatttccgttccagttggtaaggccaccctgggccgtatcatggacgtactgggcaacccgatcgacgaagccggcccgatcggcgaagaagagcgtcgcggtatccaccagccagcgccttcgttcgctgaccaggcaggcggcaacgacctgctggaaaccggcatcaaggttatcgacctggtttgcccgttcgccaagggtggtaaggttggtctgttcggtggtgccggtgtcggcaagaccgtaaacatgatggaactgatccgtaacatcgccatggaacacagcggttactccgtgttcgctggtgtgggtgagcgtactcgtgagggtaacgacttctaccacgagatgaaggactccaacgttctcgacaaagtagcgctggtctacggtcagatgaacgagccaccaggaaaccgtctgcgtgtagcgctgaccggcctgaccatggccgagaagttccgtgacgaaggtaacgacgttctgctgttcgtcgacaacatctatcgttacaccctggccggtaccgaagtatccgcactgctgggccgtatgccttcggcagtaggttaccagccgaccctggctgaagagatgggcgttctgcaagagcgcatcacctccaccaaggaaggttcgatcacctccgtacaggccgtatacgtacctgcggacgacttgaccgacccgtcgccagcgaccaccttcgcccacttggacgccaccgtcgttctgtcccgtgacatcgcctccctgggtatctacccagcggtcgacccactggactcgacttcgcgccagctggacccgaacgtgatcggcaacgagcactacgagaccgctcgtggcgttcagtatgttctgcagcgctataaagagctgaaggacatcattgcgatcctgggtatggacgaactgtccgaagccgacaagcaactggtagcccgcgctcgtaagatccagcgcttcctgtcgcagccgttcttcgtggcagaagtcttcaccggttcgccaggcaagtacgtttccctgaaagacaccatcgctggcttcagcggcatcctcaaaggtgactacgaccacctgccagaacaagcgttctacatggtcggcagcatcgacgaagcgatcgagaaagccaagaaactgtaa

SEQ ID NO: 7243 - protein, 458 aa, Pseudomonas putida
MSSGRIVQIIGAVIDVEFPRDVVPSVYNALKVQGAETTLEVQQQLGDGVVRTIAMGSTEGLKRGLDVVDTGAAISVPVGKATLGRIMDVLGNPIDEAGPIGEEERRGIHQPAPSFADQAGGNDLLETGIKVIDLVCPFAKGGKVGLFGGAGVGKTVNMMELIRNIAMEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKEGSITSVQAVYVPADDLTDPSPATTFAHLDATVVLSRDIASLGIYPAVDPLDSTSRQLDPNVIGNEHYETARGVQYVLQRYKELKDIIAILGMDELSEADKQLVARARKIQRFLSQPFFVAEVFTGSPGKYVSLKDTIAGFSGILKGDYDHLPEQAFYMVGSIDEAIEKAKKL

SEQ ID NO: 7244 - DNA, 1404 bp, Ralstonia eutropha
  CDS (1)..(1404): transl_table=11
atgagtatcggaaatattgtgcagtgcattggcgccgtggtggacatcgagttcccgcgcaacgcaatgccgaaggtgtacgacgcgctggtgctggaagacagcagcgaaacgtcgtttgccgaaaagggcctgacgttcgaagtccagcagcagctgggcgacggcgtggtgcgtaccattgccctcggttcgtcggacggcctgcgccgcggcatggccgtgaagaacaccgaagcgccgatctcggtgccggtgggtcagggcacgctgggccgcatcatggacgtgctgggtcgccccatcgacgaagctggcccgatcgcttcggacgagcgccgcgcgattcaccagaaggcaccgaagttcgacgaactgtcgccttcgaccgacctgctcgaaaccggcatcaaggtgatcgacctgatctgcccgttcgcaaagggcggtaaggttggcctgttcggtggtgctggcgtgggcaagaccgtcaacatgatggagctcatcaacaacatcgccaagcagcacagcggtctgtcggtgttcgccggcgtgggcgagcgtacccgtgaagggaacgacttctaccacgaaatgaaggactccaacgtgctcgacaaggtggccatggtgttcggccagatgaacgagccgccgggcaaccgtctgcgcgtggcactctccggcctgaccatggccgagaagttccgcgacgaaggccgcgacatcctgttcttcgtcgacaacatctaccgctacacgctggccggtaccgaagtgtcggcactgctgggccgtatgccttccgccgtgggctaccagccgacgctggctgaagaaatgggcaagctgcaggaacgtattacgtcgaccaagactggctcgatcacgtcgatccaggccgtgtacgtgcctgcggatgacttgaccgacccgtcgccggcaaccaccttcctgcacctggactcgaccctcgtgctgtcgcgtgacatcgctgcgctcggtatctaccccgcagtggatccgctggactcgacctcgcgccagatggacccgcaggttgtgggccaggagcactacaatgtcgcgcgtgccgttcagcagacgctgcagcgctacaaggaactgcgcgacatcatcgcgattctgggcatggacgaactgtcgccggaagacaagatggccgtgaaccgcgcgcgtaagatccagcgtttcctgtcgcagccgttccacgtggccgaagtgttcacgggttcgccgggcaagtacgtgccgctgaaggaaaccatccgtggtttcaagatgctggtggatggcgagtgcgatcacctgcccgagcaggcgttctacatggtcggctcgatcgacgaagccttcgagaaggccaagaagctccagtaa

SEQ ID NO: 7245 - protein, 467 aa, Ralstonia eutropha
MSIGNIVQCIGAVVDIEFPRNAMPKVYDALVLEDSSETSFAEKGLTFEVQQQLGDGVVRTIALGSSDGLRRGMAVKNTEAPISVPVGQGTLGRIMDVLGRPIDEAGPIASDERRAIHQKAPKFDELSPSTDLLETGIKVIDLICPFAKGGKVGLFGGAGVGKTVNMMELINNIAKQHSGLSVFAGVGERTREGNDFYHEMKDSNVLDKVAMVFGQMNEPPGNRLRVALSGLTMAEKFRDEGRDILFFVDNIYRYTLAGTEVSALLGRMPSAVGYQPTLAEEMGKLQERITSTKTGSITSIQAVYVPADDLTDPSPATTFLHLDSTLVLSRDIAALGIYPAVDPLDSTSRQMDPQVVGQEHYNVARAVQQTLQRYKELRDIIAILGMDELSPEDKMAVNRARKIQRFLSQPFHVAEVFTGSPGKYVPLKETIRGFKMLVDGECDHLPEQAFYMVGSIDEAFEKAKKLQ

SEQ ID NO: 7246 - DNA, 1404 bp, Ralstonia solanacearum
  CDS (1)..(1404): transl_table=11
atgagtatcggaacgattgtgcagtgcatcggcgccgtggtggacatccagttcccgcgcgacgcgatgcccaaggtctacgacgcgctcgtgctgcaggacagcggcgaagcgtcgttcgccgagaagggcctgagcttcgaagtgcaacaacagctgggcgacggcgtggtgcgtaccattgcgctgggttcgtcggacggcctgcgccgcggcatgccggtgtcgaacactggcgcgccgatctcggtgcccgtcggccacggcacgctgggccgcatcatggacgtgctgggtcgcccgatcgacgaagccggtccgatcgccgccgatgaaaagcgcgcgattcaccagaaggccccgaagttcgacgaactgtcgccgtcggtggacctgctggaaaccggcatcaaggtgatcgacctggtttgcccgttcgccaagggcggcaaggtgggtctgttcggtggcgccggcgtcggcaagaccgtgaacatgatggagctgatcaacaacatcgccaagcagcactcgggcttgtcggtgtttgctggcgtgggcgagcgtacccgtgagggcaacgacttctaccacgaaatgaaggactccaacgtgctcgacaaggtggccatggtgttcggccagatgaacgagccgccgggcaaccgtctgcgcgtggcgctgaccggcctgaccatggccgagcgcttccgtgacgaaggccgcgacatcctgttcttcgtcgacaacatctaccgctacacgctggccggtaccgaagtgtcggcactgctgggccggatgccttccgccgtgggctatcagccgacgctggctgaagaaatgggcaagctgcaggagcgcatcacgtcgaccaagaccggttcgatcacgtcgatccaggccgtgtacgtgcctgcggatgacttgaccgatccgtcgcccgctacgaccttcctgcacctggactcgaccgtcgtgctgtcgcgtgacatcgctgcgctgggtatctaccccgccgtcgatccgctcgactcgacctcgcgtcagctggatccgcaaatcgtcggtacggaacactacgaagtggcccgccgcgtgcagcagaccctgcagcgctacaaggaactgcgcgacatcatcgcgattctgggcatggacgaactgtcgccggaagacaagctggccgtgggccgcgcccgtaagatccagcgtttcctgtcgcagccgttccacgtggccgaagtgttcacgggttcgccgggcaagtacgtgccgctgaaggaaaccatccgcggcttcaagatgctggtggatggcgagtgcgatcacctgccggagcaggcgttctacatggtcggctcgatcgacgaggccttcgagaaggccaagaagctccagtaa

SEQ ID NO: 7247 - protein, 467 aa, Ralstonia solanacearum
MSIGTIVQCIGAVVDIQFPRDAMPKVYDALVLQDSGEASFAEKGLSFEVQQQLGDGVVRTIALGSSDGLRRGMPVSNTGAPISVPVGHGTLGRIMDVLGRPIDEAGPIAADEKRAIHQKAPKFDELSPSVDLLETGIKVIDLVCPFAKGGKVGLFGGAGVGKTVNMMELINNIAKQHSGLSVFAGVGERTREGNDFYHEMKDSNVLDKVAMVFGQMNEPPGNRLRVALTGLTMAERFRDEGRDILFFVDNIYRYTLAGTEVSALLGRMPSAVGYQPTLAEEMGKLQERITSTKTGSITSIQAVYVPADDLTDPSPATTFLHLDSTVVLSRDIAALGIYPAVDPLDSTSRQLDPQIVGTEHYEVARRVQQTLQRYKELRDIIAILGMDELSPEDKLAVGRARKIQRFLSQPFHVAEVFTGSPGKYVPLKETIRGFKMLVDGECDHLPEQAFYMVGSIDEAFEKAKKLQ

SEQ ID NO: 7248 - DNA, 1515 bp, Rhizobium meliloti
  CDS (1)..(1515): transl_table=11
atggctaaggcagctaccccgaaagaaaccgcagcggcgaagaagccggctgctccgaagaaggcagcttccgccaagacagtcgttgcggctacgggtgctgtcggccgcgtgacgcaggtcatcggcgccgtcgtcgacgtcgcattcgaagaaggccagctcccgcagatcctgaacgcgctggaaaccgacaacaacggcaaccgcctcgttctcgaagttgcgcagcatctcggcgaaaactccgtccgcacgatcgccatggactcgaccgaaggtctcgttcgcggccagaaggtcgccgacacgggcggcccgatcgcggttccggtcggcaaggaaacgctcggccgcatcatgaacgtcatcggcgagccggtcgacgaagccggcccgctgaagacttccgcccgccgcgccatccaccaggaagcgccggcctatgtggaccagtcgacggaagcgcagattctcgtcaccggcatcaaggtcgtcgacctgctcgctccctatgcgaagggcggcaagatcggcctcttcggcggcgcgggcgtcggcaagaccgtgctgatcatggaactgatcaacaacgtcgccaaggcgcacggcggttactccgtcttcgcaggcgtcggtgaacggacccgcgaaggcaacgacctctatcacgaaatgatcgagtccggcgtgaacaagcatggcggcggcgaaggttccaaggccgcgctcgtctacggccagatgaacgagccgccgggcgcccgcgcacgcgtcgcgctgaccggcctgacggtcgccgaacagttccgtgacgaaggccaggacgttctcttcttcgtcgacaacatcttccgcttcacccaggcaggctcggaagtgtcggctctgctcggccgtattccttcggccgtgggctatcagccgacgctggcaaccgacatgggccagatgcaggagcgcatcaccaccacgaccaagggctcgatcacctcggttcaggcgatttacgttccggccgacgatttgaccgacccggcaccggcgacctcgttcgcgcacctcgatgcgacgacggttctgtcgcgctcgatcgccgaaaagggcatctacccggccgtggatccgctcgactcgacctcgcgcatgctggacccgatgatcgtcggcgaagagcattacgaagtgtcgcgcaaggtgcagtcgaccctgcagcgctacaaggccctgcaggacatcatcgcgatcctgggcatggacgagctttccgaagaggacaagatcgccgtcgcccgcgcccgcaagatcgagcgtttcctgtcgcagccgttcttcgtcgccgaagtcttcaccggctcgccgggcaagctggttgcgctcgaagacacgatcaagggcttcaagggcctcgtcaacggcgagtacgaccacctgccggaagccgccttctacatggtcggttccatcgaggaagccgtcgagaaggccaagaagctggctgccgaagccgcctga

SEQ ID NO: 7249 - protein, 504 aa, Rhizobium meliloti
MAKAATPKETAAAKKPAAPKKAASAKTVVAATGAVGRVTQVIGAVVDVAFEEGQLPQILNALETDNNGNRLVLEVAQHLGENSVRTIAMDSTEGLVRGQKVADTGGPIAVPVGKETLGRIMNVIGEPVDEAGPLKTSARRAIHQEAPAYVDQSTEAQILVTGIKVVDLLAPYAKGGKIGLFGGAGVGKTVLIMELINNVAKAHGGYSVFAGVGERTREGNDLYHEMIESGVNKHGGGEGSKAALVYGQMNEPPGARARVALTGLTVAEQFRDEGQDVLFFVDNIFRFTQAGSEVSALLGRIPSAVGYQPTLATDMGQMQERITTTTKGSITSVQAIYVPADDLTDPAPATSFAHLDATTVLSRSIAEKGIYPAVDPLDSTSRMLDPMIVGEEHYEVSRKVQSTLQRYKALQDIIAILGMDELSEEDKIAVARARKIERFLSQPFFVAEVFTGSPGKLVALEDTIKGFKGLVNGEYDHLPEAAFYMVGSIEEAVEKAKKLAAEAA

SEQ ID NO: 7250 - DNA, 1437 bp, Rhodopseudomonas blastica
  CDS (1)..(1437): transl_table=11
atgacaatggcaacgactgtctccaaaggtaaggtgacccaggtcatcggcgccgtcgtggacgttcagttcgaaggcgttcttcccgcgattctgaacgcgctggaaaccaccaacaacggcaagaagctgatcctggaagtcgcccagcacctgggcgagaacacggtccgctgcatcgccatggatgccaccgaaggcctcgtgcgcggcgccccggtcagcgacagcggcaccccgatctcggtgccggtgggcaatgccacgctgggccgcatcctgaacgtcgtcggggaaccgattgacgagcgcggcccgatcgcggccacggaaaagcgcgccattcaccagaaggcgcccgacttccagtcgcagtcgaccgaatcgcagatccttgtcaccggcatcaaggtgatcgacctgctggccccctattccaagggcggcaagatcggcctgttcggcggcgccggcgtgggcaagacggttctcattcaggaactgatcaacaacatcgccaaggtgcactcgggctactcggtgttcgccggcgtgggcgaacggacccgtgaaggcaacgacctgtatcacgagttcatcgaatcgggcgtcatcaacatcgacgatctggaaaagtcgaaggtggcccttgtgtacggccagatgaacgaacctccgggggcgcgtgcccgcgtggcgctgaccggcctgacgctggccgagcagttccgtgaccagtccggcaccgacgttctgttcttcgtggacaacatcttccgcttcacccaggcgggttcggaagtgtcggctctgctgggccgtatcccttcggccgtgggctaccagccgacgctggccaccgacatggggcagcttcaggaacgcatcacctcgaccaaggcgggttcgatcacctcggttcaggcgatctacgttccggccgacgacctgaccgaccccgcgccggccacgtccttcgcccacctcgacgccacgaccaccctgtcgcgcgccatttcggaactggggatctatccggcggttgacccgctcgactcgacctcgcgtctgatggacccgcagatcctgggcgaagagcactacaacaccgcccgtgcggtgcagggcatccttcagcgctacaagtcgctgcaggacatcatcgccatccttggcatggacgaactgtcggaagaggacaagctgaccgtggcccgcgcccggaagatccagcggttcctgtcgcagccgttcgacgtggcgcaggtcttcaccggctcgcccggcgtgcaggtgccgctggacaagaccatcgcctcgttcaaggcggttgtggccggcgaatacgaccacctgccggaagcggccttctacatggtcggcgacatcgaggaagccaaggccaaggccgcgaagcttgccgcggctgcggcctaa

SEQ ID NO: 7251 - protein, 478 aa, Rhodopseudomonas blastica
MTMATTVSKGKVTQVIGAVVDVQFEGVLPAILNALETTNNGKKLILEVAQHLGENTVRCIAMDATEGLVRGAPVSDSGTPISVPVGNATLGRILNVVGEPIDERGPIAATEKRAIHQKAPDFQSQSTESQILVTGIKVIDLLAPYSKGGKIGLFGGAGVGKTVLIQELINNIAKVHSGYSVFAGVGERTREGNDLYHEFIESGVINIDDLEKSKVALVYGQMNEPPGARARVALTGLTLAEQFRDQSGTDVLFFVDNIFRFTQAGSEVSALLGRIPSAVGYQPTLATDMGQLQERITSTKAGSITSVQAIYVPADDLTDPAPATSFAHLDATTTLSRAISELGIYPAVDPLDSTSRLMDPQILGEEHYNTARAVQGILQRYKSLQDIIAILGMDELSEEDKLTVARARKIQRFLSQPFDVAQVFTGSPGVQVPLDKTIASFKAVVAGEYDHLPEAAFYMVGDIEEAKAKAAKLAAAAA

SEQ ID NO: 7252 - DNA, 1419 bp, Rhodobacter capsulatus
  CDS (1)..(1419): transl_table=11
atggcaagcaaaggcaaagtgacccaggtcatcggcgccgtcgtcgacgtgcagttcgaagacggcctcccggcgattctgaacgcccttgaaaccaccaacaacggcaagcgcctcgttctcgaagtggcgcagcacctgggcgagaacaccgtccgcaccatcgcgatggacgcgaccgagggtctcgtgcgcggcgcggccgtgtccgacaccggcggcccgatcaccgttccggtgggcaacgccaccctgggccgcatcctgaacgtcatcggcgagccggtggacgaacgcggtgacgtgtcgaaagccgaagcccgggcgatccaccagcccgcgcccgatttcgcggcgcagtcgacggaaagccagatcctcgtcaccggcatcaaggtgatcgacctgctcgccccctattccaagggcggcaagatcggtctcttcggcggcgccggtgtgggcaagaccgttctgatcatggaactgatcaacaacatcgcgaaagtgcactcgggcttctcggtgttcgcgggcgttggcgaacggacccgtgagggcaacgacctttaccacgagatgatcgaatcgggcgttatcaacctcgagaagctcgaagaatcgaaagtggcgctggtctacggccagatgaacgaacccccgggggcccgtgcccgcgtggcgctgaccggcctgaccctggcggaacagttccgcgaccagtcgggcaccgacgtgctgttcttcgtcgacaacatcttccgcttcacccaggccggttcggaagtgtcggcgctccttggccgtatcccctcggccgtgggctaccagccgacgctggccaccgacatgggcgcgctgcaagaacgcatcacctcgaccaaagccggttcgatcacctcggttcaggccatctacgttccggccgacgaccttaccgacccggccccggccacgtcctttgcccacctcgacgccacgaccgttctgtcgcgtgcgatctcggaactcgggatctacccggccgtcgacccgctcgactccacctcgcggatccttgacccgcaagtcgtcggcgaagagcactatcaggtcgcccgtgacgtccaagggatgctgcaacgctacaagtcgctgcaggacatcatcgccatcctcggcatggacgaactgtcggaagaagacaagctgacggtggcccgcgcccggaagatccagcgcttcctgtcgcagcccttcgacgtggcgaaagtcttcaccggctcggacggcgtgcaggttccgctcgaagacaccatcaagtcgttcaaggcggtggttgcgggcgaatacgaccacctgccggaagcggccttctacatggtcggcggcatcgatgacgtgatcgcgaaagcccagcgcctcgccgctgcggcgtaa

SEQ ID NO: 7253 - protein, 472 aa, Rhodobacter capsulatus
MASKGKVTQVIGAVVDVQFEDGLPAILNALETTNNGKRLVLEVAQHLGENTVRTIAMDATEGLVRGAAVSDTGGPITVPVGNATLGRILNVIGEPVDERGDVSKAEARAIHQPAPDFAAQSTESQILVTGIKVIDLLAPYSKGGKIGLFGGAGVGKTVLIMELINNIAKVHSGFSVFAGVGERTREGNDLYHEMIESGVINLEKLEESKVALVYGQMNEPPGARARVALTGLTLAEQFRDQSGTDVLFFVDNIFRFTQAGSEVSALLGRIPSAVGYQPTLATDMGALQERITSTKAGSITSVQAIYVPADDLTDPAPATSFAHLDATTVLSRAISELGIYPAVDPLDSTSRILDPQVVGEEHYQVARDVQGMLQRYKSLQDIIAILGMDELSEEDKLTVARARKIQRFLSQPFDVAKVFTGSDGVQVPLEDTIKSFKAVVAGEYDHLPEAAFYMVGGIDDVIAKAQRLAAAA

SEQ ID NO: 7254 - DNA, 1431 bp, Rhodopseudomonas palustris
  CDS (1)..(1431): transl_table=11
atggctacacccgccaatcagaccggacgcatcacgcaggtcatcggcgccgtcgtcgacgttcagttcgaagggcacctgccggccattctgaacgccatcgaaaccaagaacggcgacaaccgcctggtgctcgaagttgcgcagcatctcggtgaatcgaccgtccgcaccatcgcgatggacaccaccgaaggtctggtccgtggccaggaagtcaccgacactggcgcgccgatctcggtaccggtcggcgccggcacgctcggccgcatcatgaacgtgatcggcgagccggtcgatgagcagggcccgatcaagtcggaaggcctccgcgccatccaccaggaagcgccggcctacaccgaccagtcgaccgaggctgaaattctcgtcaccggcatcaaggtcgtcgacctgctggcgccttacgccaagggcggtaagatcggcctgttcggcggcgccggcgtcggcaagaccgtgctgattcaggaactgatcaacaacgtcgcccgcgctcacggcggttactcggtgttcgccggcgtcggcgaacgtacccgcgaaggtaacgacctctatcacgagttcatcgaatccggcgtcaacaagaagggcggcggcgagggttcgaagtgcgcgctggtgtacggccagatgaacgaaccgccgggcgcccgcgctcgcgtcggtctgaccggtctgaccgtcgccgagcacttccgcgatcagggccaggacgtgctgttcttcgtcgacaacatcttccgcttcacccaggcgggttcggaagtgtcggcgctgctcggccgtatcccgtcggcggtgggttatcagccgacgctcgcgaccgacatgggcgcgctgcaggagcgcatcaccaccaccaccaagggctcgatcacctcggtgcaggcgatttacgtgccggccgacgacttgaccgacccggcgcccgcgacctcgttcgcgcacttggacgccaccaccgtgctcaatcgtgcgatctcggaaaagggcatctacccggcggtggatccgctcgactcgacctcgcgcatgctgtccgcctcgatcgtcggcgaagagcactacaataccgcgcgtatggttcagcagatcctgcagaagtacaagtcgctgcaggacatcatcgcgatcctgggcatggacgaactgtctgaagaggacaagctcacagtggctcgcgcccgtaagatcgagcgcttcctgtcgcagccgttcttcgtcgccgaagtgttcaccggctcgccgggcaagttcgtcgacctcgccgacaccatcaagggcttccgcgcgatctgcgaaggcaagtacgaccatctgccggaagcggcgttctacatggtcggcaccatcgaagaggcggtcgagaagggcaagaagctcgccgccgaggcggcctga

SEQ ID NO: 7255 - protein, 476 aa, Rhodopseudomonas palustris
MATPANQTGRITQVIGAVVDVQFEGHLPAILNAIETKNGDNRLVLEVAQHLGESTVRTIAMDTTEGLVRGQEVTDTGAPISVPVGAGTLGRIMNVIGEPVDEQGPIKSEGLRAIHQEAPAYTDQSTEAEILVTGIKVVDLLAPYAKGGKIGLFGGAGVGKTVLIQELINNVARAHGGYSVFAGVGERTREGNDLYHEFIESGVNKKGGGEGSKCALVYGQMNEPPGARARVGLTGLTVAEHFRDQGQDVLFFVDNIFRFTQAGSEVSALLGRIPSAVGYQPTLATDMGALQERITTTTKGSITSVQAIYVPADDLTDPAPATSFAHLDATTVLNRAISEKGIYPAVDPLDSTSRMLSASIVGEEHYNTARMVQQILQKYKSLQDIIAILGMDELSEEDKLTVARARKIERFLSQPFFVAEVFTGSPGKFVDLADTIKGFRAICEGKYDHLPEAAFYMVGTIEEAVEKGKKLAAEAA

SEQ ID NO: 7256 - DNA, 1425 bp, Rhodospirillum rubrum
  CDS (1)..(1425): transl_table=11
atggccaagaacaacctcggtacgatcacgcaggtgacgggcgctgtcgttgacgtgaagttcgagggtgaacttccgtcgatcctttccgccctcgagaccgataatcacgggaaccgtctggttctcgaagtggcgcagcatctgggcgagagcgtggtccgcaccatcgccatggacagcacggaaggtctggtccgcggccagcaggtcacgtcgaccggcggtccgatcaccgttccggtcggcccccaggtgctggggcgcatcatgaacgtcatcggcgagcccgttgacgagcgtggcccggtggtcacggcgcagcgctatccgatccaccgtcaggctccgaccttcgccgagcaggcgacggaaaccgagatcctcgtcaccggcatcaaggtcatcgatctgatcgccccctacaccaagggcggcaaggtcggcctgttcggcggcgccggcgtcggcaagaccgtgctgatccaggaactgatcaacaacgtcgccaagggtcacggcgggtattcggtgttcgccggcgtcggcgagcgcacccgtgagggcaacgatctttatcacgagatgatcgacgccgggattatcgacctggaaggcgacaagtcgaaggtcgccctagtttatggccagatgaacgagccgccgggtgcgcgcgcccgcgtcgccctggccggtctgacccaggccgaatacttccgcgacgaagaaggccaggacgtgttgttcttcgtcgacaacatcttccgcttcacccaggccggttcggaagtgtcggccctgctcggtcgtatcccctcggccgtgggctatcagccgaccctggccaccgacatgggcgccctgcaagagcgtatcacctcgaccaagaagggctcgatcacctcggttcaggcgatttacgtgcccgccgacgatctgaccgacccggcgccggccgcctccttcgcccacctcgacgcgacgacgacgctcaaccgctcgatcgccgagctgggcatctacccggccgtcgatccgctcgattcgacctcccgcgcccttgatccgctggtggttggcgaagagcactacaaggtggcccgcgaagttcagcgcgtgttgcagacctataagtcgctccaggacatcatcgccatccttggcatggacgagctgtccgaagaggaccgtctggtcgtcgcccgcgcccgcaagatccagcgcttcctgtcccagccgttccatgtggccgaagtgttcaccggctcgccgggcaagctggtcagcctcgaagacacgatcaagggcttcaagggtctggtcgagggcgagtacgatcacctgcccgaacaggctttctatatggtcggcaacatggccgaagccatcgagaaggccaagaagatggccgccgaagccgcctga

SEQ ID NO: 7257 - protein, 474 aa, Rhodospirillum rubrum
MAKNNLGTITQVTGAVVDVKFEGELPSILSALETDNHGNRLVLEVAQHLGESVVRTIAMDSTEGLVRGQQVTSTGGPITVPVGPQVLGRIMNVIGEPVDERGPVVTAQRYPIHRQAPTFAEQATETEILVTGIKVIDLIAPYTKGGKVGLFGGAGVGKTVLIQELINNVAKGHGGYSVFAGVGERTREGNDLYHEMIDAGIIDLEGDKSKVALVYGQMNEPPGARARVALAGLTQAEYFRDEEGQDVLFFVDNIFRFTQAGSEVSALLGRIPSAVGYQPTLATDMGALQERITSTKKGSITSVQAIYVPADDLTDPAPAASFAHLDATTTLNRSIAELGIYPAVDPLDSTSRALDPLVVGEEHYKVAREVQRVLQTYKSLQDIIAILGMDELSEEDRLVVARARKIQRFLSQPFHVAEVFTGSPGKLVSLEDTIKGFKGLVEGEYDHLPEQAFYMVGNMAEAIEKAKKMAAEAA

SEQ ID NO: 7258 - DNA, 1428 bp, Rhodobacter sphaeroides
  CDS (1)..(1428): transl_table=11
atggcaacagcatcccaaggcaaggtgacgcaggtcatcggcgccgtggtggacgtgcagttcgacggtggcctgccgcccatcctgaacgcgctcgaaaccgagaacaacggcaagcgtctggtcctcgaagtggcccagcacctcggcgagagcaccgtccgcacgatcgccatggacgcgacggaaggtctcgtgcgcggcgcccgggtgacggacaccggcagcccgatctcggtgccggtgggtgacgccaccctcggccgcatcctgaacgtgatcggcgagccgatcgacgagaagggcgatctcggcgaggcctcgacccgcgcgatccaccagccggccccgaccttcgccgagcagtcgaccacctcggagatcctcgtcaccggcatcaaggtgatcgacctcctcgccccctactcgaaaggcggcaagatcggcctcttcggcggcgccggcgtgggcaagaccgttctcatcatggagctcatcaacaacatcgccaaggtgcactcgggctattccgtgttcgccggcgtgggtgagcggacccgtgaagggaacgacctctaccacgagatgatcgaatccggggttatcaagatcgacaacctctcggagtcgaaggtggcgctggtctacggccagatgaacgagcctccgggggcgcgtgcccgcgtggcgctgacgggcctcacgctcgccgagcagttccgcgaccagtcggggacggacgtgctgttcttcgtggacaacatcttccgcttcacccaggcgggttcggaagtgtcggcgcttctcggccgtatcccctcggccgtgggttaccagccgacgctcgccaccgacatgggtgccctgcaggagcgcatcacctcgacgaaagccggctcgatcacctcggtgcaggcgatctacgttccggccgacgaccttaccgacccggcgccggccacctcgttcgcccacctcgacgccacgaccgtgctctcgcgcgcgatctcggaactcgggatctacccggccgtggacccgctcgactccacctcgcggatcctcgatccgcagatcgtcggcgaagagcactacaacgtggcccgtgcggtgcaggggatcctccagcgctacaagtcgcttcaggacatcatcgccatcctcgggatggacgaactgtcggaagaggacaagctgtccgtggcccgcgcccggaagatccagcggttcctgagccagccgttcgacgtggcgaaggtcttcaccggctcggacggggtgcaggtcccgctcgagaaaaccatcgcctccttcaaggccgtggtaaacggcgagtatgaccacctgccggaagccgccttctacatggtcggcgacatcgaggatgtgatcgccaaggcccagcgtctcgcggcgcaggcggcgtaa

SEQ ID NO: 7259 - protein, 475 aa, Rhodobacter sphaeroides
MATASQGKVTQVIGAVVDVQFDGGLPPILNALETENNGKRLVLEVAQHLGESTVRTIAMDATEGLVRGARVTDTGSPISVPVGDATLGRILNVIGEPIDEKGDLGEASTRAIHQPAPTFAEQSTTSEILVTGIKVIDLLAPYSKGGKIGLFGGAGVGKTVLIMELINNIAKVHSGYSVFAGVGERTREGNDLYHEMIESGVIKIDNLSESKVALVYGQMNEPPGARARVALTGLTLAEQFRDQSGTDVLFFVDNIFRFTQAGSEVSALLGRIPSAVGYQPTLATDMGALQERITSTKAGSITSVQAIYVPADDLTDPAPATSFAHLDATTVLSRAISELGIYPAVDPLDSTSRILDPQIVGEEHYNVARAVQGILQRYKSLQDIIAILGMDELSEEDKLSVARARKIQRFLSQPFDVAKVFTGSDGVQVPLEKTIASFKAVVNGEYDHLPEAAFYMVGDIEDVIAKAQRLAAQAA

SEQ ID NO: 7260 - DNA, 1422 bp, Rickettsia conorii
  CDS (1)..(1422): transl_table=11
atgacaaaaaatattggaaaaattactcagattatttcagcggtggtggatgtaaaatttacgaataacggtgagttaccgaaaattttaaatgctctagagtgctataacgataaacaaaggatagtcctggaagtagcacaacatataggtgatgatacagtgcgttgtattgctatggattctatggaagggttagtgcggggcgtagaagtaatagatacaggcagtcctattcgtattcctgtaggtactgagacgcttgggcgtattatgaatgttgtaggtgagccgattgacggtaaaggagacattaaaagctcaaatatttcttctatatataagcctgctcctgattttacccatcagtcaaccgagtgtaatatattagtaactggtattaaagttattgatttacttgctccttatactaaaggcggtaaaataggactattcggtggtgcaggagtcggtaaaaccgtgcttataatggagcttattaataacgtagctaaagcacacggcggttatacggtatttgcaggagttggtgagagaactagagaaggtaatgatctttaccatgaaatgattgactcgggtgttattaaccttgcagagcctgaaaagtcaaaagtagctttagtttatggacaaatgaacgagccgccgggagcaagggcaagagttgcgttaagcggtctgaccattgcagagagttttagagatatgaatgaagggcaagatgttttgttttttgtagataatattttccgttttactcaagcaggttctgaagtatcggcgttactcggtaggattccgtcagcggtagggtatcagcctactcttgcaaccgatatgggtgagctacaagagcgtatcacctctactaagtacggctcaataacttccgtgcaggctatatatgtaccggcggatgatttaactgatcctgctcctgctacttcttttgcacatttagatgctacaacggtacttagccgtcagatagctgagtttgggatttatccggcagttgatccgttagatagtaattcgcaggtacttgatccgatgattgtcggtgaagaacattatagtgtagcaagacaagtgcagcaggttttacaaacttataaatcgttgcaggatattatcactattttaggtatggatgagctatccgaagaagataaactaaccgtggcacgtgctagaaaaatacagcgtttcttatcgcagcctttccatgtcgctgaagtatttaccggagctgcaggcaaatttgttaatctagccgatactatcgcaggctttaaaggacttgtagagggtaaatacgatgatttaccggaagctgctttttatatggtcggaactatagacgaggctatagagaaggcgcagacgttgaagtga

SEQ ID NO: 7261 - protein, 473 aa, Rickettsia conorii
MTKNIGKITQIISAVVDVKFTNNGELPKILNALECYNDKQRIVLEVAQHIGDDTVRCIAMDSMEGLVRGVEVIDTGSPIRIPVGTETLGRIMNVVGEPIDGKGDIKSSNISSIYKPAPDFTHQSTECNILVTGIKVIDLLAPYTKGGKIGLFGGAGVGKTVLIMELINNVAKAHGGYTVFAGVGERTREGNDLYHEMIDSGVINLAEPEKSKVALVYGQMNEPPGARARVALSGLTIAESFRDMNEGQDVLFFVDNIFRFTQAGSEVSALLGRIPSAVGYQPTLATDMGELQERITSTKYGSITSVQAIYVPADDLTDPAPATSFAHLDATTVLSRQIAEFGIYPAVDPLDSNSQVLDPMIVGEEHYSVARQVQQVLQTYKSLQDIITILGMDELSEEDKLTVARARKIQRFLSQPFHVAEVFTGAAGKFVNLADTIAGFKGLVEGKYDDLPEAAFYMVGTIDEAIEKAQTLK

SEQ ID NO: 7262 - DNA, 1425 bp, Rickettsia felis
  CDS (1)..(1425): transl_table=11
atgacaaaaaatatcggtaaaattactcagattatttcagcggtggtggatgtaaaatttacgaataacggtgagttaccggaaattttaaatgctctagagtgctataacgataaacaaaggatagtgctggaagtagcacaacatataggcgatgatacggtgcgttgtattgctatggattctaccgaaggattagtgcggggtgtagaagtaatagatacaggcagtcctattcggattcccgtaggtactgagacgcttgggcgtattatgaatgttgtaggtgagccgattgacggtaaaggagacattaaaagctcaaatatttcttctatatataagtctgctcctgattttaccaaccagtcaaccgagcgtaatatattagtaaccggtattaaagttgttgatttacttgctccttatactaagggcggtaagataggattattcggtggtgcaggtgtaggtaaaaccgtgttaattatggagcttattaataacgtagctaaggcacatggcggttataccgtatttgcaggagtcggtgagagaactagagagggtaatgatctttaccatgaaatgattgactccggtgtgattgaccttgagaaaccggaaaattcaaaagtagctcttgtttatggacaaatgaacgagccgccgggagcaagggcaagagttgcattaagcggtctgaccattgcggaaagttttagagatatgaatgaggggcaagatgttttattctttgtagataatattttccgttttactcaagcaggttctgaagtatcggcgttgcttggtagaattccgtcagcggtagggtatcagcctactcttgctactgatatgggagagctacaggagcgtatcacctctactaagaacggctcaataacttccgtgcaggctatatatgtaccggcagatgatttaaccgatcctgctcctgctacttcttttgcacatttagatgctacaacagtacttagccgtcagatagccgagcttggaatttatccggcagttgacccgttagatagtaattctcaggtacttgacccgatgattgtcggtgaagagcattatagcgtagcaagacaagtgcagcagattttacaaacttataaatcgttgcaggatatcatcgctattttaggtatggatgagctatccgaagaagataagctaaccgtgtcgcgtgctagaaaaatacagcgtttcttatcacagcctttccatgtcgctgaagtatttaccggagctgaaggcaaatttgttaatttagccgatactatagcaggctttaaagggcttgtagagggtaaatacgatgatttaccagaagctgctttttatatggtcggaactatggacgaggctattgagaaagcgaagattttgaaaggataa

SEQ ID NO: 7263 - protein, 474 aa, Rickettsia felis
MTKNIGKITQIISAVVDVKFTNNGELPEILNALECYNDKQRIVLEVAQHIGDDTVRCIAMDSTEGLVRGVEVIDTGSPIRIPVGTETLGRIMNVVGEPIDGKGDIKSSNISSIYKSAPDFTNQSTERNILVTGIKVVDLLAPYTKGGKIGLFGGAGVGKTVLIMELINNVAKAHGGYTVFAGVGERTREGNDLYHEMIDSGVIDLEKPENSKVALVYGQMNEPPGARARVALSGLTIAESFRDMNEGQDVLFFVDNIFRFTQAGSEVSALLGRIPSAVGYQPTLATDMGELQERITSTKNGSITSVQAIYVPADDLTDPAPATSFAHLDATTVLSRQIAELGIYPAVDPLDSNSQVLDPMIVGEEHYSVARQVQQILQTYKSLQDIIAILGMDELSEEDKLTVSRARKIQRFLSQPFHVAEVFTGAEGKFVNLADTIAGFKGLVEGKYDDLPEAAFYMVGTMDEAIEKAKILKG

SEQ ID NO: 7264 - DNA, 1425 bp, Rickettsia prowazekii
  CDS (1)..(1425): transl_table=11
atgacacaaaatattggaaaaattactcaagttatttcagcagtagtggatgtgaaatttactaataacggtaagttaccagaaattttaaacgcacttgaatgctataacgataaacaaaggatagtactagaagtagcacaacatataggtgatgatacagtgcgttgtattgctatggactctactgaagggctgataaggggcttagaagtaatagatacaggtaaccctattcgtattcctgtaggtactgaaacgcttggccgtattatgaatgttgtgggtgaaccgattgatggtaaaggagagattaaaagcgcaaccatttcttctatatataagcctgctcctgatttcataaatcagtcaactgagcgtgatatattggtcactggtattaaagttgttgatttactcgctccttatgctaaaggtggtaaaataggactatttggtggtgctggtgttggtaaaactgtgttaattatggaacttattaataacgtagctaaagcacatggtggttatactgtatttgcaggcgttggtgagagaactcgagaaggtaatgatctttatcatgaaatgattgcctcaggtgttattaaccttgaagagcctgaaaagtcaaaagtcgctttagtttatggacaaatgaatgagcctcctggtgcaagagcaagggttgcattaagtggtctgactattgcagagagttttagagatatgaatgcaggacaagatgtattgttttttgtagataatattttccgttttactcaagcaggttctgaagtatctgcattgctcggtaggatcccatcagcggtaggatatcaacctactcttgcaactgatatgggtgaactacaagagcgtatcacttctactaaacacggatcaataacttctgtgcaggctatatatgtaccggcagatgatttaactgatcctgctccctctacttcttttgcacatttggatgcgacaacggtactgagtcgtcagatagctgagcttgggatttacccagcggttgatccgttagatagtaattctcaggtacttgatccgatgattgtaggggaaaaacattatggcgttgcaagacaagtgcagcaggttttacaaacttataaatcattgcaagatataattgctattttaggtatggatgagctatctgaagaagataaattaacagtgtcgcgtgctagaaaaatacagcgttttttgtcacagcctttccatgttgctgaagtatttactggagttgaaggcaaatttgtaaatttagatgatacaattgaaggttttaaaggacttgtagaggggcaatacgatgatttacctgaagcagctttttatatggtcggcactatagacgaggctgtagagaaagcaaagatattaaaaatatag

SEQ ID NO: 7265 - protein, 474 aa, Rickettsia prowazekii
MTQNIGKITQVISAVVDVKFTNNGKLPEILNALECYNDKQRIVLEVAQHIGDDTVRCIAMDSTEGLIRGLEVIDTGNPIRIPVGTETLGRIMNVVGEPIDGKGEIKSATISSIYKPAPDFINQSTERDILVTGIKVVDLLAPYAKGGKIGLFGGAGVGKTVLIMELINNVAKAHGGYTVFAGVGERTREGNDLYHEMIASGVINLEEPEKSKVALVYGQMNEPPGARARVALSGLTIAESFRDMNAGQDVLFFVDNIFRFTQAGSEVSALLGRIPSAVGYQPTLATDMGELQERITSTKHGSITSVQAIYVPADDLTDPAPSTSFAHLDATTVLSRQIAELGIYPAVDPLDSNSQVLDPMIVGEKHYGVARQVQQVLQTYKSLQDIIAILGMDELSEEDKLTVSRARKIQRFLSQPFHVAEVFTGVEGKFVNLDDTIEGFKGLVEGQYDDLPEAAFYMVGTIDEAVEKAKILKI

SEQ ID NO: 7266 - DNA, 1425 bp, Rickettsia typhi
  CDS (1)..(1425): transl_table=11
atgacacaaaatattggaaaaattactcaagttatttcagcagtagtggatgtgaaatttacgaataacagtaagttaccagaaattttaaacgcacttgaatgctataacgcgaaacaaaggatagtgttagaagtagcacaacatataggtgatgatacggtgcgttgtatttctatgggttctactgaagggcttataaggggcttagaagtaatagatacaggtaaccctattcatattcctgtaggtattgcaacgctcggtcgtattatgaatgttgtaggtgaaccgattgatggtaaaggagagattaaaagctcaactatttcttctatatataagcctgctcctgattttatcaatcaatcaactgagcgtgatatattagtcactggtattaaagttgttgatttactcgctccttatactaaaggtggtaaaataggactatttggtggtgctggtgttggtaaaaccgtgttaattatggaacttattaataatgtagctaaagcacatggtggttataccgtatttgcaggtgttggtgagagaacacgagaaggtaatgatctttaccatgaaatgattgcctcaggtgttattaaccttgaagcgcctgaaaagtcaaaagtagctttagtttatggacaaatgaatgagcctcctggtgcaagagcaagggttgcattaagtggtctgactattgcagagagttttagagatatgaatgcaggacaagatgtattgttttttgtagataatattttccgttttactcaagcaggtgctgaagtatcagcattacttggtaggatcccatcagcagtaggatatcaacctacccttgcaactgatatgggtgaactacaagagcgtatcacttctactaaacatggatcaataacttctgtgcaagctatatatgtaccggcagatgatttaactgatcctgctccttctacttcttttgcacatttagatgctacaacagtactgagtcgtcagatagctgagcttgggatttatccagcagttgatccgttagatagtaattctcaggtacttgatccgatgattgtaggtgaagaacattatagtgttgcaagacaagtgcagcaggttttacaaacttataaatcattgcaggatataattgctattttaggtatggatgagctatctgaagaagataaattaacagtgtcgcgtgctagaaaaatacagcgttttttgtcacagcctttccatgttgctgaagtatttactggagttgaaggcaaatttgtgaatctagatgatactattgcaggttttaaaggacttgtagaggggaaatacgatgatttacctgaagcagctttttatatggtcggtactatagacgaggctgtagagaaagcaaagatattaaaaatatag

SEQ ID NO: 7267 - protein, 474 aa, Rickettsia typhi
MTQNIGKITQVISAVVDVKFTNNSKLPEILNALECYNAKQRIVLEVAQHIGDDTVRCISMGSTEGLIRGLEVIDTGNPIHIPVGIATLGRIMNVVGEPIDGKGEIKSSTISSIYKPAPDFINQSTERDILVTGIKVVDLLAPYTKGGKIGLFGGAGVGKTVLIMELINNVAKAHGGYTVFAGVGERTREGNDLYHEMIASGVINLEAPEKSKVALVYGQMNEPPGARARVALSGLTIAESFRDMNAGQDVLFFVDNIFRFTQAGAEVSALLGRIPSAVGYQPTLATDMGELQERITSTKHGSITSVQAIYVPADDLTDPAPSTSFAHLDATTVLSRQIAELGIYPAVDPLDSNSQVLDPMIVGEEHYSVARQVQQVLQTYKSLQDIIAILGMDELSEEDKLTVSRARKIQRFLSQPFHVAEVFTGVEGKFVNLDDTIAGFKGLVEGKYDDLPEAAFYMVGTIDEAVEKAKILKI

SEQ ID NO: 7268 - DNA, 1413 bp, Saccharophagus degradans
  CDS (1)..(1413): transl_table=11
atgagtagcggacgtatcgtacaaatcatcggcgctgtaattgacgtggaattcccacgcgactcagtgccaaaggtttacgacgctttaaccgtcgcagacaaaggcctcacccttgaagtacagcaacagctcggcgacggcgttgttcgtgcaattgcaatgggtggttctgagggtgttagccgcggcctagccgtagaaaacactggtgcaccaatcaacgtacctgttggtactgcgactcttggccgcatcatggacgtattgggtaaccctatcgatgaaaagggcccaatcaacgaaacagaacgtgcttctatccaccgcaaagcaccaaaatatgacgagcttgcggcatctgaagaactactagcaaccggtattaaagttatcgacctagtatgtcctttcgctaagggtggtaaagttggtctgttcggtggtgccggtgtgggtaaaaccgtaaacatgatggaattgatcaacaacatcgcaaccgagcacagcggtttatccgtatttgctggtgtgggtgagcgtactcgtgaaggtaacgacttctacttcgagatgcaggaagccggcgttgtaaacgttgataaattcgacgaatctaaagtggccatggtttatggtcagatgaacgagccacctggaaaccgtttgcgcgtagcattgactggtttgaccatggctgaaaaattccgtgacgaaggtaaagacgtactgttgttcgtagacaacatctaccgttacaccttggcggggaccgaagtatctgcactgttgggccgtatgccttcagcggtgggctaccagcctactcttgctgaagaaatgggtgtgcttcaggagcgtattacttcaaccaagactggttctattacttctatccaagcggtatacgtacctgcggatgacttgactgacccatcgccagctaccacctttgctcacttggattcaaccgttgtattgagtcgtgatattgcagcaaaaggtatctaccctgctatcgacccattggattctagctcacgtcagctagacccattaatcatcggtcaagagcactacgatactgcgcgtggcgtacagtctgttcttcagcgctacaaagaactgaaagatattattgccattttgggtatggatgaattgtctgaagaagataaattaaccgtatctcgtgcacgtaaaatcgaacgtttcttatctcagccatttaacgttgcaaaagtatttaccggtcaagacggtaaaatcgtatcgcttaaagacaccatctctggcttccagggcttgttgagcgggcaatacgacgacttacctgagcaggcgttctacatggttggctctatcgatgaagcaatcgaaaaagccaagaaaatgaaagagaaagcagcgtaa

SEQ ID NO: 7269 - protein, 470 aa, Saccharophagus degradans
MSSGRIVQIIGAVIDVEFPRDSVPKVYDALTVADKGLTLEVQQQLGDGVVRAIAMGGSEGVSRGLAVENTGAPINVPVGTATLGRIMDVLGNPIDEKGPINETERASIHRKAPKYDELAASEELLATGIKVIDLVCPFAKGGKVGLFGGAGVGKTVNMMELINNIATEHSGLSVFAGVGERTREGNDFYFEMQEAGVVNVDKFDESKVAMVYGQMNEPPGNRLRVALTGLTMAEKFRDEGKDVLLFVDNIYRYTLAGTEVSALLGRMPSAVGYQPTLAEEMGVLQERITSTKTGSITSIQAVYVPADDLTDPSPATTFAHLDSTVVLSRDIAAKGIYPAIDPLDSSSRQLDPLIIGQEHYDTARGVQSVLQRYKELKDIIAILGMDELSEEDKLTVSRARKIERFLSQPFNVAKVFTGQDGKIVSLKDTISGFQGLLSGQYDDLPEQAFYMVGSIDEAIEKAKKMKEKAA

SEQ ID NO: 7270 - DNA, 1383 bp, Salmonella paratyphi
  CDS (1)..(1383): transl_table=11
atggctactggaaagattgtccaggtaatcggcgccgtggtcgacgtcgatttccctcaggatgccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagctacgctgggtcgtatcatgaacgtcctgggcgaaccggtcgacatgaaaggcgagatcggcgaagaagagcgttgggcgattcaccgcgcagcgccttcctacgaagagttgtcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttatccgtaacatcgcgatcgagcactccggttactctgtgtttgcgggcgtaggtgaacgtactcgtgagggtaacgacttctaccatgaaatgaccgactccaacgttatcgataaagtatccctggtgtatggccagatgaacgagccgccgggaaaccgtctgcgcgttgcactgaccggcctgaccatggcggagaaattccgtgacgaaggtcgtgacgtactgctgttcgtcgataacatctatcgttacaccctggccggtacggaagtatccgcactgctgggtcgtatgccttccgcggtaggttaccagccgactctggcggaagagatgggcgttctgcaggaacgtatcacctccaccaagaccggttctatcacctccgtacaggcggtatacgtacctgcggatgacttaactgacccgtctccagccaccacctttgcgcacttagatgcaaccgtggtactgagccgtcagatcgcatccctgggtatctacccggccgttgacccgctggattccaccagccgtcagctggatccgctggttgttggtcaggaacactacgacaccgcgcgtggcgttcagtccatcctgcagcgttatcaggaactgaaagacatcatcgccatcctcggtatggatgaactgtctgaagaagataaactggtggtagctcgcgcgcgtaagatccagcgcttcctgtcccagccgttcttcgtggcggaagtatttaccggttctccgggcaaatacgtctccctgaaagacaccatccgtggctttaaaggcatcatggaaggcgaatacgatcacctgccggagcaggcgttctacatggtcggttccatcgacgaagccgtggaaaaagccaaaaaactttaa

SEQ ID NO: 7271 - protein, 460 aa, Salmonella paratyphi
MATGKIVQVIGAVVDVDFPQDAVPRVYDALEVQNGNEKLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVSLKDTIRGFKGIMEGEYDHLPEQAFYMVGSIDEAVEKAKKL

SEQ ID NO: 7272 - DNA, 1578 bp, Schizosaccharomyces pombe
  CDS (1)..(1578)
atgctaaagaaacaggccctgagcgggatccgccggttttctttggcaacaaaacagtcttttgtaaagactagttataagttacctcggaagtcatggttgaataccgctaaatttaacactataagatatgcttcgacggaagcagcaaaacataataaaggatcgattaaacaagttattggtgcagttgtcgattgtcagtttgaagatgccgattcattacctagcattttgaacgctttggaagttaagcttcccgataacaaacgccttgttttggaagtagcccaacacgtcggtgaaaatactgttcgtactattgctatggatggtactgagggtcttgttcgtggaacagccgttatcgatactgggtcacccatcagcattcctgttggcccgggtacattaggccgtattatgaacgttattggtgaacccgtagatgaacgcggtcccattaaagccgttaaatactccccaatccacgctgatgctccttctttcgaagaacaatcaacaaccccagaaatcttggagaccggtattaaagttgtagatttgcttgccccatatgctcgtggtggtaagattggtctattcggtggtgcaggtgttggtaaaacagtttttatccaggaattgattaacaacattgccaaagctcatggtggttactctgtctttactggtgtcggtgaacgtacccgtgagggtaacgatttataccgggaaatgcaagaaaccggtgtcattaaattagaaggcgagtctaaggctgctcttgtctttggtcaaatgaatgagcctccaggtgctcgtgcacgtgttgctctcactggtttgactgttgctgaatatttccgcgatattgaaggacaagacgttttgcttttcattgataacattttccgttttactcaagcaggttctgaagtatcagctttgcttggtcgtattccctctgccgtcggttaccaacccacgttagccactgatatgggtgctatgcaagaacgtattaccactactaagaaaggttctattacctcagtccaagctgtctatgttccagctgacgatttaactgatcctgctcctgccactacctttgcccatttggacgctactactgtgttatctcgtagtatttccgagttgggtatttatcctgctgtcgatcctcttgactccaagtctcgtatgatggatcctcgtattcttggtgaggagcactataaccttgcaggttctgttcaacaaatgcttcaagaatacaaatcactacaagatatcattgccattcttggtatggatgaattgtctgaagctgataaattgacagttgagcgtgctcgtaaggtacaacgtttcttgtcccaaccatttgcagttgccgaagtgtttactggtattgaaggacgccttgtttccttgaaagatactatccgctcttttaaggaaattcttgaaggcaagcacgattcattacctgaatctgctttctatatggttggtagcattgacgacgctgttaagaaggctgagaagattgcacaagaattggctgcataa

SEQ ID NO: 7273 - protein, 525 aa, Schizosaccharomyces pombe
MLKKQALSGIRRFSLATKQSFVKTSYKLPRKSWLNTAKFNTIRYASTEAAKHNKGSIKQVIGAVVDCQFEDADSLPSILNALEVKLPDNKRLVLEVAQHVGENTVRTIAMDGTEGLVRGTAVIDTGSPISIPVGPGTLGRIMNVIGEPVDERGPIKAVKYSPIHADAPSFEEQSTTPEILETGIKVVDLLAPYARGGKIGLFGGAGVGKTVFIQELINNIAKAHGGYSVFTGVGERTREGNDLYREMQETGVIKLEGESKAALVFGQMNEPPGARARVALTGLTVAEYFRDIEGQDVLLFIDNIFRFTQAGSEVSALLGRIPSAVGYQPTLATDMGAMQERITTTKKGSITSVQAVYVPADDLTDPAPATTFAHLDATTVLSRSISELGIYPAVDPLDSKSRMMDPRILGEEHYNLAGSVQQMLQEYKSLQDIIAILGMDELSEADKLTVERARKVQRFLSQPFAVAEVFTGIEGRLVSLKDTIRSFKEILEGKHDSLPESAFYMVGSIDDAVKKAEKIAQELAA

SEQ ID NO: 7274 - DNA, 1392 bp, Shewanella oneidensis
  CDS (1)..(1392): transl_table=11
atgagcacaggtactgttgtccaagtgattggcgcggttgtggacgtagagtttccacaagatgccgtacctcaggtatatgacgctctgaagatcacaggtgaaggctcctgtaatggtttggtgctggaagttcagcaacaactaggtggtggtgtagttcgtaccatcgctatgggtacttctgatggtctgcgtcgtggtcttgaggtagtaaactcaggttcacctatttctgttcctgttggtacagccactcttggccgtatcatgaacgttttaggcgaccctattgatgaagcgggtgcaatcggtgaagaagaacgttatgtgattcaccgtgcagctccttcatacgaagagcaatcaaacacgactgaactgttagagactggtatcaaggttatcgaccttgtatgtccattcgctaagggtggtaaagtaggtctgttcggtggtgcgggtgttggtaagacagttaacatgatggaactgattaacaacatcgctaaagctcactcaggtctttctgtattcgccggtgtaggtgagcgtactcgtgagggtaacgacttctactacgagatgaaggattctggcgttctcgacaaagtagccatggtgtatggccaaatgaacgagccaccaggaaaccgtctgcgtgtagcactgactggtctgactatggctgagaaattccgtgacgaaggtcgtgacgtactgttgttcgttgacaacatctaccgttacaccctagccggtactgaagtatcagcactgttaggtcgtatgccttctgcggtaggttaccaacccactctggctgaagaaatgggcgttctgcaagagcgtattacttcaactaagacgggttctattacctctgtacaagcggtatacgtacctgcggacgacttgactgacccgtcaccagcaacaaccttcgctcacttagatgcgactgttgtattgtcacgtcaaatcgcttctctgggtatttacccagcggttgacccattggattcgacttcacgtcaattagatccattagtggttggtcaagagcactatgacgtagctaacggtgtacaaactgttctgcaacgctacaaagagctgaaagacattattgcgattctgggtatggacgaattgtcagatgatgacaagatgaccgtttcccgtgcacgtaagattgagcgtttcttgtctcagcctttccacgtagcagaagtctttactggttctcctggtaagtacgtttctctgaaagacactatccgtggcttcaagggaattctgagtggcgagttcgaccacattccagaacaagcgttctacatggttggttctatcgacgaagctgtcgagaaagctaacaaaaagaaataa

SEQ ID NO: 7275 - protein, 463 aa, Shewanella oneidensis
MSTGTVVQVIGAVVDVEFPQDAVPQVYDALKITGEGSCNGLVLEVQQQLGGGVVRTIAMGTSDGLRRGLEVVNSGSPISVPVGTATLGRIMNVLGDPIDEAGAIGEEERYVIHRAAPSYEEQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDDDKMTVSRARKIERFLSQPFHVAEVFTGSPGKYVSLKDTIRGFKGILSGEFDHIPEQAFYMVGSIDEAVEKANKKK

SEQ ID NO: 7276 - DNA, 1425 bp, Silicibacter pomeroyi
  CDS (1)..(1425): transl_table=11
atggcgaatgcaaaaggcaaagtcacgcagatcatcggggccgtcgtcgacgtccagttcgatgatgccctgcctgaaattctgaacgcgctggaaaccgaaaacaacggcaagcgtctggtgctcgaagttgcgcagcacctgggcgagaacaccgtccgcaccatcgcaatggacgcgaccgaaggtctggtccgtggcgcggtcgtgaccgataccggcggcccgatctcggtgccggtgggcgcagccaccctgggccgcatcctgaacgtgatcggcgaaccggtggacgaaaagggcccggtgaacgccaccgagacccgtgccatccaccagcccgcaccctcgtttgacgaacagtcgacctcgtcggacatcctggtcaccggcatcaaggtgatcgacctgctggccccctattccaagggcggcaagatcggcctgttcggcggcgccggcgtgggcaagaccgttctgatcatggaactgatcaacaacatcgccaaggtgcactcgggctactcggtgttcgccggtgtgggtgaacggacccgtgagggcaacgacctctaccacgagatgatcgaatccaacgtgatcaagctcgagaacctggaagaatcgcaggtggccctggtttacggccagatgaacgagcctccgggagcccgtgcccgcgttgcgctgaccggtctgaccctggccgagcagttccgcgaccagtccggcaccgacgttctgttcttcgtggacaacatcttccgcttcacccaggccggttccgaggtgtccgcacttctgggccgtatcccttcagccgtgggttaccagccgacgctggccaccgacatgggtgcgatgcaggaacgcatcacctcgaccaaggcaggctcgatcacctcgatccaggccgtctacgttcccgcggacgaccttaccgaccccgcgcccgcaaccacctttgcgcacctcgacgcaaccacggttctgtcgcgtgcgatctcggaactgggtatctacccggctgtggacccgctcgactcgtcgagccggatcctcgatccgcaggttgtcggtgaagagcattatcaggttgcccgtgacgttcagggtatccttcagcgctacaagtcgctgcaggacatcatcgccattctcggcatggacgaactgagcgaagaggacaagctgaccgtggcccgcgcccggaaaatccagcgtttcctcagccagcccttcgacgtggcgaaagtgttcaccggctcggacggtgtgcaggttccgctggaagacaccatctcgtcgttcaaggcggttgtggccggtgaatacgaccacctgcccgaaggcgccttctacatggttggcggcatcgacgaagtgatcgccaaagccgagcggatggccgcagaagccgcctaa

SEQ ID NO: 7277 - protein, 474 aa, Silicibacter pomeroyi
MANAKGKVTQIIGAVVDVQFDDALPEILNALETENNGKRLVLEVAQHLGENTVRTIAMDATEGLVRGAVVTDTGGPISVPVGAATLGRILNVIGEPVDEKGPVNATETRAIHQPAPSFDEQSTSSDILVTGIKVIDLLAPYSKGGKIGLFGGAGVGKTVLIMELINNIAKVHSGYSVFAGVGERTREGNDLYHEMIESNVIKLENLEESQVALVYGQMNEPPGARARVALTGLTLAEQFRDQSGTDVLFFVDNIFRFTQAGSEVSALLGRIPSAVGYQPTLATDMGAMQERITSTKAGSITSIQAVYVPADDLTDPAPATTFAHLDATTVLSRAISELGIYPAVDPLDSSSRILDPQVVGEEHYQVARDVQGILQRYKSLQDIIAILGMDELSEEDKLTVARARKIQRFLSQPFDVAKVFTGSDGVQVPLEDTISSFKAVVAGEYDHLPEGAFYMVGGIDEVIAKAERMAAEAA

SEQ ID NO: 7278 - DNA, 1497 bp, Solanum bulbocastanum
  CDS (1)..(1497)
atgagaatcaatcctactacttctggttctggggtttccacgcttgaaaaaaaaaacccggggcgtgtcgtccaaatcatcggtccggtactagatgtagcctttcccccgggcaagatgccaaatatttataacgctctggtagttcaaggtcgagatagtgttggtcaaccaattaatgtggcttgtgaggtacagcaattattaggaaataatcgagttagggctgtagctatgagtgctacagacggtctaacgagaggaatggcagtgattgacacaggagctcctataagtgttccagtcgggggagcgactctgggacgaatttttaacgtgctcggagagcctgttgataatttagggcctgtagatactagtacaacgtctcctattcatagatctgcgcccgcctttatacagttggatacaaaattatctatttttgaaacaggaattaaagtagtagatcttttagccccctatcgccgtggaggaaaaatcggactattcgggggagctggagtgggtaaaacagtactcattatggaattgattaacaatattgctaaagctcacgggggcgtatccgtatttggcggagtgggtgaacgtactcgggaaggaaatgatctttacatggaaatgaaagaatctggagtgattaataaagaaaatattgcagaatcaaaagtggccctagtttacggtcagatgaatgaaccgccgggagctcgtatgagagttggtttgactgccctaactatggcggaatatttccgagatgttaatgagcaagacgtacttctatttattgacaatatcttccgtttcgtccaagcaggatccgaagtatcggccttattgggtagaatgccttccgctgtgggttatcaaccgaccctaagtaccgaaatgggttctttacaagaaagaattacttctaccaaagacgggtccataacctctattcaagcagtttatgtacccgcagacgatttgaccgaccctgctcctgctacgacatttgcacatttagatgctactaccgtactatcaagaggattggctgccaaaggtatttatccagcagtagatcctttagattcaacgtcaaccatgcttcaacctcggatcgttggtgaggaacattacgaaaccgcccaaagagttaagcaaactttacaacgttacaaagaacttcaggacattatagctatccttggattggacgaattatccgaagaggatcgtttactcgtagcaagagcgcgaaaaattgagcgtttcttatcacaaccctttttcgtagcagaagtatttaccggttctccagggaaatatgttggtctagcagaaacaattcgaggatttcaattgatcctttccggagaattagatggtcttcctgaacaggccttttatttggtaggtactatcgatgaagctaccgcgaaggctatgaacttagaaatggagagcaatttgaagaaatga

SEQ ID NO: 7279 - protein, 498 aa, Solanum bulbocastanum
MRINPTTSGSGVSTLEKKNPGRVVQIIGPVLDVAFPPGKMPNIYNALVVQGRDSVGQPINVACEVQQLLGNNRVRAVAMSATDGLTRGMAVIDTGAPISVPVGGATLGRIFNVLGEPVDNLGPVDTSTTSPIHRSAPAFIQLDTKLSIFETGIKVVDLLAPYRRGGKIGLFGGAGVGKTVLIMELINNIAKAHGGVSVFGGVGERTREGNDLYMEMKESGVINKENIAESKVALVYGQMNEPPGARMRVGLTALTMAEYFRDVNEQDVLLFIDNIFRFVQAGSEVSALLGRMPSAVGYQPTLSTEMGSLQERITSTKDGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLLVARARKIERFLSQPFFVAEVFTGSPGKYVGLAETIRGFQLILSGELDGLPEQAFYLVGTIDEATAKAMNLEMESNLKK

SEQ ID NO: 7280 - DNA, 2482 bp, Solanum lycopersicum
  CDS (451)..(1947)
aaaggtataaaaaagaaagaaaaacgcaaagaaaagaataggctaggcataaatcgatatgctgaaattgaaataaaaaagaaataagaagaggagcccattagatacaaataatgaatcgtaatagaaatagaaaataaagttcaggttcgaattccatagaatcgataatatggatgggcttgtctataatggtagacaaatgaaagactttctcaagattttgattcatccacttgagattgttaaatgaaaataggttgggtgagctgccaaattaactcagtctcattgaataagtaaacaattggattggttcaattgcatggtgccaacgaaatcgagtgctaattccgattttattgaattaaccgatcgacgtgctagcggacattttttttgaattcgataattttggaaaaaacatttcgacatatttattttattattatgagaatcaatcctactacttctggttctggggtttccacgcttgaaaaaaaaaacccggggcgtgtcgtccaaatcatcggtccggtactagatgtagcctttcccccgggcaagatgccaaatatttataacgctctggtagttcaaggtcgagatagtgttggtcaaccaattaatgtggcttgtgaggtacagcaattattaggaaataatcgagttagggctgtagctatgagtgctacagaaggtctaacgagaggaatggcagtgattgacacaggagctcctataagtgttccagttgggggagcgactctgggacgaatttttaacgtgctcggagagcctgttgataatttagggcctgtagatactagtacaacgtctcctattcatagatctgcgcccgcctttatacagttggatacaaaattatctatttttgaaacaggaattaaagtagtagatcttttagccccttatcgccgtggaggaaaaatcggactattcgggggagctggagtgggtaaaacagtactcattatggaattgattaacaatattgctaaagctcacgggggcgtatccgtatttggcggagtgggtgaacgtactcgggaaggaaatgatctttacatggaaatgaaagaatctggagtgattaataaagaaaatattgcagaatcaaaagtggccctagtttacggtcagatgaatgaaccgccgggagctcgtatgagagttggtttgactgccctaactatggcggaatatttccgagatgttaatgagcaagacgtacttctatttattgacaatatcttccgtttcgtccaagcaggatccgaagtatcggccttattgggtagaatgccttccgctgtgggttatcaaccgaccctaagtaccgaaatgggttctttacaagaaagaattacttctaccaaagaagggtccataacctctattcaagcagtttatgtacccgcagacgatttgaccgaccctgctcctgctacgacatttgcacatttagatgctactaccgtactatcaaggggattggctgccaaaggtatttatccagcagtagatcctttagattcaacgtcaaccatgcttcaacctcggatcgttggtgaggaacattacgaaaccgcccaaagagttaagcaaactttacaacgttacaaagaacttcaggacattatagctatccttggattggacgaattatccgaagaggatcgtttactcgtagcaagagcgcgaaaaattgagcgtttcttatcacaaccctttttcgtagcagaagtatttaccggttctccagggaaatatgttggtctagcagaaacaattcgaggatttcaattgatcctttccggagaattagatggtcttcctgaacaggccttttatttggtaggtactatcgatgaagctaccgcgaaggctatgaacttagaaatggagagcaatttgaagaaatgaccttaaatcttagtgtactgacccctaatcgaattgtttgggattcagaagtggaagaaattgttttatctactaatagtggtcaaattggcatattaccaaatcacgcccctattgccacagctgtagatatagggattttgagaatacgccttaacgaccaatggttaacgatggctctgatgggtggttttgctagaataggaaataatgagatcactgttttagtaaatgatgcggagaagggtagtgacattaatccacaagaagctcagcaaactcttgaaatagcggaagctaatgtgaaaaaggctgaaggaaggagacaaaaaattgaggcaaatctagctctccgacgagctagaacacgggtggaggctagcaatccgatttcataactagttggtacgttcgaataataaaaagaagttctctttctaatcctatttagattctgtcgggtgaatacaatcaaatacaatcaaacagaatccaattctgatgcaaaaattcaaattaaaaaatgaaatagaaa

SEQ ID NO: 7281 - protein, 498 aa, Solanum lycopersicum
MRINPTTSGSGVSTLEKKNPGRVVQIIGPVLDVAFPPGKMPNIYNALVVQGRDSVGQPINVACEVQQLLGNNRVRAVAMSATEGLTRGMAVIDTGAPISVPVGGATLGRIFNVLGEPVDNLGPVDTSTTSPIHRSAPAFIQLDTKLSIFETGIKVVDLLAPYRRGGKIGLFGGAGVGKTVLIMELINNIAKAHGGVSVFGGVGERTREGNDLYMEMKESGVINKENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLLVARARKIERFLSQPFFVAEVFTGSPGKYVGLAETIRGFQLILSGELDGLPEQAFYLVGTIDEATAKAMNLEMESNLKK

SEQ ID NO: 7282 - DNA, 1497 bp, Solanum tuberosum
  CDS (1)..(1497)
atgagaatcaatcctactacttctggttctggggtttccacgcttgaaaaaaaaaacccggggcgtgtcgtccaaatcatcggtccggtactagatgtagcctttcccccgggcaagatgccaaatatttataacgctctggtagttcaaggtcgagatagtgttggtcaaccaattaatgtggcttgtgaggtacagcaattattaggaaataatcgagttagggctgtagctatgagtgctacagacggtctaacgagaggaatggcagtgattgacacaggagctcctatacgtgttccagtcgggggagcgactctgggacgaatttttaacgtgctcggagagcctgttgataatttagggcctgtagatactagtacaacgtctcctattcatagatctgcgcccgcctttatacagttggatacaaaattatctatttttgaaacaggaattaaagtagtagatcttttagccccctatcgccgtggaggaaaaatcggactattcgggggagctggagtgggtaaaacagtactcattatggaattgattaacaatattgctaaagctcacgggggcgtatccgtatttggcggagtgggtgaacgtactcgggaaggaaatgatctttacatggaaatgaaagaatctggagtgattaataaagaaaatattgcagaatcaaaagtggccctagtttacggtcagatgaatgaaccgccgggagctcgtatgagagttggtttgactgccctaactatggcggaatatttccgagatgttaatgagcaagacgtacttctatttattgacaatatcttccgtttcgtccaagcaggatccgaagtatcggccttattgggtagaatgccttccgctgtgggttatcaaccgaccctaagtaccgaaatgggttctttacaagaaagaattacttctaccaaagacgggtccataacctctattcaagcagtttatgtacccgcagacgatttgaccgaccctgctcctgctacgacatttgcacatttagatgctactaccgtactatcaagaggattggctgccaaaggtatttatccagcagtagatcctttagattcaacgtcaaccatgcttcaacctcggatcgttggtgaggaacattacgaaaccgcccaaagagttaagcaaactttacaacgttacaaagaacttcaggacattatagctatccttggattggacgaattatccgaagaggatcgtttactcgtagcaagagcgcgaaaaattgagcgtttcttatcacaaccctttttcgtagcagaagtatttaccggttctccagggaaatatgttggtctagcagaaacaattcgaggatttcaattgatcctttccggagaattagatggtcttcctgaacaggccttttatttggtaggtactatcgatgaagctaccgcgaaggctatgaacttagaaatggagagcaatttgaagaaatga

SEQ ID NO: 7283 - protein, 498 aa, Solanum tuberosum
MRINPTTSGSGVSTLEKKNPGRVVQIIGPVLDVAFPPGKMPNIYNALVVQGRDSVGQPINVACEVQQLLGNNRVRAVAMSATDGLTRGMAVIDTGAPIRVPVGGATLGRIFNVLGEPVDNLGPVDTSTTSPIHRSAPAFIQLDTKLSIFETGIKVVDLLAPYRRGGKIGLFGGAGVGKTVLIMELINNIAKAHGGVSVFGGVGERTREGNDLYMEMKESGVINKENIAESKVALVYGQMNEPPGARMRVGLTALTMAEYFRDVNEQDVLLFIDNIFRFVQAGSEVSALLGRMPSAVGYQPTLSTEMGSLQERITSTKDGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLLVARARKIERFLSQPFFVAEVFTGSPGKYVGLAETIRGFQLILSGELDGLPEQAFYLVGTIDEATAKAMNLEMESNLKK

SEQ ID NO: 7284 - DNA, 1497 bp, Sorghum bicolor
  CDS (1)..(1497)
atgagaaccaatcctactacttcgcgtcccggggtttccacaattgaagaaaaaagcgtagggcgtattgatcaaattattggacccgtgctggatatcacttttcccccgggcaagttgccttatatttataatgctttgatagtcaagagtcgagacactgccgataagcaaattaatgtgacttgtgaggtacaacaattattaggaaataatcgagttagagctgtggctatgagtgctacagacgggttgatgagaggaatggaagtgattgacacgggaactcctctcagtgttccagtcggtggagctactctcggacgaatttttaacgttcttggggagcctattgacaatttgggtcctgtggatactagtgcaacattccctattcatagatctgcgcctgcctttatcgagttagatacgaaattatctatctttgaaacaggtattaaggtggtcgatcttttagctccctatcgacgtggaggaaaaatcggactgtttgggggggcaggagtaggtaaaacagtactcatcatggaattaatcaataacattgctaaagctcatggaggcgtatccgtatttggcggagtaggggaacggactcgtgaaggaaatgatctttatatggaaatgaaggaatccggagtaattaatgaaaaaaatattgaggaatcaaaggtagctctagtctatggccaaatgaatgaaccgccgggagctcgtatgagagttggtttaactgccctaactatggcagaatatttccgagatgttaataagcaagacgtgcttttattcatcgataatatctttcgttttgttcaagcaggatcggaagtatccgccttattaggcagaatgccctccgcagtgggttatcaacctacccttagtacagaaatgggttctttgcaagaaagaattacttctaccaaaaagggatctataacttcgatccaagcagtttatgtacctgcagacgatttgaccgaccctgctcctgccacaacatttgcacatttggacgctactaccgtactttccagaggattagcttccaagggtatttatcccgcagtagatcctttagattcaacctcaactatgttacagcctcggatcgttggcaacgaacattatgaaactgcgcaaagagttaaggaaactttacaacgttacaaagaacttcaggacattatcgcaattcttggattggatgaattatcggaggaggatcgtttaactgtagcaagagcacgaaaaatcgagcggttcttatcacaaccgttctttgtggcagaagtttttaccggttctccaggaaagtatgttggtcttgcagaaacaattaggggatttcaactaatcctttccggagaattagacggcctacccgaacaggctttttatttagtggggaacatcgatgaagctagcacgaaagctataaacttagaagaggagagcaaattgaagaaatga

SEQ ID NO: 7285 - protein, 498 aa, Sorghum bicolor
MRTNPTTSRPGVSTIEEKSVGRIDQIIGPVLDITFPPGKLPYIYNALIVKSRDTADKQINVTCEVQQLLGNNRVRAVAMSATDGLMRGMEVIDTGTPLSVPVGGATLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAINLEEESKLKK

SEQ ID NO: 7286 - DNA, 1497 bp, Glycine max
  CDS (1)..(1497)
atgcgaatcaatcctactacttctggtcctgaggtttctgcgcttgaaaaaaaaaatctgggacgtatcgcccaaataattggtccggtactagatgtagcttttcccccaggtaagatgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggtggagcaactctaggacgaattttcaacgtgcttggagagcccattgataatttaggtcctgtagatactcgcacaacatctcccattcatagatctgcgcctgcctttatacaattagatacaaaattagccatttttgaaacaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtaggtaatatcgatgaagctactgcgaaagctacgaacttagaaatggagagcaatttgaagaaatga

SEQ ID NO: 7287 - protein, 498 aa, Glycine max
MRINPTTSGPEVSALEKKNLGRIAQIIGPVLDVAFPPGKMPNIYNALIVKGRDTVGQQINVTCEVQQLLGNNRIRAVAMSATEGLMRGMEVIDTGAALSVPVGGATLGRIFNVLGEPIDNLGPVDTRTTSPIHRSAPAFIQLDTKLAIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGNIDEATAKATNLEMESNLKK

SEQ ID NO: 7288 - DNA, 1542 bp, Sphingopyxis alaskensis
  CDS (1)..(1542): transl_table=11
atggcaaccgcacccgccaccgaaaagaaggctcccgccaaaaaggccgccgcgcccaaggctgctgcgccgaagaaggccgccgctcccaaggccgctgcccccgtcggcgccgcgaccggccgcatcgcgcaggtcatcggcgccgtcgtcgacgtccagttcaccggcgaactgcccgcgatcctgaacgcgctcgaaaccgacaacaatggcaaccgcctcgtcctcgaagtcgcgcagcacctcggcgagaacaccgtccgcaccatcgcgatggacgcgaccgacggcctgacccgcggccagccggtgcgcgacaccggcgcgcagatttcggtccccgtcgggccgcagacattgggccgcatcctcaacgtcatcggcgagccgatcgacgaacgcggtccggtgaacagcgacatgaccgcgccgatccacgccaaggctcctgagtttgtcgaccagtcgaccgaagcgtcgatcctcgtcaccggcatcaaggtcatcgacctgatcgcgccctatgccaagggtggcaagatcggcctgttcggcggcgcgggcgtcggcaagaccgtgctcatccaggaactgatcaacaacatcgccaagggtcacggcggcgtcagcgtgttcgcgggcgtcggtgaacgcacccgcgaaggcaacgacctttatcacgagtttctcgatgccggcgtcatcgccaaggacgccgacggcaacccgacccccgacgggtcgaaggtcgcgctggtgttcggccagatgaacgaaccgccgggcgcgcgtgcccgcgtcgcgctctcgggcctcaccatggccgaatatttccgcgaccaggaagggcaggacgtgctcttcttcgtcgacaacattttccgcttcacccaggcgggttcggaagtgtcggcgctgctcggccgtattccctcggcggtgggttatcagccgacgctgtcgaccgacatgggcgcgctgcaggaacgcatcacctcgaccaccaagggctcgatcacctcggtgcaggcgatttacgtccccgcggacgacctgaccgacccggcgcctgcaacctccttcgctcacctggacgcgacgacgacgctcagccgcgcgatttcggaactcggcatctatcccgcggtcgatccgctcgattcgaccagccgcgtgctcaccccggcgatcgtcggtcaggaacattatgaaaccgcgcgccgcgttcaggaaacgctgcagaaatacaagtcgctgcaggacatcatcgcgatcctcggcatggacgagctgtcggaagaggacaagctggtcgtcgcccgcgcgcgcaagatccagcgcttcctcagccagcccttccacgtcgccgaagtcttcaccggcattcccggcaagttcgtgccgatcgaggaaacggtgaagtcgttcaaggcggtcgtcgacggcgaatatgaccatctgcccgaagcggccttctacatggtcggcggcatcgacgaagcggtcgccaaggccgcgaagctcgccgaagaggcgtaa

SEQ ID NO: 7289 - protein, 513 aa, Sphingopyxis alaskensis
MATAPATEKKAPAKKAAAPKAAAPKKAAAPKAAAPVGAATGRIAQVIGAVVDVQFTGELPAILNALETDNNGNRLVLEVAQHLGENTVRTIAMDATDGLTRGQPVRDTGAQISVPVGPQTLGRILNVIGEPIDERGPVNSDMTAPIHAKAPEFVDQSTEASILVTGIKVIDLIAPYAKGGKIGLFGGAGVGKTVLIQELINNIAKGHGGVSVFAGVGERTREGNDLYHEFLDAGVIAKDADGNPTPDGSKVALVFGQMNEPPGARARVALSGLTMAEYFRDQEGQDVLFFVDNIFRFTQAGSEVSALLGRIPSAVGYQPTLSTDMGALQERITSTTKGSITSVQAIYVPADDLTDPAPATSFAHLDATTTLSRAISELGIYPAVDPLDSTSRVLTPAIVGQEHYETARRVQETLQKYKSLQDIIAILGMDELSEEDKLVVARARKIQRFLSQPFHVAEVFTGIPGKFVPIEETVKSFKAVVDGEYDHLPEAAFYMVGGIDEAVAKAAKLAEEA

SEQ ID NO: 7290 - DNA, 1497 bp, Spinacia oleracea
  CDS (1)..(1497)
atgagaatcaatcctactacttctgatcctggggtttccacacttgaaaaaaaaaacctggggcgtatcgctcaaattattggtccggtactggacgtagcctttcctccaggcaagatgcccaatatttacaacgctctaatagttaaaggtcgagatactgctggtcaaccaatgaatgtgacttgtgaagtacaacaattattaggaaataatagagttagagctgtagctatgagtgctacagatggtctaacgcgaggaatggaagttatcgacacaggagctcctttaagcgttccagtcggtggagcgactcttggacgaatttttaacgtgcttggggagcctgttgataatttaggtccagtagatacacgcacaacatctcctattcatagatcggcgcccgcctttacacagttagatacaaaattatctatttttgaaacaggaattaaagtggtagatcttttagccccttatcgccgtggaggaaaaatcggactatttgggggagcgggagtgggtaaaacagtactcattatggaattgattaacaatattgccaaagctcatgggggcgtatccgtatttggcggagtaggtgaacgtactcgtgaaggaaatgatctttacatggaaatgaaagaatccggagttatcaatgaacaaaatatcgcagaatcaaaggtggctttagtttatgggcaaatgaatgaaccgccaggagcgcgtatgagagttgggttgactgccctaactatggcggaatatttccgagatgttaatgaacaagacgtacttctatttattgacaatatcttccgtttcgtccaagcaggatctgaagtatctgccttattgggtcgaatgccttccgctgtgggttatcaacctactcttagtaccgaaatgggctcgttacaggaaagaattacttctacaaaagaagggtccataacttcgattcaagcagtttatgtacctgcggacgatttgaccgatcccgctcctgctacgacatttgcacatttagatgctactaccgtactatcaagaggattggccgccaaagggatctatccagcagtagatccgctagattcaacgtcaactatgctccaacctaggatcgttggcgaggaacattatgaaattgcgcaaagagttaaggaaaccttacaacgttacaaagaacttcaggacattatagctatccttggtttggacgaattatccgaagaagatcgtttaactgtagcaagagcacgaaaaattgagcgtttcttatcacaaccctttttcgtagcagaagtatttacaggctctccaggaaaatatgttggtctagcagaaacaattagagggtttcaattgatcctttccggagaattagacagtcttcctgaacaggctttttatttggtaggtaacatcgacgaagctaccgcgaaagctatgaacttagaaatggagagcaaattaaagaaatga

SEQ ID NO: 7291 - protein, 498 aa, Spinacia oleracea
MRINPTTSDPGVSTLEKKNLGRIAQIIGPVLDVAFPPGKMPNIYNALIVKGRDTAGQPMNVTCEVQQLLGNNRVRAVAMSATDGLTRGMEVIDTGAPLSVPVGGATLGRIFNVLGEPVDNLGPVDTRTTSPIHRSAPAFTQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQRVKETLQRYKELQDIIAILGLDELSEEDRLTVARARKIERFLSQPFFVAEVFTGSPGKYVGLAETIRGFQLILSGELDSLPEQAFYLVGNIDEATAKAMNLEMESKLKK

SEQ ID NO: 7292 - DNA, 1413 bp, Staphylococcus epidermidis
  CDS (1)..(1413): transl_table=11
atgggaattggccgtgtaactcaagttatgggtccagtaatagatgttcgttttgaacataacgaagtacctgagataaataatgcattacacatcgaagttcctaaagaagatggagcgcttcaattaacattagaagttgcacttcaactaggtgacgatgtagttcgtacaattgcaatggactcaactgacggcgttcaaagaggaatggaagttaaagatacaggtagagacataagtgtacctgtcggtgacgtaactctaggaagagtgtttaacgtactaggagaaactattgacttagatgaaaaaattgatgattcagtacgacgtgaccctatccatagacaagctccaggattcgacgaattatcaacaaaagtagaaatcttagaaactggtattaaagtagtagacttattagcaccttacataaaaggtggtaaaattggattatttggtggtgccggtgtaggtaaaaccgtactaatccaagaacttattaataacatcgctcaagaacacggtggtatctcagtattcgctggtgttggtgaacgtacacgtgaaggtaatgatctttactatgaaatgagtgacagtggtgttatcaagaaaactgcaatggtctttggtcaaatgaatgagccacctggtgcacgtatgcgtgtagcattatccggattaacaatggccgaatatttccgagatgaagaaggccaagatgtgttattattcattgataacattttcagattcactcaagctggttcagaagtttctgcgttattaggtcgtatgccatcagctgttggttatcaacctacacttgctacagaaatgggtcaattacaagaacgtataagttcaacaaataaaggttcagttacatcaattcaagctgttttcgtaccagccgatgactatactgaccctgcgccagcaacaacgttcgcacacttagattcaacaacaaacttagagcgtaaattaacagaaatgggtatttatccagctgtagacccgcttgcttctacatctagagctttggaaccttcagtagtaggtcaagagcattatgatgtggcacgtgaagttcaatctactttacaaaaatatagagagttacaagatattattgcgattcttggtatggatgaattatcagatgaagataaacaaactgtggaacgagcacgtagaattcaattcttcttatcacaaaacttccacgttgcagaacaatttactggacaaaaaggttcatatgtacctgttaaaacaacagttgcagacttcagagatattttagatggtaagtatgaccatattcctgaagacgcattccgtttagtaggtagcatggaagacgtaattgagaaagcaaaagatatgggtgttgaagtctaa

SEQ ID NO: 7293 - protein, 470 aa, Staphylococcus epidermidis
MGIGRVTQVMGPVIDVRFEHNEVPEINNALHIEVPKEDGALQLTLEVALQLGDDVVRTIAMDSTDGVQRGMEVKDTGRDISVPVGDVTLGRVFNVLGETIDLDEKIDDSVRRDPIHRQAPGFDELSTKVEILETGIKVVDLLAPYIKGGKIGLFGGAGVGKTVLIQELINNIAQEHGGISVFAGVGERTREGNDLYYEMSDSGVIKKTAMVFGQMNEPPGARMRVALSGLTMAEYFRDEEGQDVLLFIDNIFRFTQAGSEVSALLGRMPSAVGYQPTLATEMGQLQERISSTNKGSVTSIQAVFVPADDYTDPAPATTFAHLDSTTNLERKLTEMGIYPAVDPLASTSRALEPSVVGQEHYDVAREVQSTLQKYRELQDIIAILGMDELSDEDKQTVERARRIQFFLSQNFHVAEQFTGQKGSYVPVKTTVADFRDILDGKYDHIPEDAFRLVGSMEDVIEKAKDMGVEV

SEQ ID NO: 7294 - DNA, 1446 bp, Stigmatella aurantiaca
  CDS (1)..(1446): transl_table=11
atgagcgctcaagttgcgacggtaggcaagatcacccaggttctcggtcccgtgattgacgtggagttcccgccgggaggcctgcccgaggtgtacaccgccctcaaggtcaccaacaccagcatcagcgccgaggcggacaacctcaccatcgaagtggcccagcacctgggtgagaacatggtgcgctgcatctcgatggactccaccgagggcctggcccgaggccaggcggtgaagaacaccggcgcccccatccaggtgcccgtggggcaaggcaccctgggccgcatcctcaacgtcatcggcgagccggtggacgagcgcggccccatcacctcctcgcagacgtggcccattcaccgtccggcgcccaccttcgtggaccaggacgtgcgcgtgcaggccttcgagacgggcatcaaggtcatcgacctgctggggccctacacccgcggtggcaagatcggcctgttcggcggcgccggcgtgggcaagacggtgctcctgatggagctcatcgtcaacgtggccaaggagcgcggcggcttctcggtgttcgccggcgtgggcgagcgcacccgcgagggcaacgacctgtatcacgagatgcaggaaggcaacgtatcaacaccaagaacctggatggagagccagtgcgtgctggtgtacgggcagatgaatgagccgcccggcgcccgtgcccgcgtggccctctcggcgctcaccatcgccgagtacttccgggacatggaggggcacgacgtgctcctcttcgtggacaacatctttcgcttcacgcaggcaggctccgaggtgtccgcgctcctgggccgcatccccagcgccgtgggttaccagcccacgctgtccaccgagatgggcgccctccaggagcgcatcacctccaccaccaagggctcggtcacctcggtgcaggccatctacgtgcccgccgacgacctgacggacccggcgccggccaccacgttcgcccacctggatgcgaccacggtgctcaaccgcgccatctccgagctgggcatctaccccgcggtggacccgctcgactccaccagccgcatcctcgatccgaacgtggtggggccggagcactacgcggtggcgcgcaaggtccagggcatcctccagaagtacaaggagctccaggacatcatcgccatcctcggcatggacgagctgtccgagacggacaagctcaccgtggcccgcgcgcggaagatccagaagttcctgtcgcagcccttccacgtggccgaggtcttcaccggcgcgcccggccgctacgtggagctcaaggacaccatccagggcttcaaggagctcgccgagggcaagcacgacgacctgcccgaggctgccttctacatggtgggcaacatcaacgaggccatcgagaaggcgcgcaagctggccgcggcctaa

SEQ ID NO: 7295 - protein, 481 aa, Stigmatella aurantiaca
MSAQVATVGKITQVLGPVIDVEFPPGGLPEVYTALKVTNTSISAEADNLTIEVAQHLGENMVRCISMDSTEGLARGQAVKNTGAPIQVPVGQGTLGRILNVIGEPVDERGPITSSQTWPIHRPAPTFVDQDVRVQAFETGIKVIDLLGPYTRGGKIGLFGGAGVGKTVLLMELIVNVAKERGGFSVFAGVGERTREGNDLYHEMQEGNVSTPRTWMESQCVLVYGQMNEPPGARARVALSALTIAEYFRDMEGHDVLLFVDNIFRFTQAGSEVSALLGRIPSAVGYQPTLSTEMGALQERITSTTKGSVTSVQAIYVPADDLTDPAPATTFAHLDATTVLNRAISELGIYPAVDPLDSTSRILDPNVVGPEHYAVARKVQGILQKYKELQDIIAILGMDELSETDKLTVARARKIQKFLSQPFHVAEVFTGAPGRYVELKDTIQGFKELAEGKHDDLPEAAFYMVGNINEAIEKARKLAAA

SEQ ID NO: 7296 - DNA, 1437 bp, Streptomyces avermitilis
  CDS (1)..(1437): transl_table=11
atgacgacgacagttgagacggccgttgccacgggccgcgtcgcccgggtcatcggcccggtcgtcgacgtggaattccccgtcgacgcgatgccggacatgtacaacgcccttcacgtcgaggtggccgacccggccaacgccggcgagaagaagacgctgaccctggaggtcgcccagcacctgggtgacggcctggtccgcaccatctccatgcagcccaccgacggtctggtccgccaggccgcggtcaccgacaccggtacgggcatcaccgtcccggtcggcgacttcaccaagggcaaggtgttcaacaccctcggtgaggtgctgaacgtcgacgagaagtacgacggcgagcgctggtccatccaccgcaaggccccgcgcttcgacgagctcgagtcgaagaccgagatgttcgagaccggcgtcaaggtcatcgaccttctcaccccgtacgtcaagggtggaaagatcggtctgttcggtggagccggcgtcggcaagacggtgctcatccaggagatgatctaccgcgtcgccaacaaccacgacggtgtctccgtgttcgccggtgtcggtgagcgcacccgtgagggcaacgacctcatcgaggagatgtcggactcgggcgtcatcgacaagaccgccctggtcttcggccagatggacgagcccccgggcacccgtctgcgcgtggccctggccggtctgaccatggcggagtacttccgcgatgtgcagaagcaggacgtgctgttcttcatcgacaacatcttccgcttcacccaggccggttccgaggtgtcgaccctgctcggccgtatgccctccgcggtgggctaccagccgaacctggccgacgagatgggtctcctccaggagcgcatcacctcgacccgtggtcactcgatcacctcgatgcaggcgatctacgtccccgcggacgacctgaccgacccggccccggccaccacgttcgcccacctcgacgcgacgacggttctctcccgtccgatctccgagaagggcatctacccggccgtggacccgctggactccacgtcccgcatcctggacccgcgctacatcgcgcaggaccactacgacgccgccatgcgcgtcaagacggttctgcagaagtacaaggacctccaggacatcatcgcgatcctcggtatcgacgagctcggcgaggaggacaagctcgttgtccaccgcgcccgtcgcgtggagcgcttcctgtcccagaacacccacgtcgccaagcagttcaccggcgtcgacgggtcggacgtcccgctggacgagtcgatcaccgcgttcaacgcgatcatcgacggcgagtacgaccacttcccggagcaggcgttcttcatgtgcggtggcattgaggacctcaaggccaacgccaaggagctcggcgtctcctga

SEQ ID NO: 7297 - protein, 478 aa, Streptomyces avermitilis
MTTTVETAVATGRVARVIGPVVDVEFPVDAMPDMYNALHVEVADPANAGEKKTLTLEVAQHLGDGLVRTISMQPTDGLVRQAAVTDTGTGITVPVGDFTKGKVFNTLGEVLNVDEKYDGERWSIHRKAPRFDELESKTEMFETGVKVIDLLTPYVKGGKIGLFGGAGVGKTVLIQEMIYRVANNHDGVSVFAGVGERTREGNDLIEEMSDSGVIDKTALVFGQMDEPPGTRLRVALAGLTMAEYFRDVQKQDVLFFIDNIFRFTQAGSEVSTLLGRMPSAVGYQPNLADEMGLLQERITSTRGHSITSMQAIYVPADDLTDPAPATTFAHLDATTVLSRPISEKGIYPAVDPLDSTSRILDPRYIAQDHYDAAMRVKTVLQKYKDLQDIIAILGIDELGEEDKLVVHRARRVERFLSQNTHVAKQFTGVDGSDVPLDESITAFNAIIDGEYDHFPEQAFFMCGGIEDLKANAKELGVS

SEQ ID NO: 7298 - DNA, 1437 bp, Streptomyces coelicolor
  CDS (1)..(1437): transl_table=11
atgaccaccactgttgagaccgcgacggccacgggccgcgtcgcccgggtcatcggcccggtcgtcgacgtggagttccccgtcgacgcgatgccggagatctacaacgcgctgcacgtagaggtcgccgacccggccaaggagggcgagctcaagacgctgaccctcgaggtcgcccagcacctcggtgacggcctggtccgcaccatctccatgcagcccaccgacggcctgatccgtcaggccccggtgaccgacacgggcgcggccatctccgtccccgtcggcgacttcaccaagggcaaggtgttcaacaccctcggtgaggtgctgaacgtcgacgagcagtacaccggtgagcgctggccgatccaccgcaaggccccgaacttcgacgagctcgagtcgaagaccgagatgttcgagaccggcgtcaaggtcatcgacctgctgaccccgtacgtcaagggcggcaagatcggtctgttcggcggtgccggcgtcggcaagacggtgctcatccaggagatgatctaccgcgtcgccaacaaccacgacggtgtctccgtgttcgccggtgtcggcgagcgcacccgtgagggcaacgacctcatcgacgagatgagcgagtccggcgtcatcgacaagaccgcgctggtcttcggtcagatggacgagccgccgggcacccgtctgcgcgtcgcgctggccggcctcaccatggccgagtacttccgcgacgtccagaagcaggacgtgctgttcttcatcgacaacatcttccgcttcacccaggcgggctccgaggtgtcgaccctgctcggccgcatgccctccgcggtgggctaccagccgaacctggccgacgagatgggtctcctccaggagcgcatcacctcgacccgtggtcactcgatcacctcgatgcaggcgatctacgtccccgcggacgacctgaccgacccggccccggccaccaccttcgcccacctcgacgcgacgacggtgctctcccgtccgatctccgagaagggcatctacccggccgtggacccgctggactcgacgtcccgcatcctcgacccgcggtacatcgcggcggagcactacaacgccgcgatgcgcgtgaagaacatcctgcagaagtacaaggacctgcaggacatcatcgcgatcctcggtatcgacgagctgggcgaagaggacaagctcgtcgtccaccgcgcccgtcgcgtggagcgcttcctgtcccagaacacccacgtcgccaagcagttcaccggcgtcgacgggtcggacgtcccgctggacgagtcgatcgcggccttcaacgcgatctgcgacggcgagtacgaccacttcccggagcaggcgttcttcatgtgcggtggcatcgaggacctgaagaacaacgccaaggagctgggcgtctcctga

SEQ ID NO: 7299 - protein, 478 aa, Streptomyces coelicolor
MTTTVETATATGRVARVIGPVVDVEFPVDAMPEIYNALHVEVADPAKEGELKTLTLEVAQHLGDGLVRTISMQPTDGLIRQAPVTDTGAAISVPVGDFTKGKVFNTLGEVLNVDEQYTGERWPIHRKAPNFDELESKTEMFETGVKVIDLLTPYVKGGKIGLFGGAGVGKTVLIQEMIYRVANNHDGVSVFAGVGERTREGNDLIDEMSESGVIDKTALVFGQMDEPPGTRLRVALAGLTMAEYFRDVQKQDVLFFIDNIFRFTQAGSEVSTLLGRMPSAVGYQPNLADEMGLLQERITSTRGHSITSMQAIYVPADDLTDPAPATTFAHLDATTVLSRPISEKGIYPAVDPLDSTSRILDPRYIAAEHYNAAMRVKNILQKYKDLQDIIAILGIDELGEEDKLVVHRARRVERFLSQNTHVAKQFTGVDGSDVPLDESIAAFNAICDGEYDHFPEQAFFMCGGIEDLKNNAKELGVS

SEQ ID NO: 7300 - DNA, 1407 bp, Streptococcus mutans
  CDS (1)..(1407): transl_table=11
atgagcacaggcaaaattgctcaggtagttggtcctgttgttgatgttgcatttgcgacagatgataaacttcctgagattaataatgcattggtcgtttataaagatggcgacaagtctcaaagaattgttcttgaagttgcccttgaactcggtgatggactagttcgtaccattgctatggagtcaactgatggtttaacacgtgggcttgaagtctttgatacgggccgtgctatcagtgttccggttggaaaagaaacactaggtcgtgtctttaatgttcttggagatacgattgaccttgataagccttttgcagaagatgctgaacgtcagccaattcataaaaaggcaccatcatttgatgatctatcaacttcaactgagattttagaaacaggaattaaagttattgaccttcttgccccttatcttaaaggtggtaaagtcggcctttttggtggtgccggtgtcggaaagaccgttttgattcaggagttaattcataatattgctcaagagcatggcgggatttcggtatttactggtgttggtgaacggacacgtgaaggaaatgacctttattgggaaatgaaagaatctggtgttattgaaaagacagctatggtctttggtcagatgaatgaaccgcctggagcacggatgcgtgttgctcttactggtcttaccatcgctgaatacttccgtgatgtagaaggtcaggatgtgcttcttttcattgataacattttccgttttacccaagcaggttctgaagtttcagctcttcttggccgtatgccatcagccgttggttatcagccaaccttggcaactgaaatggggcaattgcaagaacggattacatcgacgaaaaaaggttctgttacctcaattcaggccatctatgtgccagccgatgactatactgaccctgcgccagctacagcctttgctcacttagattcaaccactaaccttgaacgccgtctgacacaaatggggatttacccagcggtggatcctttagcttcaagttcacgtgctctctcgcctgaaatagttggtcaagagcactacgatgttgccacagaagtacagcatgtcttgcagcgttatcgtgagttacaagatattatagctattcttggtatggatgagttatctgatgaagaaaagactctggttggccgtgcgcgtcggattcagttcttcctttcacaaaatttcaatgttgcagaacaatttacaggacagccgggttcttatgttcctgttgctgaaactgtccgtggatttaaagaaattctcgaaggaaaatatgatgaacttccagaagatgctttccgaagtgttggagctattgaggatgttgttgaaaaagccaagaatatgggtgtttaa

SEQ ID NO: 7301 - protein, 468 aa, Streptococcus mutans
MSTGKIAQVVGPVVDVAFATDDKLPEINNALVVYKDGDKSQRIVLEVALELGDGLVRTIAMESTDGLTRGLEVFDTGRAISVPVGKETLGRVFNVLGDTIDLDKPFAEDAERQPIHKKAPSFDDLSTSTEILETGIKVIDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERRLTQMGIYPAVDPLASSSRALSPEIVGQEHYDVATEVQHVLQRYRELQDIIAILGMDELSDEEKTLVGRARRIQFFLSQNFNVAEQFTGQPGSYVPVAETVRGFKEILEGKYDELPEDAFRSVGAIEDVVEKAKNMGV

SEQ ID NO: 7302 - DNA, 1436 bp, Thermotoga maritima
  CDS (1)..(1407): transl_table=11
atggcaaagggttcgaaaggattcattgtgagtattatgggacctgttgtggacgtgaaatttcccgaagaggaactcccggatatatacaacgccctcgaagttgtaaatccccaaacggggcagaaggtagtgctcgaggtggagcagctcatcggcgatggagttgttagaacggtggctatggattcaacagacggtttaaccaaaggtctggaagtggtagatacaggagctcccataacagcacctgtggggaaagaagtccttggaaggatcctgaacgtgataggtgaacctgtcgacgaagcaggagaaataaaagccaaagaaagatggcccattcacagaccagcccctgagcttgtggaacaatccacagagatagaaatcctcgagaccggtataaaggtgatcgatcttctcgctccgttcccaaagggcggaaagatcggtttcttcggaggagcgggcgttggaaagaccgtgctcgttatggaactcatcagaaacatcgcaatagaacacaagggattttcagtgttcgcaggtgtcggggagagaacaagagaaggtaacgaactctggctcgaaatgcaggaaagcggagttcttggaaacaccgttctcgtttttggccagatgaacgagcccccgggagcaaggttcagagtggctcttaccgccctcaccatcgctgagtacttcagagacgtagaaggaagagacgttcttctcttcatagacaacatattcaggtttgtccaagctggaagtgaagtctcggcacttctcggaagaatgccgtctgctgtgggatatcagcccaccctcgcaaccgatatgggagaacttcaggagagaatcacttcgacgaggagaggttccatcacatccgttcaggccatatacgttcctgcggacgacataaccgacccggcaccggcaaccaccttcgcccatcttgatgccactgtggttctgtcacgaagaatagcagaacttggactttacccggcggttgatcctctcgactcctcctcgaaaattctggatccagcgatcgttggaagagagcattacgaagtggcaagaggtgttcaggaagttcttcagagatacaaggaccttcaggatattatcgccatactcggtgtggaggaactctctccggaagacaaacttgtggttcaccgtgccagaagaattcaaaggttcctcagccagccgttccacgtagcagaaaggttcacaggtcgtcctggaagatacgtacccattgaagaaacaattagaggattcaaggagattctcgacggaaaacttgacgatgtacctgaacaggcgtttctcatggccggaaacatcgacgaagttaaagaaagagcaaaagaaatgaggagttgaaaatgtgaagggtaaaaatcgttacaccc

SEQ ID NO: 7303 - protein, 468 aa, Thermotoga maritima
MAKGSKGFIVSIMGPVVDVKFPEEELPDIYNALEVVNPQTGQKVVLEVEQLIGDGVVRTVAMDSTDGLTKGLEVVDTGAPITAPVGKEVLGRILNVIGEPVDEAGEIKAKERWPIHRPAPELVEQSTEIEILETGIKVIDLLAPFPKGGKIGFFGGAGVGKTVLVMELIRNIAIEHKGFSVFAGVGERTREGNELWLEMQESGVLGNTVLVFGQMNEPPGARFRVALTALTIAEYFRDVEGRDVLLFIDNIFRFVQAGSEVSALLGRMPSAVGYQPTLATDMGELQERITSTRRGSITSVQAIYVPADDITDPAPATTFAHLDATVVLSRRIAELGLYPAVDPLDSSSKILDPAIVGREHYEVARGVQEVLQRYKDLQDIIAILGVEELSPEDKLVVHRARRIQRFLSQPFHVAERFTGRPGRYVPIEETIRGFKEILDGKLDDVPEQAFLMAGNIDEVKERAKEMRS

SEQ ID NO: 7304 - DNA, 1380 bp, Thiobacillus denitrificans
  CDS (1)..(1380): transl_table=11
atgagcaacggaaaaattgttcagatcatcggcgcggtggtggacgtggaattcccgcgcgatgccatgcccaaggtcatggaagcgctgaagatgcaggcccccgagctgaccttcgaagtccagcagcagctgggcgacggcgtcgtccgcaccatcgcgatgggctcgaccgacggcctgcgccgcggcatggacgtgctgtcgaccggcaacccgatcatggtgcccgtcggccagaagacgctcggccgcatcatgaacgtgctcggcgatccggttgacgaagccggcccgatcggcgccgagacgaccatgccgatccaccgcaaggccccggcctacgccgaccaggccgcgacggtcgagattctcgaaaccggcatcaaggtcatcgacctcatcatgccgatcgccaagggcggcaaggtcggcctgttcggcggtgccggcgtcggcaagaccgtgacgctgatggaactgatccgcaacatcgctgtgcagcactcgggtttctcggtgttcgccggcgtgggcgagcgtacccgtgaaggcaacgacttctatcacgagatgaaggaaggcggcgttctcgacaaggtcgccctggtctacggccagatgaacgagcccccgggcaaccgtctgcgcgttgcgctgaccggtctgaccatggccgagtacttccgtgacgaaggccgcgacgtgctgctgttcgtcgacaacatctaccgctacacgctggccggtaccgaagtgtcggcgctcttgggccgcatgccgtccgcggtgggctaccagccgaccctggccgacgagatgggccgcctgcaggagcgcatcacctcgaccaagaccggttcgatcacctcgttccaggccgtgtacgtgccggcggacgacttgaccgacccgtcgcccgcgacgacgttcgcgcacttggacgcgacgctggtgttgagccgtcaggttgccgaactcggtatctaccccgcggtggacccgctcgactcgacctcgcggattctcgatccgcaagtcgtcggtgaggagcactacacggtcgcgcgcaaggtgcagggcacgctgcagaagtacaaggaactgcgcgacatcatcgcgattctgggcatggacgaactgtcgcccgaagacaagctggcggtgtcgcgtgcacgtaagctgcagcgcttcctgtcgcagccgttcttcgtcgccgaagtgttcaccggcgcgcccggcaagtacgtcacgctgaaagacacgatcgcgggcttcaaggccatcgtcgaaggcgagtacgaccacctgcccgagcaggcgttctacatggtcggcggcatcgaagaagcggtcgaaaaggcgaaaacgattcagtaa

SEQ ID NO: 7305 - protein, 459 aa, Thiobacillus denitrificans
MSNGKIVQIIGAVVDVEFPRDAMPKVMEALKMQAPELTFEVQQQLGDGVVRTIAMGSTDGLRRGMDVLSTGNPIMVPVGQKTLGRIMNVLGDPVDEAGPIGAETTMPIHRKAPAYADQAATVEILETGIKVIDLIMPIAKGGKVGLFGGAGVGKTVTLMELIRNIAVQHSGFSVFAGVGERTREGNDFYHEMKEGGVLDKVALVYGQMNEPPGNRLRVALTGLTMAEYFRDEGRDVLLFVDNIYRYTLAGTEVSALLGRMPSAVGYQPTLADEMGRLQERITSTKTGSITSFQAVYVPADDLTDPSPATTFAHLDATLVLSRQVAELGIYPAVDPLDSTSRILDPQVVGEEHYTVARKVQGTLQKYKELRDIIAILGMDELSPEDKLAVSRARKLQRFLSQPFFVAEVFTGAPGKYVTLKDTIAGFKAIVEGEYDHLPEQAFYMVGGIEEAVEKAKTIQ

SEQ ID NO: 7306 - DNA, 1407 bp, Thiobacillus ferrooxidans
  CDS (1)..(1407): transl_table=11
atgagcgaacggtgcaaagaaaacgccgtcggccatatcgtccaggtgatcgggccggtgatcgacgtcgccttttctcgcgggcaggtccccgagattatggaagctattgtggtcgacgcaaacaatctgaccattgaggtgcaggcccagttgggtgacggcgtggcgcgcggtatcgccatggggcccagcgaaggcctcaaacgcgggctggccgtcactcgtaccggtgcgccgatcagtgtgccggtagggcatgccaccctgggccggatcatgaacgtcctgggtgagccggtagatggcaaaggacccgtgcagacggaagatcgccaggccatccatcgcccggcgccggcctttgatgaacttgcggcaagcaccgaggtgctggagaccggcatcaaggtcatcgatctggtctgtccttttgccaaaggcggtaaggtcggtctcttcggcggcgccggcgtgggcaagacggtgctcatgatggagttgatccgcaacatcgctatcgagcataccggatattcggtgtttgcaggcgtcggcgagcggactcgtgaagggaacgacttttaccatgaaatgaccgactccggcgttttggacaaggtcgccctggtatacgggcagatgaacgagccgcccggcaaccgtttgcgcgccgggttgaccggcctgaccatggcggagcacttccgtgatgaaggtcgcgacattttgatgttcatcgataacattttccgctatccgctggcaggcaccgaagtctcggcgctgctggggcgtatgccttctgcggtgggctatcagccaacgctggctgaagaaatgggtcagttgcaggagcgtatcacttccaccaaggtgggctccatcacctcggtgcaggccgtttacgtgcccgcggacgatctcaccgatccttctccggcgacgacctttgcccacttggacgccacggtagtgttgtcgcggcagattgcggaactgggcatctaccccgcactcgatccgctcgattctttcagccgtcagctcgatccgcagatcgtcggccaagagcactatgatgtggctcgttcctgccagaagacgttgcagcgctacaaggaattgcaggatatcattgccattctgggcatggatgaattgtctgaggacgacaaactgctggtgtcgcgggcacgcaagattcagcgctatctgtcccagcctttctttgtcgctgaagtgttcaccggcagccccggtacctatgtctccctgaaggaaacgatccgtgcattcaaggcgatcgtggcaggagagtatgaccacctgcccgagcaggccttctacatggtcggcaccatagatgaagcccttgccaaggcccaaaagctgcagcaaggctaa

SEQ ID NO: 7307 - protein, 468 aa, Thiobacillus ferrooxidans
MSERCKENAVGHIVQVIGPVIDVAFSRGQVPEIMEAIVVDANNLTIEVQAQLGDGVARGIAMGPSEGLKRGLAVTRTGAPISVPVGHATLGRIMNVLGEPVDGKGPVQTEDRQAIHRPAPAFDELAASTEVLETGIKVIDLVCPFAKGGKVGLFGGAGVGKTVLMMELIRNIAIEHTGYSVFAGVGERTREGNDFYHEMTDSGVLDKVALVYGQMNEPPGNRLRAGLTGLTMAEHFRDEGRDILMFIDNIFRYPLAGTEVSALLGRMPSAVGYQPTLAEEMGQLQERITSTKVGSITSVQAVYVPADDLTDPSPATTFAHLDATVVLSRQIAELGIYPALDPLDSFSRQLDPQIVGQEHYDVARSCQKTLQRYKELQDIIAILGMDELSEDDKLLVSRARKIQRYLSQPFFVAEVFTGSPGTYVSLKETIRAFKAIVAGEYDHLPEQAFYMVGTIDEALAKAQKLQQG

SEQ ID NO: 7308 - DNA, 1636 bp, Nicotiana tabacum
  CDS (43)..(1539)
tttttgcaaaaacatttcgacatatttatttattttattattatgagaatcaatcctactacttctggttctggggtttccacgcttgaaaaaaaaaacccggggcgtgtcgtccaaatcatcggtccggtactagatgtagcctttcccccgggcaagatgccgaatatttataacgctctggtagttcaaggtcgagatagtgttggtcaaccaattaatgtggcttgtgaggtacagcaattattaggaaataatcgagttagggctatagctatgagtgctacagagggtctaacgagaggaatggaagtgattgacacaggagctcctataagtgttccggtcgggggagcgactctgggacgaatttttaacgtgctcggagaacctgttgataatttagggcctgtagatactagtacaacgtctcctattcatagatctgcgcccgcctttatacagttggatacaaaattatctatttttgaaacaggaattgaagtagtagatcttttagccccttatcgccgtggaggaaaaatcggactattcgggggagctggagtgggtaaaacagtacttattatggaattgattaacaatattgctaaagctcacgggggcgtatccgtatttggcggagtgggtgaacgtactcgggaaggaaatgatctttacatggaaatgaaagaatctggagtaattaatgaagaaaatattgcagaatcaaaagtagccctagtttatggtcagatgaatgaaccgccgggagctcgtatgagagttggtttgactgccctaactatggcggaatatttccgagatgttaatgagcaagacgtacttctttttattgacaatatcttccgtttcgtccaagcaggatccgaagtatcggccttattgggtagaatgccttccgctgtgggttatcaacccaccctgagtaccgaaatgggttctttacaagaaagaattacttctaccaaagaagggtccataacctctattcaagcagtttatgtacccgcagacgatttgaccgaccctgctcctgctacgacatttgcacatttagatgctactaccgtactatcaagaggattggctgccaaaggtatttatccagcagtagatcctttagattcaacgtcaaccatgcttcaacctcggatcgttggtgaggaacattacgaaaccgcccaaagagttaagcaaactttacaacgttacaaagaacttcaggacattatagctatccttggattggacgaattatccgaagaggatcgtttactcgtagcaagagcgcgaaaaattgagcgtttcttatcacaaccctttttcgtagcagaagtatttaccggttctccaggtaaatatgttggtctagcagaaacaattcgaggatttcaattgatcctttccggagaattagatggtcttcctgaacaggccttttatttggtaggtaatatcgatgaagctaccgcgaaggctatgaacttagaaatggagagcaatttgaagaaatgaccttaaatcttagtgtactgacccctaatcgaattgtttgggattcagaagtggaagaaattgttttatctactaatagcggtcaaattggcatatt

SEQ ID NO: 7309 - protein, 498 aa, Nicotiana tabacum
MRINPTTSGSGVSTLEKKNPGRVVQIIGPVLDVAFPPGKMPNIYNALVVQGRDSVGQPINVACEVQQLLGNNRVRAIAMSATEGLTRGMEVIDTGAPISVPVGGATLGRIFNVLGEPVDNLGPVDTSTTSPIHRSAPAFIQLDTKLSIFETGIEVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLLVARARKIERFLSQPFFVAEVFTGSPGKYVGLAETIRGFQLILSGELDGLPEQAFYLVGNIDEATAKAMNLEMESNLKK

SEQ ID NO: 7310 - DNA, 2392 bp, Tropheryma whipplei
  CDS (534)..(1958): transl_table=11
ttgttgaggcagaaaacattgatatgcctcatacgtccgatatgggagatatgcaaaataatacctttcggcgtaaagttgacgaagtttatattgtgttcaatcgttttgtaaacctggtaaaccaagtaccaactgcctttcgtctgatcccaatggaggttgtggatgaggtttcctcatcatccaatattcaacgggaacatgataggcccgttttgcctctttactctttcgagccagatgtaacatcggttttggatgagcttttgaaggaatatgttgagagcagggtatttgacacactacttcagtcagcaaccgcaaaacatgctgccactcaacgggctatgaaatctgcgagtgataatgccgacaagcttatagagaaatacacaagactcgcgaataatgcgcgccaggcggagataactcagcagatctctgagattatcggaggtgctggtgctctcgattcaggctgaatgtttctgtgattgttttgtatattaggatgcggatgattggagattatgacaggggatgcagttgggcggatagtgcgggttacgggctctgtcgtagatgtggagttttcacgcaataaccttcctggcgtttttaacgccttgaagacccgtgtaaaccgttctggaaaagaaattgagataacccttgaagttgctcagcatcttggtgacgacttggtccgtacggttgccatgcaatctactgatggtctaataaggggtcaagaggtgcttgataccggtggacatatcactgtccctgtaggtgatgcgacaaagggaagggtttttaacgttgttggtgaggtcttaaacagtaacggcgaagatatcaaatttgatgagtattggtctatacaccgcaagccgccagaatttagtcttcttgaaagtaagactcagctttttgaaactggcattaaagttattgatcttctaaccccgtatgttcagggcggtaaaatcggactctttggtggtgctggtgttggtaaaactgttcttattcaggaaatgatacaaagagtggcccaggatcatggcggtgtatcggtttttgccggggttggtgagcgtacgcgcgagggtaacgacctgattcgcgagatgcaggatgctggtgtttttgataaaaccgctcttgtttttggacaaatggatgagcctcccggcacacgccttcgtgtcgccctaagtgcccttacgatggcagaatacttccgagatgtccagaagcaggatgtcttattgttcatagataacattttccgtttcacgcaagcaggatcagaggtgtctactttgcttggacgtataccctcggctgttggatatcagccaaatttagctgatgaaatgggtgtcttgcaggagagaattacatcaacacgaggtcactcaattacttctcttcaggcgatctatgtgccggcagatgattatacggacccagccccggcaacaacttttgctcatcttgatgcgacaactgaactaagtcgtgagattgcctcaaaaggcttgtatcctgccgttgacccgcttgcgtcaaccagtcgcatacttgatccaaaatacattggtaaggatcattacagggtcgcagttacagtgaaacagattctgcaaagagataaggagctgcgggaaataattgcaattctcgggattgatgagctatcagaagaggacagagttacagttgcccgcgccaggcggattgagcagttcctgagtcagaatacatatatggcaaagaaatttacgggtgtggacggatcaactgtcccgcttcaggaaacaatcgatggatttgatgcaatctgcagaggtgactgcgatcatattccagaacaggcctttttcaatgtcggcggacttgaggatgttgagcgcaagtggagtaagctgcaaaaggaattaggttaaattggccacctttgaaacgaaagttgtttctgcgaagtcattttcgctaacatgcagcgcaactcttgttgttgcgcgcactcgcgctggagaaataggaattatggctggacatgagcctttacttgcggcacttgttccggggtctgtaaaaatctttgattcggtaaatagcgttcgtgccctcaaaacaggccgcgggtttttatgtatgaataacaatgttctcgagattgttgcctcggatatagaggtcgatacactcgagcagttgcacggcgcttagaattattcacataaggtgatcgcacattcggctgtgccgcgtttgctagatttgtttgcattatatataatcgggctgttcgcgttttgcgctcctcgttgccgggctttgttttctggattgctcagggattcgtcgtttgtgtatc

SEQ ID NO: 7311 - protein, 474 aa, Tropheryma whipplei
MTGDAVGRIVRVTGSVVDVEFSRNNLPGVFNALKTRVNRSGKEIEITLEVAQHLGDDLVRTVAMQSTDGLIRGQEVLDTGGHITVPVGDATKGRVFNVVGEVLNSNGEDIKFDEYWSIHRKPPEFSLLESKTQLFETGIKVIDLLTPYVQGGKIGLFGGAGVGKTVLIQEMIQRVAQDHGGVSVFAGVGERTREGNDLIREMQDAGVFDKTALVFGQMDEPPGTRLRVALSALTMAEYFRDVQKQDVLLFIDNIFRFTQAGSEVSTLLGRIPSAVGYQPNLADEMGVLQERITSTRGHSITSLQAIYVPADDYTDPAPATTFAHLDATTELSREIASKGLYPAVDPLASTSRILDPKYIGKDHYRVAVTVKQILQRDKELREIIAILGIDELSEEDRVTVARARRIEQFLSQNTYMAKKFTGVDGSTVPLQETIDGFDAICRGDCDHIPEQAFFNVGGLEDVERKWSKLQKELG

SEQ ID NO: 7312 - DNA, 1404 bp, Vibrio alginolyticus
  CDS (1)..(1404): transl_table=11
atggctacaggtaagatcgtacagatcatcggtgcggtagtcgacgtagagttcccacagagcaatgtacctagtgtatatgacgctctaaacgtaacggactcaaaagagcgtctagttcttgaagttcaacaacagctaggcggtggcgtagttcgttgtatcgtaatgggtagctctgatggtttacgtcgtggagttgaagtggttaacactggcgctccaatttcagtaccagtcggtactaaaactctaggtcgtatcatgaacgtcctaggtgacgcgattgatgagcgtggtgaagtgggcgcggaagaggtttactctatccaccgcagcgcaccaagctacgaagaacaatcaaacgagatcgcacttctagaaacgggcgttaaagtaatcgacctaatttgtccattcgctaagggtggtaaaatcggtctattcggtggtgcaggtgtaggtaagaccgttaacatgatggaacttatcaacaacatcgcactacagcactcaggtctatccgtatttgcgggtgttggtgagcgtactcgtgaaggtaacgatttctactacgagatgcaggaagcgggcgttgtaaacgttgagaagcctgaagaatcgaaagtagcgatggtttacggtcagatgaacgagccaccaggtaaccgtctacgtgttgcactgactggtctaacaatggcagaacgtttccgtgacgaaggtcgtgacgtactactgttcattgataacatctaccgttacacacttgcaggtacagaggtatcggcactgctaggtcgtatgccttctgcggtaggttaccagccaactcttgcagaagagatgggtgtacttcaggagcgtatcacgtcaacgaaatcaggttctatcacgtctgtacaggcggtatacgtacctgcggatgacttgactgacccgtctccagcaaccacgttcgcgcacttggatgcaacggttgtacttaaccgtaacatcgctgctatgggtctataccctgcgatcgacccactagattcaacatctcgtatgcttgatccactagtagttggtcaagatcactacgaagttgctcgtggcgttcagcagacacttcagcgctacaaagagctgaaagacatcattgctatcctaggtatggacgagctatctgaagaagataagcaagttgtatctcgtgcacgtaagattgagcgtttcctaactcagccttaccacgtagcagaagtatttacaggtgaccctggtatttacgtacctctaaaagagactctacgtggcttcaaaggtctactagctggtgaatacgacgacattcctgagcaggcattcatgtactgcggtagcatcgacgatgctattgagaatgcgaagaagctataa

SEQ ID NO: 7313 - protein, 467 aa, Vibrio alginolyticus
MATGKIVQIIGAVVDVEFPQSNVPSVYDALNVTDSKERLVLEVQQQLGGGVVRCIVMGSSDGLRRGVEVVNTGAPISVPVGTKTLGRIMNVLGDAIDERGEVGAEEVYSIHRSAPSYEEQSNEIALLETGVKVIDLICPFAKGGKIGLFGGAGVGKTVNMMELINNIALQHSGLSVFAGVGERTREGNDFYYEMQEAGVVNVEKPEESKVAMVYGQMNEPPGNRLRVALTGLTMAERFRDEGRDVLLFIDNIYRYTLAGTEVSALLGRMPSAVGYQPTLAEEMGVLQERITSTKSGSITSVQAVYVPADDLTDPSPATTFAHLDATVVLNRNIAAMGLYPAIDPLDSTSRMLDPLVVGQDHYEVARGVQQTLQRYKELKDIIAILGMDELSEEDKQVVSRARKIERFLTQPYHVAEVFTGDPGIYVPLKETLRGFKGLLAGEYDDIPEQAFMYCGSIDDAIENAKKL

SEQ ID NO: 7314 - DNA, 1404 bp, Vibrio cholerae
  CDS (1)..(1404): transl_table=11
atggctacaggtaagatcgtacagatcatcggtgcggtagtcgacgtagagttcccacagagcgaagtaccaagtgtttacgatgctctgaatgttgtggattccaaagaacgtctggttctggaagttcaacagcagctaggcggtggcgtgattcgcgctatcgttatgggtagctcggatggtttacgtcgtggaatgacagtacaaaacactggcgctccaatttcagtaccagtaggtactaaaaccctaggtcgtatcatgaacgtgcttggtgatgcgattgacgaacgtggcgacattggcgcagaagaggtgtactcgattcaccgtcctgctccaagctacgaagaacagtctagtgcaactgaacttttggaaacgggtgttaaggttatcgacctgatctgtccgtttgcgaaaggcggtaaaatcggtctgttcggtggtgcgggtgtaggtaagaccgttaacatgatggaacttatcaacaacatcgcgctacagcactcaggtttgtcagtatttgctggggtaggtgagcgtactcgtgagggtaacgacttctaccacgaaatgcaggaagcgggcgttgtaaacgttgaacaaccagaactgtcgaaagtagcgatggtttacggtcagatgaacgagccaccaggcaaccgtctgcgtgtagcactgactggtctgactatggcggaaaagttccgtgatgaaggccgtgacgtactgctgtttatcgacaacatctaccgttacaccctagcgggaacggaagtatctgctctgcttggccgtatgccttcagcggtaggttaccagccaacactggctgaagagatgggtgttctgcaagaacgtatcacgtcaaccaagaaaggttctatcacctctgtacaagcggtatacgtacctgcggatgacttgactgacccatcaccagcaaccacgtttgctcacttggatgcaaccgttgttctgaaccgtaacatcgccgctatgggtctatacccagcgatcgacccactggattcgacttcacgtcaattggatccactggttgttggtcaagagcactacgatgtggcgcgtggcgtgcaagcaacgctacaacgctataaagagctgaaagatatcatcgcgattctaggtatggacgaactgtctgaagcggacaagcaagtcgttgctcgtgcgcgtaagatcgaacgtttcctgactcagccttaccacgtagcagaagtctttactggcgatccaggggtatacgtacctctgaaagaaaccctgcgtggtttcaaaggtctgctggcaggtgactacgatgacattccagagcaagcgtttatgtactgcggtacgattgacgatgctatcgagaatgcgaagaagctataa

SEQ ID NO: 7315 - protein, 467 aa, Vibrio cholerae
MATGKIVQIIGAVVDVEFPQSEVPSVYDALNVVDSKERLVLEVQQQLGGGVIRAIVMGSSDGLRRGMTVQNTGAPISVPVGTKTLGRIMNVLGDAIDERGDIGAEEVYSIHRPAPSYEEQSSATELLETGVKVIDLICPFAKGGKIGLFGGAGVGKTVNMMELINNIALQHSGLSVFAGVGERTREGNDFYHEMQEAGVVNVEQPELSKVAMVYGQMNEPPGNRLRVALTGLTMAEKFRDEGRDVLLFIDNIYRYTLAGTEVSALLGRMPSAVGYQPTLAEEMGVLQERITSTKKGSITSVQAVYVPADDLTDPSPATTFAHLDATVVLNRNIAAMGLYPAIDPLDSTSRQLDPLVVGQEHYDVARGVQATLQRYKELKDIIAILGMDELSEADKQVVARARKIERFLTQPYHVAEVFTGDPGVYVPLKETLRGFKGLLAGDYDDIPEQAFMYCGTIDDAIENAKKL

SEQ ID NO: 7316 - DNA, 1404 bp, Vibrio parahaemolyticus
  CDS (1)..(1404): transl_table=11
atggctacaggtaagatcgtacagatcatcggtgcggtagtcgacgtagagttcccacagagcgaagtacctagtgtatatgacgctctaaacgtaacggactcaaaagagcgtctagttcttgaagttcaacaacagctaggcggtggcgtagttcgttgtatcgtaatgggtagctctgatggtttacgtcgtggagttgaagtggttaacactggcgctccaatttcagtaccagtaggtactaaaactctaggtcgtatcatgaacgtcctaggtgacgcgattgatgagcgtggtgagatcggtgcagaagaggtttactctatccaccgtgaagcaccaagctacgaagagcaatcaaacgaaacagcacttctagaaactggtgttaaagtaatcgacttggtttgtccattcgctaagggtggtaaaatcggtctattcggtggtgcaggtgtaggtaagaccgttaacatgatggaacttatcaacaacatcgcacttcaacactcaggtctatcagtatttgctggtgttggtgaacgtactcgtgaaggtaacgatttctacttcgagatgcaggaagcgggcgttgtaaacgttgagaatcctgaagaatctaaagtagcgatggtttacggtcagatgaacgagccaccgggcaaccgtctacgtgttgctctgactggtctaacaatggcagagcgtttccgtgacgaaggtcgtgacgtactactgttcgttgataacatctaccgttacacgcttgcaggtactgaggtatcagcacttctaggtcgtatgccttcagcggtaggttaccagccaactcttgcagaagagatgggtgtactacaggagcgtatcacgtcaactaagcaaggttctatcacgtctgtacaggcggtatacgtacctgcggatgacttgactgacccgtctccagcaacaacattcgcgcacttggatgcaacggttgtacttaaccgtaacatcgcagcaatgggtctatacccagcgatcgacccactagattctacgtctcgtcagctagacccactagttgttggtcaagatcactacgacatcgctcgtggcgttcagcagacacttcagcgctacaaagagctgaaagacatcattgcgattctaggtatggacgagctatctgagtcagataagcaagttgtatctcgtgcacgtaagattgagcgtttcctaactcagccttaccacgtagcggaagtatttacaggcgaccctggtgtttacgtacctcttaaagagactctacgtggcttcaaaggtctactagctggtgaatacgatgacattccagagcaagcgttcatgtactgcggtacgattgacgatgctatcgagaatgcgaagaagctataa

SEQ ID NO: 7317 - protein, 467 aa, Vibrio parahaemolyticus
MATGKIVQIIGAVVDVEFPQSEVPSVYDALNVTDSKERLVLEVQQQLGGGVVRCIVMGSSDGLRRGVEVVNTGAPISVPVGTKTLGRIMNVLGDAIDERGEIGAEEVYSIHREAPSYEEQSNETALLETGVKVIDLVCPFAKGGKIGLFGGAGVGKTVNMMELINNIALQHSGLSVFAGVGERTREGNDFYFEMQEAGVVNVENPEESKVAMVYGQMNEPPGNRLRVALTGLTMAERFRDEGRDVLLFVDNIYRYTLAGTEVSALLGRMPSAVGYQPTLAEEMGVLQERITSTKQGSITSVQAVYVPADDLTDPSPATTFAHLDATVVLNRNIAAMGLYPAIDPLDSTSRQLDPLVVGQDHYDIARGVQQTLQRYKELKDIIAILGMDELSESDKQVVSRARKIERFLTQPYHVAEVFTGDPGVYVPLKETLRGFKGLLAGEYDDIPEQAFMYCGTIDDAIENAKKL

SEQ ID NO: 7318 - DNA, 1497 bp, Vitis vinifera
  CDS (1)..(1497)
atgagaataaatcctactacttctggtcctggggtttccacgcttgaaaaaaaaaacctggggcgtatcgctcaaatcattggtccggtcctggatgtagcttttcccccgggcaagatgcctaatatttacaatgcgctggtagttaagggtcgagatactgtcggtcaacaaattaatgtgacttgtgaggtacagcaattattaggaaataatcgagttagagctgtggctatgagtgctacagatggtctaatgagaggaatggaagtgattgacacgggagctcctctaagtgttccagtcggtggagcgactctcggacgaattttcaacgtgcttggagagcctgttgataatttaggtcctgtagatactcgcacaacatctcctattcatagatctgcgcccgcctttatacagttagatacaaaattatccatttttgaaacaggaattaaagtagtggatcttttagctccttatcgccgtggaggaaaaattggactattcgggggagctggagtgggtaaaacagtactcattatggaattgatcaacaacattgccaaagctcatgggggtgtatctgtatttggcggagtaggtgaacgtactcgtgaaggaaatgatctttacatggaaatgaaagaatctggagtgattaatgaaaaaaatatttcagaatcaaaagtggctctagtctacggtcagatgaatgaaccgccgggagctcgtatgagagttggtttgactgccctaactatggcggaatatttccgagatgttaatgaacaagacgtacttctatttatcgacaatatcttccgtttcgtccaagcaggatccgaagtatctgccttattgggcagaatgccttccgctgtgggttatcaacctacccttagtaccgaaatgggtactttacaagaaagaattacttctaccaaggaggggtccataacttctattcaagcagtttatgtacctgcggacgatttgaccgaccctgcccctgccacaacatttgcacatttagatgctactaccgtactatcaagaggattagctgccaaaggtatctatccagcagtagatcctttagattcaacgtcaactatgctccaacctcgtatcgttggtgaggaacattatgaaactgcgcaaagagttaagcaaactttacaacgttacaaagaacttcaagacattatagctatccttgggttggacgaattatccgaagaggatcgtttaaccgtagcaagagcacgaaaaattgagcgtttcttatcacaaccctttttcgtagcagaagtatttaccggttctccagggaaatatgttggtctagcagaaacaattagagggtttcaattgatcctttccggagaattagatggtcttcccgaacaggccttttatttggtaggtaacatcgatgaagctaccgcgaaggctatgaacttagaaatggagagcaaattgaagaaatga

SEQ ID NO: 7319 - protein, 498 aa, Vitis vinifera
MRINPTTSGPGVSTLEKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNISESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESKLKK

SEQ ID NO: 7320 - DNA, 2861 bp, Triticum aestivum
  CDS (731)..(2227)
gaattctcacaataacagggtctactcgatgttaattaggcgtaaatgaaactttagcaaaaatctcgtaaaacaaaaaggatattcaattaatataatatcaactcattaaagaaaattgagggcatgcttaggttaatgaatatgtttcattcatatataatgcgtacaccctgtgtatgttctatcctataggaattcgagttgttgttatggtaagttaacacggttcgttattaaaccatggatttgatttaccaaatccataattattgtatactctttgatagatatagcgcaacccaaattaattcctaatccttattttaaaagttcttaatagttctcttttcttattttgaatgcaaatacctaactaaatactaataaaattctttgttgacagcaatctatgcttcacagtagtatatattttgtatatcgaagtcctagataggaaagtagagtaggcacagatcctccacaaaaggcaaaatgtatatgaaaaaaagattgattgaactttccaacggactcattccatgagtaaacgattgaatgggattcgcttgggcaacgaaatcaagtcctggtccccttttctctcttattgaattaactaattcatttcctttttacttttggattttttttgatttgatttggcattattcaacaataaaaaaagaaaaatttcgacaaattccttttttttaattatgtgataattatgagaaccaatcctactacttctcctcccggggcttccacaattgaagaaaaaagtacaggtcgtatcgatcaaattattggacccgtgctggatgtcacttttcccccaggcaagttaccttatatttataacgctttggtagtccagagtagagacactgacgataagcaaattaatgtgacttgtgaggtacaacaattattaggaaataatcgagttagagctgtagctatgagtgctacggacgggttgatgagaggaatggaagtgattgacacgggagctcctctcagtgttccggtcggtggagctactcttggacgaattttcaacgttcttggggagcctgttgacaatttgggtcctgtagatagtagtgcaacgttccctattcatagatctgcgcctgcctttatcgagttagatacgaaattatccatctttgaaacaggtattaaggtcgtcgatcttttagctccttatcgacgtggaggaaaaataggactatttgggggggctggagtaggtaaaacagtactgatcatggaattaatcaataacattgctaaagctcatgggggcgtatccgtattcggtggagtaggggaacggactcgtgaaggaaatgatctttatatggaaatgaaggaatccggagtaattaatgaaaaaaatattgaggaatcaaaggtagctctagtctatggccaaatgaatgaaccaccgggagctcgtatgagagttggtttaactgccctaactatggcggaatatttccgagatgttaataagcaagacgtgcttttatttatcgataatatctttcgttttgttcaagcaggatcagaggtatccgctttattagggagaatgccctccgcagtgggttatcaacctactcttagtacagaaatgggttctttgcaagaaagaattgcttctactaaaaagggatctataacttcgattcaagcagtttatgtacctgcagacgatttgaccgaccctgcccctgccacaacatttgcacatttggatgctactaccgtactttccagaggattagcttccaagggtatttatccagcagtagatcctttagattcaacctcgactatgttacagcctcggatcgttggcaacgaacattatgaaactgcgcaaagagttaaggaaactttacaacgttacaaagaacttcaggacattattgcaattcttggcttggatgaattatcggaagaggatcgtttaactgtagcaagagcaagaaaaattgagcgtttcttatcacaaccgttctttgtggcagaagtttttactggttctccaggaaagtatgttgctcttgcggaaactattaggggatttcaactaatcctttccggagaattagacggcctacctgaacaggctttttatttggtgggtaacatcgatgaagctagcacgaaagctataaccttagaagaggagaacaaatcgcagaaatgaaattaaatctttatgtactgactcctaagcgaattatttgggattgtgaggtgaaagaaatcattttatccactaatagtggccaaattggcgtattaccaaaccacgcccccattaacacagcagtagatatgggtcctttgagaatacgcctcctcaacgaccaatggttaacagcggttctgtggagcggttttgcgagaatagttaataatgagatcatcattttaggaaatgatgcggaacttggtagtgatattgatccggaagaagctcaaaaggcacttgaaatagccgaagctaacttgagtaaagctgagggtacgaaagatttggttgaagcgaagctcgctctcagacgagctaggatacgaatcgaggctgtcaattggattcccccatccaattgaagacaatccagtggtttatagttgatacaaagaaaaagggaagaggggtagaaaaagttattagatagcgaagcgaagtaagtccaatgctatctagtaatttttctacctacttacctactattggatttgaaccaatgactcccgccgtatgaaagcaatactctaaccactgagttaagtaggcaatttatcaccacaaaggaagacccattacttcgatc

SEQ ID NO: 7321 - protein, 498 aa, Triticum aestivum
MRTNPTTSPPGASTIEEKSTGRIDQIIGPVLDVTFPPGKLPYIYNALVVQSRDTDDKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVALAETIRGFQLILSGELDGLPEQAFYLVGNIDEASTKAITLEEENKSQK

SEQ ID NO: 7322 - DNA, 1389 bp, Wigglesworthia glossinidia brevipalpis
  CDS (1)..(1389): transl_table=11
atggatactgggaaaatagtccaaattattggacctgtaatagatgtaaaatttgaaatatctttcattccaaaaataaattttgctcttgagataaaaataaaaaacaaaaaattaatcatggaagtaatgcaacaaataggagatgggatagtacgatgtattttgatgggatcctccgatggattaaaaagaggattaaaagtttttaatttaaataaaggaatagaagttcctgtaggaaaacctactcttggaagaataatgaatgtattaggagatcctatagatagaaaaggaaaaattttatcaagtgaatacagaccaattcataataaatctccaagttataacgaaatttctagctcagatgaactacttgaaactggaattaaaataatagatttaatttgtcctttcgcaaaaggaggaaaaataggattgtttggaggagctggagttggaaaaactgttaatatgatggaattaattagaaatatagctattgaacattcaggatattctgttttttctggggttggagaaagaactagagaaggaaatgatttttataatgaaatgatatcctccaatgtaatagataaagtatctttagtttatggtcaaatgaacgaaccaccaggaaatagattaagagtagcactaacaggattgacattagctgaaaaattcagagatgaaggaaatgatgtattattttttgttgataatatttatagatatactttagctggaacagaagtatctgctcttctaggaagaattccttctgcagtgggttatcagcctactctttctgaagaaatgggtattttacaagaaagaattacttccaccaagtctggatcaattacttctgtacaagctatttatgttccagctgatgatcttacagatccttctccagcaactacttttgttcatttagatgcaactgtagtgttaagtcgtcaaattgcttctttagggatttatcctgctattgatcctttagattctactagtagacaattagatccattaatagtaggagaagatcattatttagtagctagaaaaatacaatcaatattacaacgctacaaagatttaaaagatattatagctattttaggaatagatgaattatcagaagaagataaaattttagtatctagagctcgtaaaattcaacgttttttatctcaacctttttttgtagcagaaatttttactggattttcaggcaaatatgttactttaaaggatactattgatggatttaatagcattataaatggagaatatgattatataccagaacaagcattttatatgacaggaaatatttcagatgttttagataaatataaaaaattttattcttaa

SEQ ID NO: 7323 - protein, 462 aa, Wigglesworthia glossinidia brevipalpis
MDTGKIVQIIGPVIDVKFEISFIPKINFALEIKIKNKKLIMEVMQQIGDGIVRCILMGSSDGLKRGLKVFNLNKGIEVPVGKPTLGRIMNVLGDPIDRKGKILSSEYRPIHNKSPSYNEISSSDELLETGIKIIDLICPFAKGGKIGLFGGAGVGKTVNMMELIRNIAIEHSGYSVFSGVGERTREGNDFYNEMISSNVIDKVSLVYGQMNEPPGNRLRVALTGLTLAEKFRDEGNDVLFFVDNIYRYTLAGTEVSALLGRIPSAVGYQPTLSEEMGILQERITSTKSGSITSVQAIYVPADDLTDPSPATTFVHLDATVVLSRQIASLGIYPAIDPLDSTSRQLDPLIVGEDHYLVARKIQSILQRYKDLKDIIAILGIDELSEEDKILVSRARKIQRFLSQPFFVAEIFTGFSGKYVTLKDTIDGFNSIINGEYDYIPEQAFYMTGNISDVLDKYKKFYS

SEQ ID NO: 7324 - DNA, 1428 bp, Wolbachia pipientis wMel
  CDS (1)..(1428): transl_table=11
atgaatataggtagagcgattaaggtaactcaagcagttgttgatataaaatttgaaggtgaattgcctaaaatatttaatgctttaaaaagcaaactaaaatataaggataaggagctggttttagaagtttcgcagcatataggtgacaatatagttcgttgtattgctatggatagcacagatggcatgtcaaggggggatgaatttgttgatacaggtgcaccaatatcggtgccaattgggcgttcaactttaggaaggatttttaatgttgttggagagcttatagatgagtgtggtccactgaagggaaagtataacttagagcctatacacagagcacctccaagttttactgaacagagaatacaggaagaagttttagttacgggaataaaagttatagatcttcttgcaccttatcttaaaggaggaaaaattggcttatttggtggagccggtgttggtaaaacagtcctaataatggaattaattaataatatagcaaaagctcataaaggattttctgtgtttgccggggtaggggagagaacgcgtgaaggtaacgatctttatcacgagatgatcacttcaaatgtaataaatataaatgagcatgaaaaatctcaagctgttttggtttatggtcagatgaatgagcctcctggagcaagggctagagttgctttaacagcacttactatggcagagtattttcgtgaccgtgaaaaccaagatgttctattttttgtggataatatctttagatttacacaagctggttctgaaatttctgctttacttggaagaataccgtcagctgttggttatcagccaacccttgcaactgatatgggtgcaatgcaagaaagaatagcttcaacaacttctggctctattacttctgtgcaagctatatatgttcctgcggacgatttgactgatccagccccagcaactacattctctcaccttgatgcaaccacagtgttgtcaaggcaaatagctgaaatgggaatataccctgctgttgatccacttgattcaacttctcagtctttatctgctgaaatcattggtgaagaacattataatgtagcttctgaggtgaaacgtatattgcaaacttataaatcactgcaagatattatcgcaatacttggtatggatgagctatctgatgaagataaaattattgttgatagggctcggaagattcagaaatttctttctcaaccttttcacgttgcagaaatatttactggcatgcctggtaaatttgtttcactttctgatactgtttccagttttaaagggattgttgaaggcaaatatgatcacttaccagaggctgctttttatatggtggggaatatagatgaagcaataaaaaaggctgaattaatacaagctgaagctaaataa

SEQ ID NO: 7325 - protein, 475 aa, Wolbachia pipientis wMel
MNIGRAIKVTQAVVDIKFEGELPKIFNALKSKLKYKDKELVLEVSQHIGDNIVRCIAMDSTDGMSRGDEFVDTGAPISVPIGRSTLGRIFNVVGELIDECGPLKGKYNLEPIHRAPPSFTEQRIQEEVLVTGIKVIDLLAPYLKGGKIGLFGGAGVGKTVLIMELINNIAKAHKGFSVFAGVGERTREGNDLYHEMITSNVININEHEKSQAVLVYGQMNEPPGARARVALTALTMAEYFRDRENQDVLFFVDNIFRFTQAGSEISALLGRIPSAVGYQPTLATDMGAMQERIASTTSGSITSVQAIYVPADDLTDPAPATTFSHLDATTVLSRQIAEMGIYPAVDPLDSTSQSLSAEIIGEEHYNVASEVKRILQTYKSLQDIIAILGMDELSDEDKIIVDRARKIQKFLSQPFHVAEIFTGMPGKFVSLSDTVSSFKGIVEGKYDHLPEAAFYMVGNIDEAIKKAELIQAEAK

SEQ ID NO: 7326 - DNA, 1404 bp, Wolinella succinogenes
  CDS (1)..(1404): transl_table=11
atggaaggaagaataacccaggttatgggtcctgtcgttgatgtcgatttcgattcgtatcttcccgcgatcaatgaggcgctggatgtcaattacgatatcgaaggacatcccaagaagttggtgttggaagtggcggcacatattggtgatagccgtgtgagaaccatcgctatggatatgacagagggcttgacgcgaggaactaaagtggttgctcgaggaaaatccatcgaggttcccgtaggcgagcaggttcttggaagaatcttcaacgtagtgggcgatgtgattgatgggggcgatgagctcaaagagcctgtgaagtggtcgattcaccgaacagctcctacatttgaaaaccaaagcaccaaaacagagatgtttgaaacagggatcaaagtggttgaccttttggctccttactccaagggtggtaaagttggactctttgggggtgcgggcgttggcaagaccgttgttattatggaacttattcacaacgttgctttcaaacacagcggttactccgtatttgcgggtgtaggcgagcgaacccgtgaggggaatgacctctatcacgagatgaaagaatcgggtgttttggataaagttgccctatgctatggacagatgaacgagccccccggcgcaagaaaccgaatcgccttcacgggcttgactatggcggaatatttccgagatgagaagggattggatgttttgatgtttattgataacatcttccgatacgctcaatcaggggctgagatgtcagcgcttcttgggcgaattccttcagcggttggttatcagcctacattggctagcgagatgggcaagctccaagagcgaatcacctccaccaaaaagggatctatcacctctgttcaagcggtttatgttcccgcggatgaccttacagaccctgcgcctgcatcggtgtttgcccaccttgatgcaactacggttttgaaccgaaagatcgctgagaaaggaatctaccctgcggttgaccctcttgattcaacctcaagaatccttgatcctcaagtagttggtgaagatcactacaagaccgccacaggcgttcagcaagtgcttcaaaaatacaaagacctccaagatatcatcgcgattcttggtatggatgagctttctgaagaggataagcgagtggttgagcgagcacgaagaattgagaaattcctctctcaacccttcttcgttgcggaagtgttcactggaagccctggcaaatatgtgacgcttcaagagaccctagagggcttcaaaggaatcttggaaggcaagtatgaccagattcctgagaacgctttctatatggtgggtggaatcgacgaagtcttggagaaggccgagcggctcaaagctaacgcttaa

SEQ ID NO: 7327 - protein, 467 aa, Wolinella succinogenes
MEGRITQVMGPVVDVDFDSYLPAINEALDVNYDIEGHPKKLVLEVAAHIGDSRVRTIAMDMTEGLTRGTKVVARGKSIEVPVGEQVLGRIFNVVGDVIDGGDELKEPVKWSIHRTAPTFENQSTKTEMFETGIKVVDLLAPYSKGGKVGLFGGAGVGKTVVIMELIHNVAFKHSGYSVFAGVGERTREGNDLYHEMKESGVLDKVALCYGQMNEPPGARNRIAFTGLTMAEYFRDEKGLDVLMFIDNIFRYAQSGAEMSALLGRIPSAVGYQPTLASEMGKLQERITSTKKGSITSVQAVYVPADDLTDPAPASVFAHLDATTVLNRKIAEKGIYPAVDPLDSTSRILDPQVVGEDHYKTATGVQQVLQKYKDLQDIIAILGMDELSEEDKRVVERARRIEKFLSQPFFVAEVFTGSPGKYVTLQETLEGFKGILEGKYDQIPENAFYMVGGIDEVLEKAERLKANA

SEQ ID NO: 7328 - DNA, 1401 bp, Xylella fastidiosa
  CDS (1)..(1401): transl_table=11
atgaatcagggtaagatcgttcagatcatcggcgcaattgtcgacgtcgaattcccacgaaacaatgtcccaaaagtatataacgcgctgaagatcgacggcacagccatcatcttggaagtgcagcaacagcttggcgacggcattgtacgcactatagcacttggctccacagacggtttaaaacgcaacctcattgccacggacaccggccatgcaatcacagttcccgtaggcactggcacattaggccgcatcatggatgtactaggcaacccaatcgacgaagcaggtccgatcacttatacagatcaatgggaaatccatcgaaacgctccttcctatgaagatcaagcctcaaccactgaactgctggagaccggaatcaaggtcatcgatcttatgtgtccatttgctaaaggcggcaaagtcggattattcggtggtgccggtgtcggcaaaactgtcaacatgatggaattgatcaataacatcgccaaggcacatagtgggctgtccgtattcgcgggtgttggcgagcgaacccgcgaaggtaacgacttctatcacgagatgaaagactccaacgttctcgacaaggtagcaatggtgtatggccagatgaacgaaccgccgggtaaccgtctgcgcgttgcgctcaccggtctcaccatggccgagtacttccgcgatgagaaagacagtagcggcaaaggcaaagatgtacttctattcatcgacaatatctaccgctacaccttagctggcacggaagtatccgccctactcggtcgcatgccctcagcagtaggctaccaaccaacccttgccgaggaaatgggcgtactacaagagcgtatcacctcaaccgcaaatggctcgatcacctcgatccaagcagtgtacgtacccgccgatgatctgactgacccatcacctgcgacgacctttggacatctggactccacagtgacactatcccgctcgatcgccgcattaggcatttacccagcagtggatccactggattcgagcagtcgccagatggatccgctgatcatcggcgaagaacactacaataccacccaacgtgtccaacaaactctgcaaaaatataaagatctgaaggacatcattgcaattttaggcatggatgaactttccgaggacgacaaactagccgtgtcacgtgcacgcaaaatagaacgatttttcagtcaaccattccatgtcgcagaagtattcaccggtgccccaggtaaatacgtcccattaaaagagacaatccgtggtttcaaagcaatcgtagacggcgaatatgaccatcttcccgaacaagccttctatatggttggtaacattgaagaagtcatcgaaaaagccaacaaaatgacagcatga

SEQ ID NO: 7329 - protein, 466 aa, Xylella fastidiosa
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLAVSRARKIERFFSQPFHVAEVFTGAPGKYVPLKETIRGFKAIVDGEYDHLPEQAFYMVGNIEEVIEKANKMTA

SEQ ID NO: 7330 - DNA, 1401 bp, Xylella fastidiosa
  CDS (1)..(1401): transl_table=11
atgaatcagggtaagatcgttcagatcatcggcgcaattgtcgacgtcgaattcccacgaaacaatgtccccaaagtatataacgcgctgaagatcgacggcacagccatcatcttggaagtgcagcaacagcttggcgatggcattgtacgcaccatagcacttggctccacagacggcttaaaacgcaacctcattgccaccgacaccggccatgcaatcacagttcccgtaggcactggcacattaggtcgcatcatggatgtactaggcaacccaatcgacgaagcaggtccgatcacttatacagatcaatgggaaatccatcgaaacgctccttcctatgaagatcaagcctcaaccaccgaactgctggagaccggaatcaaggtcatcgaccttatgtgtccatttgctaaaggcggcaaagtcggattattcggtggtgccggtgtcggcaaaactgtcaacatgatggaattgatcaataacatcgccaaggcacatagtgggctgtccgtattcgcgggtgttggcgagcgaacccgcgaaggtaacgacttctatcacgagatgaaagactccaacgttctcgacaaggtagcaatggtatatgggcagatgaacgaaccaccgggtaaccgtctgcgcgttgcgctcaccggtctcaccatggccgagtacttccgcgatgagaaagacagtagcggcaaaggcaaagatgtacttctattcatcgacaatatctaccgctacaccttagctggcacggaagtatccgccctactcggtcgcatgccctcagcagtaggctaccaaccaacccttgccgaggaaatgggcgtactacaagagcgtatcacctcaaccgcaaatggctcgatcacctcgatccaagcagtgtacgtacccgccgatgatctgactgacccatcacctgcgacgacctttggacatctggactccacagtgacactatcccgctcgatcgccgcattaggcatttacccagcagtggatccactggattcgagcagtcgccagatggatccgctgatcatcggcgaagaacactacaataccacccaacgtgtccaacaaactctgcaaaaatataaagatctgaaggacatcattgcaatcttaggcatggatgaactttccgaggacgacaaactatccgtgtcacgtgcacgcaaaattgaacgatttttcagtcaaccattccatgtcgcagaagtattcactggtgccccaggtaaatacgtcccattaaaagacacaatccgtggtttcaaagcaatcgtagacggcgaatatgaccatcttcccgaacaagccttctatatggtcggtaacattgaagaagtcatcgaaaaagccaacaaaatgacagcatga

SEQ ID NO: 7331 - protein, 466 aa, Xylella fastidiosa
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLSVSRARKIERFFSQPFHVAEVFTGAPGKYVPLKDTIRGFKAIVDGEYDHLPEQAFYMVGNIEEVIEKANKMTA

SEQ ID NO: 7332 - DNA, 1455 bp, Zymomonas mobilis
  CDS (1)..(1455): transl_table=11
atggctactgcctctagtaaaaagaatattggccggataagccaggtcattggtccggtcgtcgacgtgctttttgaagagaaacttcctcctcttcttacggctcttgaaaccaaaaaccaggatgctacggttgttctggaagtagcccagcatttgggtgaaaatgtcgttcgcaccatttctatggatacgaccgacggtttggttcgtggtcaggaagtcgttgataccggtagtgaaatccgcgttccggttggccctgaaacactcggccgtatcatgaacgtcgttggtcgtcctgttgatgaacggggtcccatcggcagcaaacagaccatgccaattcatgctgatgctccgcctttcacggaacagagcacggataccgctattctgacgacgggtattaaggttatcgatcttctggccccttactccaaaggtggtaaggtcggattgttcggtggtgccggtgttggtaagaccgtgttgattcaggaactgatcaacaatatcgctaaaggccatggtggtttctcggtgttcgccggcgttggtgagcgcacccgtgaaggtaacgatctttaccatgaattccttgaagctggcgttattgctagcgacaaagatggtaatgcgatttctgaaggttccaaagtggccttggtctatggccagatgaacgaaccgccgggagcccgtgctcgtgttgctctttctggtctgacgatggcggaatatttccgtgatcaagaaggtcaagacgtgttgttcttcgtggataacatcttccgcttcacgcaggctggtgcagaggtttccgctctgttgggtcgtattccttctgccgtgggttatcagccaactttggctactgacatgggtcagttgcaggaacgtattacttctaccaagaagggttccattacctcggttcaggccatctatgttccggccgacgatttgaccgatcctgcacctgccgccagttttgcccatttggatgcgactaccgtgttgagccgtgcgatctcggaaatgggtatttatcccgccgtcgatccgcttgactcttccagccgtaaccttgaaccacgcatcgttggtgatgagcattaccagacggctcgtgatgtgcaggaaattttgcagcgttataaaaacctgcaggatatcattgccattttgggtatggacgaattgtcggaagacgatcgcaaggtcgttggtcgtgctcgtcgtattcagcgcttcctgtcacagcctttccatgtggctgaagtctttacgggtatgcctggtaaatttgttcaggttgaagatacggttcgttccttccgtgaaatcattgatggtaaatatgatgatttgcctgaaaatgctttctacatggtcggctctatcgatgaagctgtcgctaaagctgaaaaaatggccgcagaagcagcctag

SEQ ID NO: 7333 - protein, 484 aa, Zymomonas mobilis
MATASSKKNIGRISQVIGPVVDVLFEEKLPPLLTALETKNQDATVVLEVAQHLGENVVRTISMDTTDGLVRGQEVVDTGSEIRVPVGPETLGRIMNVVGRPVDERGPIGSKQTMPIHADAPPFTEQSTDTAILTTGIKVIDLLAPYSKGGKVGLFGGAGVGKTVLIQELINNIAKGHGGFSVFAGVGERTREGNDLYHEFLEAGVIASDKDGNAISEGSKVALVYGQMNEPPGARARVALSGLTMAEYFRDQEGQDVLFFVDNIFRFTQAGAEVSALLGRIPSAVGYQPTLATDMGQLQERITSTKKGSITSVQAIYVPADDLTDPAPAASFAHLDATTVLSRAISEMGIYPAVDPLDSSSRNLEPRIVGDEHYQTARDVQEILQRYKNLQDIIAILGMDELSEDDRKVVGRARRIQRFLSQPFHVAEVFTGMPGKFVQVEDTVRSFREIIDGKYDDLPENAFYMVGSIDEAVAKAEKMAAEAA

SEQ ID NO: 7334 - DNA, 1671 bp, Oryza sativa
  CDS (1)..(1671)
atgagaaccaatcctactacttctcatcccggggtttctacaattgaagaaaaaagtacagggcgtatcgatcaaattattggacccgtgctggatgtcacttttcccccaggcaagttaccttatatttataatgctttggtagtcaagagtcgagacactgacggtaagcaaattaatgtaacttgtgaggaacaacaattattaggaaataatcgagttagagttgtagctatgagtgctacagatgggttgatgagaggaatggaagtgattgacacaggagctcctctcagtgttcctgtcggtggagctactcttggacgaattttcaacgttcttggggagcctgttgacaatttgggtcctgtagatactagtgcaacattccctattcatagatccgcgcccgcttttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtatttaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggagatatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctcctacaacatttgcacatttggatgctactaccgtactttccagaggattagcttccaaagggatttatcctgcagtagatcctttagattcaacctcaactatgttacaacctcggatcgttggcaacgaacattatgaaactgtgcaaagagttaagcaaactttacaacgttacaaagaacttcaggacattatcgcaattcttgggttggatgaattatcggaggaggatcgtttaactgtagcaagagcacgaaaaattgagcgcttcttatcacaaccgttttttgtggcagaagtttttaccggttctccgagaaatggccaaattggcgtattaccaaaccacgcccccattaacacagctgtagatatgggtcccttgagaatacgcctcctcaacgatcaatggttaatggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattga

SEQ ID NO: 7335 - protein, 556 aa, Oryza sativa
MRTNPTTSHPGVSTIEEKSTGRIDQIIGPVLDVTFPPGKLPYIYNALVVKSRDTDGKQINVTCEEQQLLGNNRVRVVAMSATDGLMRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVFNEKNLEESKVALVYGQMNEPPGARMRVGLTALTMAEYFRDVNKQDVLLFIDNIFRFVQAGSEISALLGRMPSAVGYQPTLSTEMGSLQERITSTKKGSITSIQAVYVPADDLTDPAPPTTFAHLDATTVLSRGLASKGIYPAVDPLDSTSTMLQPRIVGNEHYETVQRVKQTLQRYKELQDIIAILGLDELSEEDRLTVARARKIERFLSQPFFVAEVFTGSPRNGQIGVLPNHAPINTAVDMGPLRIRLLNDQWLMAVLWSGFARIVNNEIIILGNDAELGSDIDPEEAQQALEIAEANVSRAEGTKELVEAKVALRRARIRVEAVNWIPPSN

SEQ ID NO: 7336 - DNA, 1662 bp, Zea mays
  CDS (1)..(1662)
atggcgtcccgccgggtcgtctcctcgctcctccgctccgcgtcccgcctgcgggccgcctcgcccgctgctccacgaccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgcatcataaatgttattggtgaaccgattgatgagaagggtgacataaagacaaaccacttcctccctattcatcgtgaagcccctgcttttgttgagcaggccactgagcagcaaattcttgttactggaatcaaggtcgtggatcttcttgcaccctaccaaaggggtggaaagattggtctcttcggtggtgcaggagtgggtaaaactgtgctcattatggagttgatcaacaatgttgctaaggcccatggtggtttctctgtgtttgctggtgttggagaacgtacccgtgaaggtaatgatctgtacagggaaatgattgaaagtggtgtcattaagctagatgacaagcagagcgaaagcaagtgtgctcttgtttacgggcagatgaatgagcccccgggtgctcgtgctcgtgttgggttgactggtttgactgttgctgaacatttccgtgatgctgaaggacaagatgtgcttctgtttattgacaacattttccgttttactcaggcaaactctgaggtgtctgctcttcttggacgtatcccatctgctgtgggataccagccaacccttgccactgatcttggaggactgcaagagcgtattacgacaacaaagaagggttctattacatctgtgcaggccatctacgtgcctgccgatgacttgacggatcctgctcctgctactacctttgcccatcttgatgctacaactgtgttgtcacgacagatctctgagcttggtatttatcctgctgttgatccactggattccacatcaagaatgctttctccccacgtgctgggtgaggatcactacaacactgctcgtggtgtgcagaaggttcttcagaactacaaaaatcttcaggatattattgctatcttgggtatggatgagctcagtgagcatgacaagctgacagtcgcccgtgcaagaaagattcagcgtttcctgagccagcctttccatgtcgctgaagttttcacgggtgctccaggaaagtatgtggagctgaaggaaagcgtgaagagtttccagggtgttttggatgggaagtatgatgacctccctgagcagtcattctacatggttggtggcattgaggaagtcattgctaaggctgagaaaattgccaaggagtctgcttcataa

SEQ ID NO: 7337 - protein, 553 aa, Zea mays
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDEKGDIKTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEHDKLTVARARKIQRFLSQPFHVAEVFTGAPGKYVELKESVKSFQGVLDGKYDDLPEQSFYMVGGIEEVIAKAEKIAKESAS

SEQ ID NO: 7338 - DNA, 1662 bp, Zea mays
  CDS (1)..(1662)
atggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgcatcataaatgttattggtgaaccgattgatgagaagggtgacataaagacaaaccactccctccctattcatcgtgaagcccctgcctttgttgagcaggccactgagcagcaaattcttgttactggaatcaaggtcgtggatcttcttgcaccctaccaaaggggtggaaagattggcctcttcggtggtgcaggagtgggtaaaactgtgctcatcatggagttgatcaacaatgttgctaaggcccatggtggtttctctgtgtttgctggtgttggagaacgtacccgtgaaggtaatgatctgtacagggaaatgattgaaagtggtgtcattaagctagatgacaagcagagcgaaagcaagtgtgctcttgtttacgggcagatgaatgagcccccgggtgctcgtgctcgtgttgggttgactggtttgactgttgctgaacatttccgtgatgctgaaggacaagatgtgcttctgtttattgacaacattttccgttttactcaggcaaactctgaggtgtctgctcttcttggacgtatcccatctgctgtgggataccagccaacccttgccactgatcttggaggactgcaagagcgtattacgacaacaaagaagggttctattacatctgtgcaggccatctacgtgcctgccgatgacttgacggatcctgctcctgctactacctttgcccatcttgatgctacaactgtgttgtcacgacagatctctgagcttggtatttatcctgctgttgatccactggattccacatcaagaatgctttctccccacgtgctgggtgaggatcactacaacactgctcgtggtgtgcagaaggttcttcagaactacaaaaatcttcaggatattattgctatcttgggtatggatgagctcagtgaggatgacaagctgacagtcgcccgtgcaagaaagattcagcgtttcctgagccagcctttccatgtcgctgaagttttcacgggtgctccaggaaagtatgtggagctgaaggaaagcgtgaagagtttccagggtgttttggatgggaagtatgatgacctccctgagcagtcattctacatggttggtggcattgaggaagtcattgctaaggctgagaaaattgccaaggagtctgcttcataa

SEQ ID NO: 7339 - protein, 553 aa, Zea mays
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDEKGDIKTNHSLPIHREAPAFVEQATEQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 7340 - DNA, 1497 bp, Brassica napus
  CDS (1)..(1497)
atgagaataaatcctactacttcggatccagcggtttcaatacgtgaaaaaaacaacctgggacgtattgcccaaatcattggtccggtactggatgtagcctttcccccgggcaagatgcctaatatttacaatgctctggtggttaagggtcgagatacgcttggtcaagaaattaatgtgacttgtgaagtacagcaattattaggaaacaaccgagttagagctgtagctatgagcgcgaccgagggtttaaagagagggatggacgtggttgatatgggaaatcctctaagtgttccagtcggcggagcgactctaggacgaattttcaatgtacttggggaacctgttgataatttaggtcctgtcgatactctcacaacatctcctatccataaatccgcgcctgcttttatagacttagatacaaccttatctatttttgaaacaggaattaaagtagtagatcttttggccccttatcgtcgtgggggaaaaatcggactattcggtggggctggcgtgggtaaaacagtactaattatggaattgatcaacaacattgccaaagctcatggtggtgtatccgtatttggtggagtaggcgaacgaactcgtgaaggaaatgatctttacatggaaatgaaagaatctggagtcattaatgaactaaaccttgcggactccaaagtagccctagtctacggtcagatgaatgaaccgccgggagctcgtatgagagttggtctgactgccttaactatggcagaatatttccgagatgttaatgagcaagacgtacttctatttatcgacaatatcttccgttttgtacaagcaggatccgaggtatccgctttattgggtagaatgccttctgctgtgggttaccaacccacccttagtaccgaaatgggttctttacaagaaagaattacttctacgaaaaaagggtccataacctctattcaagcagtttatgtacctgcagacgatttgactgaccctgctcctgccaccacatttgcacatttagatgcgactaccgtactatcaagaggattagctgctaaaggtatctatccagcggtagatcctttagattcaacgtcaactatgctacaacctcgaatcgttggcgaggaacattatgaaactgcgcaacaagtaaagcaaactttacaacgttacaaggagcttcaggacattatagctatcctggggttggacgaattatccgaagaggatcgcttaaccgtcgcaagagcacgaaagattgagcgtttcttatcacaaccttttttcgtagcagaagtatttacaggttctccgggaaaatatgttgggctagcggaaacaattagagggtttaatttgatcctttccggagaatttgattctcttcctgaacaggccttttacttagtgggtaacatcgatgaagctactgcgaaggctacgaacttagaaatggagagtaaattgaagaaatga

SEQ ID NO: 7341 - protein, 498 aa, Brassica napus
MRINPTTSDPAVSIREKNNLGRIAQIIGPVLDVAFPPGKMPNIYNALVVKGRDTLGQEINVTCEVQQLLGNNRVRAVAMSATEGLKRGMDVVDMGNPLSVPVGGATLGRIFNVLGEPVDNLGPVDTLTTSPIHKSAPAFIDLDTTLSIFETGIKVVDLLAPYRRGGKIGLFGGAGVGKTVLIMELINNIAKAHGGVSVFGGVGERTREGNDLYMEMKESGVINELNLADSKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFNLILSGEFDSLPEQAFYLVGNIDEATAKATNLEMESKLKK

SEQ ID NO: 7342 - DNA, 1662 bp, Brassica napus
  CDS (1)..(1662)
atggcgtctcggagagtcttatcaactcttctccgttcatcttccgccagatctgctgccagattcgggagccgtaaccctcggcttccgtccccttcacctgctcgatgcgcttctccttttggtgacctcctcggacgcgtagccgaatattccacctcttcacctgctcctccatcgtctgctccagccaaggatgaggcgaagaagacgtatgattacggaggtaaaggagcgatcgggaaagtctgccaggtcatcggtgctatcgtcgatgtgagattcgaagatcaggaagggttgcctccgatcatgacgtcactcgaggtgcaggatcaccccacgaggctggtgctcgaggtgtcgcatcacttgggtcagaatgtggtcaggactattgctatggatggtactgaggggcttgttcgtggaagacgcgtgctcaacactggagctccgatcactgtacctgttggaagagcaacacttggacgtatcatgaatgttcttggagaacctattgatgagagaggcgaaattaagaccgaacactacttacctattcacagagatgctccggctttggttgatctagccactgggcaagagatccttgccactggtattaaggttgttgatctgcttgctccttaccaaagaggaggaaagattgggctctttggtggtgctggtgttgggaaaactgtgctcattatggaactgattaacaatgtcgccaaagctcatggtggtttctccgtgtttgctggtgtgggagaacgaacccgtgaaggcaatgacttgtacagagaaatgattgagagtggtgtcatcaagctaggcgagaagcagtctgagagcaaatgtgctcttgtgtatggacaaatgaacgagcccccgggtgcccgtgcccgtgttggacttactggtttgactgttgctgagtatttccgtgatgccgaaggccaagatgtgttgcttttcattgacaacattttccgtttcactcaggctaactctgaagtgtctgctttgcttggtcgtatcccatctgctgtgggttaccagccaactctggcttccgatctcggtgctcttcaagagcgaatcacaaccaccaagaaaggttccatcacctcagtccaagccatctatgtccctgctgacgatctgacagatcctgctccagccacaacttttgctcacttggatgccacaactgtgctctcgagacagatttccgagcttggtatctatcctgctgtggatcctctggattcaacatcccgtatgctctcgcctcacattctgggtgaggagcactacaacacggctcgtggtgtgcagaaagtgctacagaactacaagaacttgcaagatattattgccattttgggaatggatgagctaagtgaagatgacaagctgactgttgcccgtgcccgtaagatccagagattcttgagtcagccattccatgttgctgagatcttcacgggtgcccccggaaaatacgtcgaccttaaggaaaacatcaacagtttccagggtttgcttgatggtaagtatgatgatcttcctgaacaatcgttttacatggttggtggcatcgacgaggtggttgctaaagcagagaagatctccaaggaggcagcagcttaa

SEQ ID NO: 7343 - protein, 553 aa, Brassica napus
MASRRVLSTLLRSSSARSAARFGSRNPRLPSPSPARCASPFGDLLGRVAEYSTSSPAPPSSAPAKDEAKKTYDYGGKGAIGKVCQVIGAIVDVRFEDQEGLPPIMTSLEVQDHPTRLVLEVSHHLGQNVVRTIAMDGTEGLVRGRRVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLPEQSFYMVGGIDEVVAKAEKISKEAAA

SEQ ID NO: 7344 - DNA, 1668 bp, Brassica napus
  CDS (1)..(1668)
atggcgtctcggagagtcttatcaacgcttctccgctcgtcttcctccagatccgccgccagattcgctacccgaaaccctagaatcccgtccccttcccccgctcgatgcgcttctcctttcggtgacctcctcggacgcgtcgccgaatattccacctcttcacccgctgcgccatcgtctcctcctccagccaaggatgaggctaagaagaagacgtatgattacggaggcaaaggcgcgatcgggaaggtctgccaggtcatcggtgctatcgtcgatgtgagattcgaagatcaggaagggttgcctccgatcatgacgtcactcgaggtgcaggatcatcccacgaggctggtgctcgaggtgtcgcatcacttgggtcagaatgtggtcaggactattgctatggatggtaccgagggactcgttcgtgggagacgcgtgctcaacactggagctccaatcactgttcctgtgggtagagcaacacttggacgtattatgaatgttcttggagaacctattgacgagagaggcgaaattaagaccgaacactacttacctattcacagagatgctccggctttggttgatctagccaccggtcaagagatccttgccactggtattaaggttgttgatctgcttgctccttaccaaagaggaggaaagattgggctctttggtggtgctggtgttggcaaaactgtgctcattatggaactgattaacaatgtcgccaaagctcatggtggtttctccgtgtttgctggtgtgggagaaagaacacgtgaaggcaatgacttgtacagagaaatgattgagagtggtgtcatcaagctaggcgagaagcagtctgagagcaaatgtgctcttgtgtatggacaaatgaacgagcccccgggtgctcgtgcccgtgttggacttactggtttgactgttgctgagtatttccgtgatgctgaaggccaagatgtgttgcttttcattgacaacattttccgtttcactcaggctaactctgaagtgtctgctttgcttggtcgtatcccatctgctgtgggttaccagccaactctggcttccgatcttggtgctcttcaagagcgaatcacaaccaccaagaaaggttccatcacctctgtccaagccatctatgtccctgctgatgatttgacagatcctgctcctgccacaaccttcgctcatttagacgccacaactgtgctgtctagacagatttccgagctcggtatctatcctgctgtggatcctctggattcaacatcccgtatgctctcgcctcacattctgggtgaggagcactacaacactgctcgtggtgtgcagaaagtgctacagaactacaagaacttgcaagatattattgccattttgggaatggatgagctaagtgaagatgacaagctgactgttgcccgtgcccgtaagatccagagattcttgagtcagccattccacgttgctgagatcttcactggtgcccctggaaaatacgttgaccttaaggaaaacatcaacagtttccagggtttgctcgatggcaagtatgatgatcttcctgaacaatcgttttacatggttggtggcatcgacgaggtggttgctaaagcagagaagatctccaaggaggccgcagcttaa

SEQ ID NO: 7345 - protein, 555 aa, Brassica napus
MASRRVLSTLLRSSSSRSAARFATRNPRIPSPSPARCASPFGDLLGRVAEYSTSSPAAPSSPPPAKDEAKKKTYDYGGKGAIGKVCQVIGAIVDVRFEDQEGLPPIMTSLEVQDHPTRLVLEVSHHLGQNVVRTIAMDGTEGLVRGRRVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLPEQSFYMVGGIDEVVAKAEKISKEAAA

SEQ ID NO: 7346 - DNA, 1680 bp, Glycine max
  CDS (1)..(1680)
atggcttcacgcaggctcgtatcttctctgattcgatcctcccttcgtagatctcaatcgaagccctcaatttccgcatcgacatcgaggctcacgtcatccaaccgtgcctcaccgcacggatacttgctgaaccgcgtcgccgagtacgccaccgccgcggctgctgctaccactcctccctctcctcctcctccggggaagaaggagctcggcggcggcgggaagatcaccgatgaattcaccgggaagggcgcgatcgggcaggtctgccaggtcattggtgccgtcgtcgatgtcagattcgacgagggtttgcctccgatcatgaccgcgctggaggttctggatcactcgtcgaggcttgtgttggaggtggcgcagcatttgggtgaaggcgttgtccgaaccattgctatggatgccaccgaaggtgtcgttagaggctggcgcgttctcaacactggctcccctattaccgttccagttggtagggctacccttggccgtatcataaatgtcattggagagcctattgatgccaagggagaaatcaatactgagcattatttgcccattcatagagaagctcctgcttttgttgagcaagaaactgcacagcagattcttgttactggaatcaaggttgttgacctgcttgcaccatatcaaagaggaggaaagattgggttgtttggtggtgctggtgtaggaaaaactgtgcttattatggaacttattaacaatgttgcaaaagctcatggtggtttctctgtgtttgctggtgttggagaacgaacccgagagggtaatgacttgtacagagaaatgattgagagtggtgtcattaagcttgatgataagcagagtgaaagcaagtgtgctcttgtgtatggtcaaatgaatgagccccctggtgcccgtgcccgtgttggtcttactgggcttactgtggctgaacacttccgtgatgctgaagggcaagatgtgcttcttttcgtagacaacattttccgttttacccaagctaactcagaggtgtctgctttgcttggtcgtatcccatctgctgttggttaccaaccaaccttgtctactgatcttggagctcttcaagagcgtattacaacaaccaagaagggttcaattacctctgtccaagctatctatgtgcctgctgatgacttgacagatcctgctcctgctaccacttttgctcacttggatgccacaacagtgttgtcacgacagatctccgagcttggtatctatcctgctgttgatcccttggattctacatctcgtatgctttccccccttattttgggtgcggatcactacgaaactgctcgtggtgtacagaaagtgcttcagaactacaagaatcttcaagatatcattgctattttgggaatggatgagctcagtgaagatgataaattgactgttgcccgtgcccgtaagattcagcgattcttaagccagcctttccatgttgctgaagtcttcactggtgccccaggaaaatatgttgagttgaaggagaacgttgccagcttccagggtgtgttggatggaaaatacgatgaccttccagagcagtcgttttacatggttggcggtattgaggaggtcattgcaaaggccgagaaaattgctaaggaatctgcagcgtcttaa

SEQ ID NO: 7347 - protein, 559 aa, Glycine max
MASRRLVSSLIRSSLRRSQSKPSISASTSRLTSSNRASPHGYLLNRVAEYATAAAAATTPPSPPPPGKKELGGGGKITDEFTGKGAIGQVCQVIGAVVDVRFDEGLPPIMTALEVLDHSSRLVLEVAQHLGEGVVRTIAMDATEGVVRGWRVLNTGSPITVPVGRATLGRIINVIGEPIDAKGEINTEHYLPIHREAPAFVEQETAQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFVDNIFRFTQANSEVSALLGRIPSAVGYQPTLSTDLGALQERITTTKKGSITSVQAIYVPADDLTDPAPATTFAHLDATTVLSRQISELGIYPAVDPLDSTSRMLSPLILGADHYETARGVQKVLQNYKNLQDIIAILGMDELSEDDKLTVARARKIQRFLSQPFHVAEVFTGAPGKYVELKENVASFQGVLDGKYDDLPEQSFYMVGGIEEVIAKAEKIAKESAAS

SEQ ID NO: 7348 - DNA, 1497 bp, Glycine max
  CDS (1)..(1497)
atgcgaatcaatcctactacttctggtcctgaggtttctgcgcttgaaaaaaaaaatctgggacgtatcgcccaaataattggtccggtactagatgtagcttttcccccaggtaagatgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggtggagcaactctaggacgaattttcaacgtgcttggagagcccattgataatttaggtcctgtagatactcgcacaacatctcccattcatagatctgcgcctgcctttatacaattagatacaaaattagccatttttgaaacaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaatgaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtaggtaatatcgatgaagctactgcgaaagctacgaacttagaaatggagagcaatttgaagaaatga

SEQ ID NO: 7349 - protein, 498 aa, Glycine max
MRINPTTSGPEVSALEKKNLGRIAQIIGPVLDVAFPPGKMPNIYNALIVKGRDTVGQQINVTCEVQQLLGNNRIRAVAMSATEGLMRGMEVIDTGAALSVPVGGATLGRIFNVLGEPIDNLGPVDTRTTSPIHRSAPAFIQLDTKLAIFETGIKVVDLLAPYRRGGKIGLFGGAGVGKTVLIMELINNIAKAHGGVSVFGGVGERTREGNDLYMEMKESGVMNEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGNIDEATAKATNLEMESNLKK

SEQ ID NO: 7350 - DNA, 25 bp, Artificial sequence
  primer
atggttttgccaagactatatactg

SEQ ID NO: 7351 - DNA, 23 bp, Artificial sequence
  primer
ctagttggcttcagcggctaact

SEQ ID NO: 7352 - protein, 541 aa, Artificial sequence
  consensus sequence
  Variant (2)..(4): Xaa in position 2 to 4 is any amino acid
  Variant (5)..(10): Xaa in position 5 to 10 is any or no amino acid
  Variant (12)..(13): Xaa in position 12 to 13 is any amino acid
  Variant (15)..(15): Xaa in position 15 is any amino acid
  Variant (17)..(17): Xaa in position 17 is any amino acid
  Variant (20)..(20): Xaa in position 20 is any amino acid
  Variant (22)..(25): Xaa in position 22 to 25 is any amino acid
  Variant (26)..(30): Xaa in position 26 to 30 is any or no amino acid
  Variant (32)..(35): Xaa in position 32 to 35 is any amino acid
  Variant (38)..(44): Xaa in position 38 to 44 is any amino acid
  Variant (45)..(59): Xaa in position 45 to 59 is any or no amino acid
  Variant (62)..(62): Xaa in position 62 is any amino acid
  Variant (64)..(64): Xaa in position 64 is any amino acid
  Variant (67)..(69): Xaa in position 67 to 69 is any amino acid
  Variant (72)..(73): Xaa in position 72 to 73 is any amino acid
  Variant (76)..(77): Xaa in position 76 to 77 is any amino acid
  Variant (79)..(79): Xaa in position 79 is any amino acid
  Variant (82)..(82): Xaa in position 82 is any amino acid
  Variant (85)..(86): Xaa in position 85 to 86 is any amino acid
  Variant (88)..(89): Xaa in position 88 to 89 is any amino acid
  Variant (92)..(93): Xaa in position 92 to 93 is any amino acid
  Variant (95)..(95): Xaa in position 95 is any amino acid
  Variant (100)..(100): Xaa in position 100 is any amino acid
  Variant (101)..(101): Xaa in position 101 is any or no amino acid
  Variant (106)..(107): Xaa in position 106 to 107 is any amino acid
  Variant (110)..(110): Xaa in position 110 is any amino acid
  Variant (112)..(114): Xaa in position 112 to 114 is any amino acid
  Variant (116)..(126): Xaa in position 116 to 126 is any amino acid
  Variant (127)..(129): Xaa in position 127 to 129 is any or no amino acid
  Variant (132)..(133): Xaa in position 132 to 133 is any amino acid
  Variant (136)..(148): Xaa in position 136 to 148 is any amino acid
  Variant (154)..(154): Xaa in position 154 is any amino acid
  Variant (157)..(158): Xaa in position 157 to 158 is any amino acid
  Variant (160)..(162): Xaa in position 160 to 162 is any amino acid
  Variant (166)..(166): Xaa in position 166 is any amino acid
  Variant (179)..(181): Xaa in position 179 to 181 is any amino acid
  Variant (185)..(185): Xaa in position 185 is any amino acid
  Variant (187)..(187): Xaa in position 187 is any amino acid
  Variant (189)..(190): Xaa in position 189 to 190 is any amino acid
  Variant (192)..(192): Xaa in position 192 is any amino acid
  Variant (193)..(193): Xaa in position 193 is any or no amino acid
  Variant (195)..(195): Xaa in position 195 is any amino acid
  Variant (199)..(199): Xaa in position 199 is any amino acid
  Variant (211)..(211): Xaa in position 211 is any amino acid
  Variant (213)..(213): Xaa in position 213 is any amino acid
  Variant (216)..(218): Xaa in position 216 to 218 is any amino acid
  Variant (219)..(219): Xaa in position 219 is any or no amino acid
  Variant (221)..(222): Xaa in position 221 to 222 is any amino acid
  Variant (223)..(249): Xaa in position 223 to 249 is any or no amino acid
  Variant (251)..(251): Xaa in position 251 is any amino acid
  Variant (253)..(253): Xaa in position 253 is any amino acid
  Variant (255)..(255): Xaa in position 255 is any amino acid
  Variant (262)..(262): Xaa in position 262 is any amino acid
  Variant (265)..(265): Xaa in position 265 is any amino acid
  Variant (267)..(267): Xaa in position 267 is any amino acid
  Variant (270)..(270): Xaa in position 270 is any amino acid
  Variant (272)..(273): Xaa in position 272 to 273 is any amino acid
  Variant (276)..(276): Xaa in position 276 is any amino acid
  Variant (279)..(279): Xaa in position 279 is any amino acid
  Variant (283)..(285): Xaa in position 283 to 285 is any amino acid
  Variant (286)..(291): Xaa in position 286 to 291 is any or no amino acid
  Variant (295)..(295): Xaa in position 295 is any amino acid
  Variant (297)..(297): Xaa in position 297 is any amino acid
  Variant (301)..(301): Xaa in position 301 is any amino acid
  Variant (303)..(305): Xaa in position 303 to 305 is any amino acid
  Variant (308)..(308): Xaa in position 308 is any amino acid
  Variant (317)..(317): Xaa in position 317 is any amino acid
  Variant (328)..(329): Xaa in position 328 to 329 is any amino acid
  Variant (330)..(330): Xaa in position 330 is any or no amino acid
  Variant (333)..(333): Xaa in position 333 is any amino acid
  Variant (342)..(343): Xaa in position 342 to 343 is any amino acid
  Variant (349)..(349): Xaa in position 349 is any amino acid
  Variant (352)..(352): Xaa in position 352 is any amino acid
  Variant (359)..(359): Xaa in position 359 is any amino acid
  Variant (363)..(363): Xaa in position 363 is any amino acid
  Variant (367)..(367): Xaa in position 367 is any amino acid
  Variant (375)..(376): Xaa in position 375 to 376 is any amino acid
  Variant (378)..(378): Xaa in position 378 is any amino acid
  Variant (380)..(384): Xaa in position 380 to 384 is any amino acid
  Variant (394)..(394): Xaa in position 394 is any amino acid
  Variant (396)..(396): Xaa in position 396 is any amino acid
  Variant (398)..(399): Xaa in position 398 to 399 is any amino acid
  Variant (401)..(401): Xaa in position 401 is any amino acid
  Variant (403)..(405): Xaa in position 403 to 405 is any amino acid
  Variant (407)..(407): Xaa in position 407 is any amino acid
  Variant (411)..(412): Xaa in position 411 to 412 is any amino acid
  Variant (414)..(415): Xaa in position 414 to 415 is any amino acid
  Variant (417)..(419): Xaa in position 417 to 419 is any amino acid
  Variant (422)..(422): Xaa in position 422 is any amino acid
  Variant (425)..(425): Xaa in position 425 is any amino acid
  Variant (427)..(427): Xaa in position 427 is any amino acid
  Variant (435)..(435): Xaa in position 435 is any amino acid
  Variant (440)..(441): Xaa in position 440 to 441 is any amino acid
  Variant (443)..(445): Xaa in position 443 to 445 is any amino acid
  Variant (447)..(447): Xaa in position 447 is any amino acid
  Variant (451)..(451): Xaa in position 451 is any amino acid
  Variant (453)..(454): Xaa in position 453 to 454 is any amino acid
  Variant (461)..(461): Xaa in position 461 is any amino acid
  Variant (465)..(465): Xaa in position 465 is any amino acid
  Variant (469)..(470): Xaa in position 469 to 470 is any amino acid
  Variant (472)..(473): Xaa in position 472 to 473 is any amino acid
  Variant (474)..(481): Xaa in position 474 to 481 is any or no amino acid
  Variant (483)..(486): Xaa in position 483 to 486 is any amino acid
  Variant (488)..(490): Xaa in position 488 to 490 is any amino acid
  Variant (491)..(502): Xaa in position 491 to 502 is any or no amino acid
  Variant (504)..(508): Xaa in position 504 to 508 is any amino acid
  Variant (510)..(511): Xaa in position 510 to 511 is any amino acid
  Variant (512)..(512): Xaa in position 512 is any or no amino acid
  Variant (514)..(515): Xaa in position 514 to 515 is any amino acid
  Variant (518)..(518): Xaa in position 518 is any amino acid
  Variant (521)..(522): Xaa in position 521 to 522 is any amino acid
  Variant (525)..(525): Xaa in position 525 is any amino acid
  Variant (526)..(532): Xaa in position 526 to 532 is any or no amino acid
  Variant (534)..(536): Xaa in position 534 to 536 is any amino acid
  Variant (537)..(539): Xaa in position 537 to 539 is any or no amino acid
GXXXXXXXXXQXXGXVXDVXFXXXXXXXXXPXXXXALXXXXXXXXXXXXXXXXXXXXXXEVXQXLGXXXVRXXAMXXTXGLXRGXXVXXTGXXIXVPVGXXTLGRXXNVXGXXXDXXXXXXXXXXXXXXIHXXAPXXXXXXXXXXXXXTGIKVXDLXXPXXXGGKXGLFGGAGVGKTVXXXELIXNXAXXHXXGXSVFXGVGERTREGNDXYXEMXXXXVXXXXXXXXXXXXXXXXXXXXXXXXXXXXXKXAXVXGQMNEPXPGXRXRVXLXXLTXAEXFRDXXXXXXXXXDVLXFXDNIXRXXXAGXEVSALLGRXPSAVGYQPTLXXXMGXLQERITSTXXGSITSXQAXYVPADDXTDPXPATXFAHLDATXXLXRXXXXXGIYPAVDPLXSXSXXLXPXXXGXEHYXXAXXVXXXLQXYKXLXDIIAILGXDELSXXDXXXVXRARXIXXFLSQPFXVAEXFTGXXGXXXXXXXXXXVXXXXTXXXXXXXXXXXXXXXFXXXXXGXXXDXXPEXAFXXVGXXXXXXXXIXXXXXXKA

SEQ ID NO: 7353 - protein, 43 aa, Artificial sequence
  protein pattern
  Variant (3)..(3): Xaa in position 3 is any amino acid
  Variant (4)..(4): Xaa in position 4 is Leu or Met
  Variant (6)..(6): Xaa in position 6 is Asp or Glu
  Variant (9)..(9): Xaa in position 9 is Ala, Thr or Val
  Variant (10)..(10): Xaa in position 10 is Ser or Thr
  Variant (12)..(12): Xaa in position 12 is any amino acid
  Variant (13)..(13): Xaa in position 13 is any or no amino acid
  Variant (15)..(15): Xaa in position 15 is any or no amino acid
  Variant (17)..(17): Xaa in position 17 is any amino acid
  Variant (20)..(20): Xaa in position 20 is Phe, Ile, Leu, Met or Val
  Variant (23)..(23): Xaa in position 23 is Ile or Val
  Variant (30)..(30): Xaa in position 30 is any amino acid
  Variant (34)..(34): Xaa in position 34 is Ala or Ser
  Variant (36)..(36): Xaa in position 36 is any amino acid
  Variant (37)..(37): Xaa in position 37 is Ala, Asn, Ser or Thr
  Variant (38)..(38): Xaa in position 38 is Ala, Ser, Thr or Val
  Variant (40)..(40): Xaa in position 40 is any amino acid
MGXXQXRIXXTXXGXSXTSXQAXYVPADDXTDPXPXXXFXHLD

SEQ ID NO: 7354 - protein, 36 aa, Artificial sequence
  protein pattern
  Variant (2)..(2): Xaa in position 2 is Ile or Val
  Variant (4)..(4): Xaa in position 4 is Phe, Leu or Met
  Variant (6)..(6): Xaa in position 6 is Ile or Val
  Variant (10)..(10): Xaa in position 10 is Phe or Tyr
  Variant (12)..(12): Xaa in position 12 is Phe or Tyr
  Variant (13)..(14): Xaa in position 13 to 14 is any amino acid
  Variant (16)..(16): Xaa in position 16 is Gly or Asn
  Variant (17)..(17): Xaa in position 17 is any amino acid
  Variant (26)..(26): Xaa in position 26 is Ile or Met
DXLXFXDNIXRXXXAXXEVSALLGRXPSAVGYQPTL

SEQ ID NO: 7355 - protein, 35 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is any or no amino acid
  Variant (7)..(7): Xaa in position 7 is Phe or Tyr
  Variant (8)..(8): Xaa in position 8 is any amino acid
  Variant (9)..(9): Xaa in position 9 is Lys or Arg
  Variant (13)..(13): Xaa in position 13 is Ile or Val
  Variant (26)..(26): Xaa in position 26 is any amino acid
  Variant (27)..(27): Xaa in position 27 is Ile, Leu, Met or Val
  Variant (28)..(28): Xaa in position 28 is any amino acid
  Variant (32)..(32): Xaa in position 32 is any or no amino acid
  Variant (34)..(34): Xaa in position 34 is Ile, Leu or Val
DXLXXPXXXGGKXGLFGGAGVGKTVXXXELIXNXA

SEQ ID NO: 7356 - protein, 57 aa, Artificial sequence
  protein pattern
  Variant (2)..(2): Xaa in position 2 is Phe or Tyr
  Variant (3)..(4): Xaa in position 3 to 4 is any amino acid
  Variant (5)..(5): Xaa in position 5 is Ala, Ser, Thr or Val
  Variant (6)..(11): Xaa in position 6 to 11 is any amino acid
  Variant (13)..(13): Xaa in position 13 is Glu or Gln
  Variant (14)..(16): Xaa in position 14 to 16 is any amino acid
  Variant (17)..(17): Xaa in position 17 is Ala, Asp, Glu, Gly, Asn or Ser
  Variant (19)..(19): Xaa in position 19 is any amino acid
  Variant (27)..(27): Xaa in position 27 is Ile, Leu, Met or Val
  Variant (32)..(33): Xaa in position 32 to 33 is any or no amino acid
  Variant (35)..(37): Xaa in position 35 to 37 is any amino acid
  Variant (38)..(39): Xaa in position 38 to 39 is any or no amino acid
  Variant (41)..(41): Xaa in position 41 is any amino acid
  Variant (45)..(45): Xaa in position 45 is Lys or Arg
  Variant (46)..(46): Xaa in position 46 is Ile, Leu, Met or Val
  Variant (47)..(47): Xaa in position 47 is Glu, Gln or Arg
  Variant (48)..(48): Xaa in position 48 is any amino acid
  Variant (49)..(49): Xaa in position 49 is Phe or Tyr
  Variant (50)..(50): Xaa in position 50 is Phe, Leu or Met
  Variant (51)..(51): Xaa in position 51 is Gly, Ser or Thr
  Variant (53)..(53): Xaa in position 53 is Asn, Pro, Ser or Thr
  Variant (54)..(56): Xaa in position 54 to 56 is any amino acid
  Variant (57)..(57): Xaa in position 57 is Ala or Glu
HXXXXXXXXXXLXXXXXLXDIIAILGXDELSXXDXXXXXVXRARXXXXXXXQXXXXX

SEQ ID NO: 7357 - protein, 34 aa, Artificial sequence
  protein pattern
  Variant (2)..(5): Xaa in position 2 to 5 is any amino acid
  Variant (7)..(7): Xaa in position 7 is Ala, Cys, Gly or Thr
  Variant (8)..(8): Xaa in position 8 is Ile or Val
  Variant (10)..(10): Xaa in position 10 is Leu or Met
  Variant (11)..(11): Xaa in position 11 is Ala, Asp, Glu, Gly, Gln or Ser
  Variant (12)..(14): Xaa in position 12 to 14 is any amino acid
  Variant (16)..(16): Xaa in position 16 is Phe, Ile, Leu, Met or Val
  Variant (17)..(17): Xaa in position 17 is any amino acid
  Variant (19)..(21): Xaa in position 19 to 21 is any amino acid
  Variant (22)..(22): Xaa in position 22 is Ala, Ile or Val
  Variant (23)..(28): Xaa in position 23 to 28 is any amino acid
  Variant (29)..(29): Xaa in position 29 is Ile, Leu or Val
  Variant (30)..(31): Xaa in position 30 to 31 is any amino acid
GXXXXRXXAXXXXXGXXRXXXXXXXXXXXXXPVG

SEQ ID NO: 7358 - protein, 20 aa, Artificial sequence
  protein pattern
  Variant (4)..(4): Xaa in position 4 is Ala, Gly or Thr
  Variant (16)..(16): Xaa in position 16 is Phe or Leu
  Variant (17)..(18): Xaa in position 17 to 18 is any amino acid
  Variant (20)..(20): Xaa in position 20 is Phe or Met
SVFXGVGERTREGNDXXXEX

SEQ ID NO: 7359 - protein, 21 aa, Artificial sequence
  protein pattern
  Variant (4)..(5): Xaa in position 4 to 5 is any amino acid
  Variant (7)..(8): Xaa in position 7 to 8 is any amino acid
  Variant (10)..(10): Xaa in position 10 is any amino acid
  Variant (11)..(11): Xaa in position 11 is Ile, Leu or Val
  Variant (12)..(12): Xaa in position 12 is any amino acid
  Variant (13)..(13): Xaa in position 13 is Asp or Glu
  Variant (15)..(15): Xaa in position 15 is Ile, Leu or Val
  Variant (16)..(16): Xaa in position 16 is any amino acid
  Variant (17)..(17): Xaa in position 17 is Ala, Gly or Ser
  Variant (19)..(20): Xaa in position 19 to 20 is any amino acid
  Variant (21)..(21): Xaa in position 21 is Ile, Leu or Val
FTGXXGXXVXXXXTXXXFXXX

SEQ ID NO: 7360 - protein, 10 aa, Artificial sequence
  protein pattern
  Variant (9)..(9): Xaa in position 9 is Ala or Asn
GQMNEPPGXR

SEQ ID NO: 7361 - protein, 28 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Ala, Glu, Asn or Ser
  Variant (7)..(7): Xaa in position 7 is any amino acid
  Variant (8)..(8): Xaa in position 8 is Ile or Leu
  Variant (9)..(9): Xaa in position 9 is Ala, Ser, Thr or Val
  Variant (10)..(10): Xaa in position 10 is Ala, Glu, Gln or Ser
  Variant (11)..(11): Xaa in position 11 is any amino acid
  Variant (21)..(21): Xaa in position 21 is Ala, Asp, Glu, Gly, Asn, Ser or Thr
  Variant (23)..(23): Xaa in position 23 is any amino acid
  Variant (25)..(26): Xaa in position 25 to 26 is any amino acid
  Variant (27)..(27): Xaa in position 27 is Ile, Leu or Met
  Variant (28)..(28): Xaa in position 28 is Ala, Asp, Glu, Gln, Ser or Thr
TXXLXRXXXXXGIYPAVDPLXSXSXXXX

SEQ ID NO: 7362 - protein, 25 aa, Artificial sequence
  protein pattern
  Variant (3)..(4): Xaa in position 3 to 4 is any amino acid
  Variant (5)..(5): Xaa in position 5 is Ala or Pro
  Variant (7)..(7): Xaa in position 7 is any amino acid
  Variant (8)..(8): Xaa in position 8 is Phe or Tyr
  Variant (9)..(9): Xaa in position 9 is any amino acid
  Variant (10)..(10): Xaa in position 10 is Asp, Glu, Asn or Gln
  Variant (11)..(17): Xaa in position 11 to 17 is any amino acid
  Variant (18)..(18): Xaa in position 18 is Phe or Leu
  Variant (19)..(19): Xaa in position 19 is any amino acid
  Variant (22)..(22): Xaa in position 22 is Ile, Leu or Val
  Variant (25)..(25): Xaa in position 25 is Ile or Val
IHXXXPXXXXXXXXXXXXXTGXKVX

SEQ ID NO: 7363 - protein, 21 aa, Artificial sequence
  protein pattern
  Variant (2)..(2): Xaa in position 2 is Asp, Glu, Lys or Arg
  Variant (3)..(3): Xaa in position 3 is any amino acid
  Variant (5)..(6): Xaa in position 5 to 6 is any amino acid
  Variant (9)..(9): Xaa in position 9 is any or no amino acid
  Variant (11)..(11): Xaa in position 11 is any or no amino acid
  Variant (13)..(15): Xaa in position 13 to 15 is any amino acid
  Variant (17)..(17): Xaa in position 17 is any amino acid
  Variant (18)..(18): Xaa in position 18 is Phe, Ile, Leu or Met
  Variant (19)..(19): Xaa in position 19 is Ala, Asp, Glu, Asn, Gln or Thr
  Variant (20)..(20): Xaa in position 20 is any amino acid
  Variant (21)..(21): Xaa in position 21 is Ala, Leu or Val
GXXDXXPEXAXFXXXGXXXXX

SEQ ID NO: 7364 - protein, 13 aa, Artificial sequence
  protein pattern
  Variant (4)..(4): Xaa in position 4 is Ile or Val
  Variant (5)..(5): Xaa in position 5 is Phe, Ile, Leu or Met
  Variant (6)..(6): Xaa in position 6 is Asp or Asn
  Variant (8)..(8): Xaa in position 8 is Ile, Leu or Val
  Variant (10)..(12): Xaa in position 10 to 12 is any amino acid
LGRXXXVXGXXXD

SEQ ID NO: 7365 - protein, 10 aa, Artificial sequence
  protein pattern
  Variant (2)..(2): Xaa in position 2 is Ser or Thr
  Variant (3)..(3): Xaa in position 3 is Ala or Gly
  Variant (6)..(6): Xaa in position 6 is Ile, Met or Val
  Variant (9)..(9): Xaa in position 9 is any amino acid
LXXLTXAEXF

SEQ ID NO: 7366 - DNA, 1650 bp, Saccharomyces cerevisiae
  CDS (1)..(1650)
atgaagaactctgtcggtatttcaattgcaaccattgttgctatcatagcagctatatactatgtgccatggtacgaacactttgagagaaagtcaccgggggccggagaaatgagagatcggattgaaagcatgttcttggaatcgtggagagactattccaagcatggctggggatacgatgtgtatggacctattgagcacacttcccataatatgcctcgtggcaaccagccgttaggctggattatcgtagattcagtggataccttgatgttaatgtataactcctccacactatacaaaagtgagttcgaggcagaaattcagagatcggagcattggataaacgatgttttggattttgatattgatgccgaagtgaatgtttttgaaactactattagaatgctaggtggtttattatccgcatatcatctatctgatgttttagaagtaggtaataagactgtctacttgaacaaagcaatagatttgggggataggcttgctttggcgttcttatccactcagaccggaattccatactcaagtataaaccttcatagtggccaagcggttaagaaccatgcagatgggggggcatcttctaccgcagaattcactacgctacaaatggaattcaaatatctggcgtatttgacaggaaatcgtacttattgggagctggtggagcgtgtttacgagccattatacaaaaataacgatcttctaaatacctacgatggattggttccaatttatacatttccagatactgggaagtttggtgcttcgactatccggttcggatcaagaggtgattctttttatgagtatttactaaaacaatatttattgacgcacgaaacactttattatgatctgtacagaaaatccatggaaggtatgaaaaagcatttattagcacaatccaaaccctcttctctgtggtacattggggaaagagaacaaggtctacatggacaactttctcctaagatggaccacctcgtgtgctttatggggggattgttagcatcaggctctactgagggcctttctattcatgaagcccgaagacgtccgtttttctctctttcccttgaaagaaaaagtgactgggatttggctaaagggataactgacacatgttatcaaatgtacaagcagtcttcctcggggcttgcgcctgaaatcgttgtcttcaatgatggaaacataaaacaggatggttggtggcggtcgtctgtgggtgatttttttgttaaaccactcgataggcacaacctacaaagaccagaaacggtggaatcgattatgttcatgtatcatttatctcatgatcacaaatatcgtgaatggggggcggaaatcgcaactagcttctttgaaaatacctgtgttgattgtaatgacccaaaattaaggcggttcaccagtttaagtgattgtatcacgttacctacaaagaaatctaacaatatggaaagtttctggttggcagagactttaaagtatttatatatattgtttttagacgagtttgatttgaccaaagttgttttcaacacagaagctcatccttttccagtattagacgaagaaatattaaaatcgcagtctctgaccacaggttggtcgttgtag

SEQ ID NO: 7367 - protein, 549 aa, Saccharomyces cerevisiae
MKNSVGISIATIVAIIAAIYYVPWYEHFERKSPGAGEMRDRIESMFLESWRDYSKHGWGYDVYGPIEHTSHNMPRGNQPLGWIIVDSVDTLMLMYNSSTLYKSEFEAEIQRSEHWINDVLDFDIDAEVNVFETTIRMLGGLLSAYHLSDVLEVGNKTVYLNKAIDLGDRLALAFLSTQTGIPYSSINLHSGQAVKNHADGGASSTAEFTTLQMEFKYLAYLTGNRTYWELVERVYEPLYKNNDLLNTYDGLVPIYTFPDTGKFGASTIRFGSRGDSFYEYLLKQYLLTHETLYYDLYRKSMEGMKKHLLAQSKPSSLWYIGEREQGLHGQLSPKMDHLVCFMGGLLASGSTEGLSIHEARRRPFFSLSLERKSDWDLAKGITDTCYQMYKQSSSGLAPEIVVFNDGNIKQDGWWRSSVGDFFVKPLDRHNLQRPETVESIMFMYHLSHDHKYREWGAEIATSFFENTCVDCNDPKLRRFTSLSDCITLPTKKSNNMESFWLAETLKYLYILFLDEFDLTKVVFNTEAHPFPVLDEEILKSQSLTTGWSL

SEQ ID NO: 7368 - DNA, 2055 bp, Oryza sativa (japonica cultivar-group)
  CDS (1)..(2055)
atgcccacctcgggcccggacgcgatgcagccggcgctgcgacggcggcggcggcgccaaggcttcctcctccccttcgcctgcctctccgccgccctcatcgccgctgccctgctccccggcgccgctttcgccgatggcgtcacgccctccgaggcccgccggctccgcgacgaggtcaaagatatgttctatcatgcatttgatgggtacatgcaacatgcttttccacttgatgaattgcggcctttaagttgccaaggagaagattcacttggtggctatgcacttactcttatagactctttggataccttggctttactaggggataaggagagatttgatgctgccgtggagtgggttggtaagaatgtccgctttgatattaataaaactgtctctgtttttgaaaccaacatacgcattcttgggggtctgctatcagctcacctgattgccagtgattatgcaactggaatgagaattcaatcttatgatgatcagttgcttcatttagcggctgacttagctcaaagattgctacctgcatttgacactccaacaggtattccatttggatcagtaaatttattgtatggagtcgatgaaaatgaaagcaagataacttcaacagctggtggtggcactttgacactggaatttggtgtcctgagtcgtttgactaatgatagcgtttatgaacgagttacaaaaaactctgtgcgtggaatatgggcacgcaggtcgaaacttgaccttgttggtgcccatataaatgtatttactggtgaatggacacagaaggatgcaggaattggcacaagcattgactcattctatgagtatcttctaaaggcgtatttattatttggagatgaagaatatttgtatatatttcaggaggcttacaaggctgccatgcattatctccatcatgatccctggtatgtggaggtaaatatgaattctggtgctactgtttggccactattcaacagtctccaggcattctggccaggacttcaggtgttagctggagatgttgatcctgccattcgaactcatgctgccttcttcagtgtatggaaaaaatatggcttcaccccagaagggtttaatcttgctacatccactgttcagaatggacaaaggagctacccgctgcggcctgaattgattgaaagcacatattggctgttcaaggctactagagattataggtaccttgatgttggaagggatatattagcaagccttcaatatggtgctaaatgtccatgtggttactgccatatttcagatgtagaaacccaccagcaggatgaccacatggagagttttttccttgcagaaacagtcaaatatctctggcttctttttgatttagctgcaggccctgataatattgttgaaaatgggccatataaatacatatttagtacagaaggtcatctgttgcctgctactcctcagataaccttgttagatgagcattgcttgtatgctggagcattctgcaatggtactgcaggccatggatatggtaccggtgatagttctaataagcatcaaaatgcaaactctgttccgttcgatgatagtcgaacaccttccgatcaatctttatccaatattttgtctacgacaagagggtacatcaagggagtttgtccaggattaactcatgcccagaaacttggcatatcatactctgccgaggaggataactcaatacagcagaattctggaagtagtgagaatcttgatgaatcacacgtgatcaaatccagtgtccaagctcaatcaagttctgttatattgatatcgcatccagtcgcaagccaaactgaggagcctacgtcgggcagaagtcagtacaatgcaaacattgtggcaactgctgagtctgtagggactgatactgccggcgcctcatcccaccccgaggatcttgttaaggaaactgagagcgtctctgaacagaaagaaatcaatgacaaagagatcgcttctcagggtagtcaaccgaccgaaggaagatacctgacctaa

SEQ ID NO: 7369 - protein, 684 aa, Oryza sativa (japonica cultivar-group)
MPTSGPDAMQPALRRRRRRQGFLLPFACLSAALIAAALLPGAAFADGVTPSEARRLRDEVKDMFYHAFDGYMQHAFPLDELRPLSCQGEDSLGGYALTLIDSLDTLALLGDKERFDAAVEWVGKNVRFDINKTVSVFETNIRILGGLLSAHLIASDYATGMRIQSYDDQLLHLAADLAQRLLPAFDTPTGIPFGSVNLLYGVDENESKITSTAGGGTLTLEFGVLSRLTNDSVYERVTKNSVRGIWARRSKLDLVGAHINVFTGEWTQKDAGIGTSIDSFYEYLLKAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYGAKCPCGYCHISDVETHQQDDHMESFFLAETVKYLWLLFDLAAGPDNIVENGPYKYIFSTEGHLLPATPQITLLDEHCLYAGAFCNGTAGHGYGTGDSSNKHQNANSVPFDDSRTPSDQSLSNILSTTRGYIKGVCPGLTHAQKLGISYSAEEDNSIQQNSGSSENLDESHVIKSSVQAQSSSVILISHPVASQTEEPTSGRSQYNANIVATAESVGTDTAGASSHPEDLVKETESVSEQKEINDKEIASQGSQPTEGRYLT

SEQ ID NO: 7370 - DNA, 1758 bp, Oryza sativa (japonica cultivar-group)
  CDS (1)..(1758)
atgcgacctcctccccggccgcgccgcccagtgccggcgcggctcgtcgccgctgcggtcctcctctcggctctcgccgggggagccgcggcgggcgccgccatcgccggcgatgggtacgggcgcggcaggaggctgtacatgaggaacaaggtcctggagatgttttaccatgcttatgacaactatatgacttatgcatttccacatgatgaattgaagcctctaaccaaaagtttcactgactcccttagtgagcttggcaacctaaatcttgaacatttgccaaatgattacaatggatctgcacttacactagtcgaatcgttgtcaagtcttgttgtcttaggtaacctcacggagtttgaaagaggagttctctggctttcagagaacctaacatttgatgttgatgctcgaataaatctttttgagtgcaacataagacttcttggggggcttatttctggtcatattcttgcaaaggagcacagcagtcatcttaaagatggaccatatcaggaccagttactacatcttgctgaaaatttaggaagtcgttttctaccagcttttgagacacctactggattgccatacgcatggatcaatcttaagtatggagtgatggaaaatgaaacaactgagacaagcacatcagggtgtggttctctgattcttgaaatgggtgcattatcacgtttgacgggtgattctagatatgaggctgcagctcttcgtgctcttcgtaagttgtggagcatgagaagttcactaaatcttgtaggcacaacccttgatgtcttgactggcaagtggattgaatattcgtcaggcattggtgctggagttgattcattttatgagtatttgattaaagcgtatgttcttttcggaagcgaagaatactgggatatgtttcattcagcttaccttgcagtgcagaagtatttccgacatggcccatggtatcatgaggctgatatgaggaccggagaagcaacacactggcaactaactagccttcaagccttctggccaggtcttcagacacttctaggagatgttgctgctgcaaatatatcacatcgtgaattttacaatgtatggcaaaggtttggtgttctgccggaaagatatcttttggacttcggaatgttgcatcctacagagaagtattatcctttacgtccagagtttgctgagtctacattttatctttatcaagcaactaaagatccttggtatctagaagttggtgaagctatcattggatcccttaattactatactaaagtggatggaggttttgctagtgtcagggatgtttcgacaatgaaacttgaagatcatcaacatagcttctttctttcagaaacctgcaaatatctttttcttctctacgatgattcattcttgaggaaccaaaattacatatttaccacggagggtcacccccttccaataaggagcacatggcacgagataatcccgacaacgcatgttcccagcaactggacattcgttaaggatgacagccaacccttccgtgtgagcgcattgtcgtctcaagtttgtccagaaacgattttccggcaaagcgttggctccccgtgggagagtgcatgccatgtaccagacgtgttacctacccacagatgcaggaccgatgatgactgtggagtggaggccgtatcatgcaggagaagaacttgcagtatggctggctactgcggcttgtggctgggggtttattag

SEQ ID NO: 7371 - protein, 585 aa, Oryza sativa (japonica cultivar-group)
MRPPPRPRRPVPARLVAAAVLLSALAGGAAAGAAIAGDGYGRGRRLYMRNKVLEMFYHAYDNYMTYAFPHDELKPLTKSFTDSLSELGNLNLEHLPNDYNGSALTLVESLSSLVVLGNLTEFERGVLWLSENLTFDVDARINLFECNIRLLGGLISGHILAKEHSSHLKDGPYQDQLLHLAENLGSRFLPAFETPTGLPYAWINLKYGVMENETTETSTSGCGSLILEMGALSRLTGDSRYEAAALRALRKLWSMRSSLNLVGTTLDVLTGKWIEYSSGIGAGVDSFYEYLIKAYVLFGSEEYWDMFHSAYLAVQKYFRHGPWYHEADMRTGEATHWQLTSLQAFWPGLQTLLGDVAAANISHREFYNVWQRFGVLPERYLLDFGMLHPTEKYYPLRPEFAESTFYLYQATKDPWYLEVGEAIIGSLNYYTKVDGGFASVRDVSTMKLEDHQHSFFLSETCKYLFLLYDDSFLRNQNYIFTTEGHPLPIRSTWHEIIPTTHVPSNWTFVKDDSQPFRVSALSSQVCPETIFRQSVGSPWESACHVPDVLPTHRCRTDDDCGVEAVSCRRRTCSMAGYCGLWLGVY

SEQ ID NO: 7372 - DNA, 1719 bp, Oryza sativa (japonica cultivar-group)
  CDS (1)..(1719)
atggctcgtcggtcctcctcctcctcgtcgtcgtcgggggcgtggcggtacctcaacccggcgtattacctcaagcggccgaagcgcctcgccctcctcttcttcgtcttcgtcgccgccaccttcgccttctgggatcgacagtcgctcgtccgcgagtacgagtcagaaatttctcgattggatgataaagtaaatcagttgcgtgaccagttaagaaaggctggagttcatctggatgaaaatccaacaggtgacaaagtatccagagaaaagcttgtagaaattgatcctattaataatgaaaggagagaaaaggttaaggaggctatggcccatgcttggaattcctatgtgaagtatgcctggggaatggatgaacttcagccacaatcaaagaatggtgtcaatagctttggtggtctcggggcaactcttgtggactcacttgatacactgtatataatgggcctaaaggatgaatttcagagggccagagactgggtggccgattcactaagctttgacaaggattacgatgcaagtgtctttgaaacgaccataagagttgttggaggcctcctcagtgcatatgatctatctggtgacaaagtatttcttgagaaggccaaagatattactgaccgtctactacctgcttgggatacaccatctggtatcccttataatagaatcaacctagctcatggacgagcccataatcctggatggaccaatggtgatagtatccttgctgattctggcacggagcaacttgaatttatagctttgtcacagaggactggtgatcccaagtatcaacaaaaggcagagaatgtcatcagacagcttcagaagatatacccaagcgatggcttactccctatatacataaaccctcattcaggaactgcgtcgtactcaacaattacatttggtgcaatgggagatagcttctacgagtacttgctcaaggtttgggtccaggggaataaaactgagcatgtaaagcattacagacaaatgtgggagacatcaatggaaggcctactaagcttgaccaaaaaaactacaccctctaattactactacatttgcgagaagaatggtggttcattgtctgacaagatggatgagcttgcatgttttgcccctggtatgctggcactgggggcctctggctatgaggagactgaaaaggctgaagaaattatgaatcttgcgaaagagcttgctcggacctgttataacttctaccaaacaactcctacaaagttggctggggagaattattttttccatactggacaggatatgaacgtgggcacatcatggaatatcctgagacctgagactgtcgaatcacttatgtacttgtggcgtcttacggggaacaaaacataccaagactgggggtgggacatattccaggcatttgaaaagaactcccgcatagaatctggttacgttgggctgagagatgtgaatactggcgagaaggataacatgatgcaaagcttcttcctagcagagactctcaagtacctatacctcctgttctctcctccatcagtcatatccttcgatgagtgggtcttcaataccgaagcccacccattgcgaattgttcctttaaatgacaatagcaaagcccactcagtaggcattgcaacaccgacggtacgaccgttcgggaggaagcaggggaaacaagagtag

SEQ ID NO: 7373 - protein, 572 aa, Oryza sativa (japonica cultivar-group)
MARRSSSSSSSSGAWRYLNPAYYLKRPKRLALLFFVFVAATFAFWDRQSLVREYESEISRLDDKVNQLRDQLRKAGVHLDENPTGDKVSREKLVEIDPINNERREKVKEAMAHAWNSYVKYAWGMDELQPQSKNGVNSFGGLGATLVDSLDTLYIMGLKDEFQRARDWVADSLSFDKDYDASVFETTIRVVGGLLSAYDLSGDKVFLEKAKDITDRLLPAWDTPSGIPYNRINLAHGRAHNPGWTNGDSILADSGTEQLEFIALSQRTGDPKYQQKAENVIRQLQKIYPSDGLLPIYINPHSGTASYSTITFGAMGDSFYEYLLKVWVQGNKTEHVKHYRQMWETSMEGLLSLTKKTTPSNYYYICEKNGGSLSDKMDELACFAPGMLALGASGYEETEKAEEIMNLAKELARTCYNFYQTTPTKLAGENYFFHTGQDMNVGTSWNILRPETVESLMYLWRLTGNKTYQDWGWDIFQAFEKNSRIESGYVGLRDVNTGEKDNMMQSFFLAETLKYLYLLFSPPSVISFDEWVFNTEAHPLRIVPLNDNSKAHSVGIATPTVRPFGRKQGKQE

SEQ ID NO: 7374 - DNA, 1938 bp, Oryza sativa (japonica cultivar-group)
  CDS (1)..(1938)
atgagcggcggcggcggcggctcgggccccctcccctactcgatgcgcgatgtggacggccgcggcgcctacaacaacgccaagttccgccaccgatctcgcctcaagatggcctctcaggctctgtttaccaatagcagcaagtaccaatgtggaaagttcactgttggaaaatttttgagtcttttaatggtttctggcgtaatatacttacttgtgcacaaaagttcggatggttttgtatccggtgagctccatgaaaaagtagggaatacacataccaagaaagattttcccaaaattcgtacattttggagaaagccaccaaggctgccgccacgtcttcctccaaatgaaatctatagaaacaattcattgcttctacagtctcctcaatctgaatggacactcagacagaagaaagttaaagaagcatttgaacatgcatggtctggctatcgaaattatgcaatgggttatgatgagcttatgcctttaacccgccgaggtatagatggactaggaggtctaggcgctactgttgtagattctttagacactgcaataataatgggtgctgatgatgttgtttccgaagcatcaaaatggattgaagataatctcatgaaaaagttaagtgagaaagggcaggtcaatctatttgaaactactatccgtgtcttgggagggcttcttagtgcctatcacttgagtggtggtgacaaagcaagaggtgactctgggataccaatgacatctaaaagggctaatccggagcgtcttttggaagtttcaaaggacttggcagacagattattgttagcctttacatcaagcccaactgctatacctttaagtgatgttgttcttcgagatcgaactgcacatgcagcccctgatggtttaagcagtacctctgaggctacaacattgcagctggagtacagttaccttagcacaatatcaggagatccaaagtatgacttagaggcaatgaaagtgttagagcatatgcgaacactcccaacagtggagggtttggttcctatttacatcaatccctcctctggtcaatttagtggagaaaatattcgattaggatctcgtggtgacagttactatgaatacctattgaaagtatgggttcagcaagaaagatatcgtgacactagtttgaagtatctatttgaaatgtatacagaagcaatgaaaggggtcaagcatcttcttgttcgaaaaactattccaaatgggctggtcttcgttggggagctcccctatggacgaaatagtggttttagccctaaaatggatcacctggtgtgttttcttcctggtacccttgctctgggtgcaacgaagggtataaccaagaaaaaagctcttgaaaatcatttattgactgcggaagacatagacaatctgcagcttgctgaagatttggccaaaacttgtgttgaaatgtactttgtgacatctactggacttgctcctgaaattgcttattttcacattgagggtaattctgagggaggacctgatggtgggaacaaaagttctcaatatgttaatgatatcataatcaaacctctggatcgtcacaatcttttacgcccagagactgtagaatcactatttgttttatatagaatcacagaggatccgaagtatagggaatggggttggcagatttttcaggcttttgagaagtatacaagagttgattctggtggctatacttcattggatgatgtcacaagcttgcccccacctaggagagacaaaatggaaactttcttccttggagaaacactgaaatacttgtatttgctgtttggtgaaagcaatattcttccattagataagtatgtattcaacacagaggcccatccacttccaatcattcagtctgcacaacagatctctcattcggtatag

SEQ ID NO: 7375 - protein, 645 aa, Oryza sativa (japonica cultivar-group)
MSGGGGGSGPLPYSMRDVDGRGAYNNAKFRHRSRLKMASQALFTNSSKYQCGKFTVGKFLSLLMVSGVIYLLVHKSSDGFVSGELHEKVGNTHTKKDFPKIRTFWRKPPRLPPRLPPNEIYRNNSLLLQSPQSEWTLRQKKVKEAFEHAWSGYRNYAMGYDELMPLTRRGIDGLGGLGATVVDSLDTAIIMGADDVVSEASKWIEDNLMKKLSEKGQVNLFETTIRVLGGLLSAYHLSGGDKARGDSGIPMTSKRANPERLLEVSKDLADRLLLAFTSSPTAIPLSDVVLRDRTAHAAPDGLSSTSEATTLQLEYSYLSTISGDPKYDLEAMKVLEHMRTLPTVEGLVPIYINPSSGQFSGENIRLGSRGDSYYEYLLKVWVQQERYRDTSLKYLFEMYTEAMKGVKHLLVRKTIPNGLVFVGELPYGRNSGFSPKMDHLVCFLPGTLALGATKGITKKKALENHLLTAEDIDNLQLAEDLAKTCVEMYFVTSTGLAPEIAYFHIEGNSEGGPDGGNKSSQYVNDIIIKPLDRHNLLRPETVESLFVLYRITEDPKYREWGWQIFQAFEKYTRVDSGGYTSLDDVTSLPPPRRDKMETFFLGETLKYLYLLFGESNILPLDKYVFNTEAHPLPIIQSAQQISHSV

SEQ ID NO: 7376 - DNA, 1683 bp, Arabidopsis thaliana
  CDS (1)..(1683)
atggcgagaagtagatcgattagtggttatgggatatggaaatatttgaatcctgcgtattatcttagaagaccgagacgtttggctttgcttttcattgtcttcgtctctgtttctatgcttgtctgggatcgtattaatcttgcccgagaacatgaggttgaagtttttaagctaaatgaagaagtttcacggttggagcagatgttagaagagcttaatggtggtgttggcaataagcctttgaagactctgaaggatgccccagaagatccagttgataaacagcgaaggcagaaagtaaaagaggcaatgatccatgcttggagctcttatgaaaagtatgcatgggggaaagatgagcttcagcctcggacaaaagatggcactgatagctttggtggccttggagcaactatggtagattctttagatacactctatataatgggtctagatgagcagtttcaaaaagccagagagtgggttgcaagctcattggatttcgacaaggattatgacgccagtatgtttgagacaaccataagagttgtaggcggacttcttagtgcgtatgatctttctggggacaaaatgttccttgaaaaggctaaggatattgcagacagattattgcctgcatggaatactccaacgggtataccttacaatattatcaacttgagaaatggaaatgctcacaatccttcatgggcggcagggggagacagtattctcgcagactccggcactgagcagctcgagtttattgccctttcccaaaggacaggggacccaaaatatcagcagaaggtagagaaggttattacagaactgaataagaactttcctgctgatggtttacttcccatctatataaatccggataatgctaatccatcgtactctaccacaacatttggtgccatgggagatagcttttatgagtatttgctcaaagtttgggtgcaagggaacaaaacatctgccgtgaaaccctatagagatatgtgggagaaatcaatgaaaggtttgttaagcttggtcaagaaatcaacaccttcatcatttacgtatatatgtgagaagaacggaaataatttgattgataagatggatgaattggcgtgctttgctcctggaatgttggctttaggagcttcaggttatggccctgatgaagaaaaaaagtttctttcacttgctggagagcttgcctggacttgttataacttttaccaatcgacaccaacgaaacttgctggagagaactatttcttcactgcagggcaggacatgagtgttggcacatcttggaacattttaagaccagaaaccgttgaatcactgttttacctctggcgattaactgggaacaagacatatcaagagtggggatggaatatatttcaagcatttgagaagaactctcgcgtagaatctggatatgtaggcttgaaggatgtcaatacaggtgctaaagacaacaagatgcaaagcttcttcttagctgagactcttaagtatctatatcttctcttttcgccttcatctgttatttcattagacgagtgggttttcaacacagaagcccatccgcttaagattgtggcacggaatgatccgcgtaagccaactatagcactacgccagaggaagtttggtcatcagattaacgtttag

SEQ ID NO: 7377 - protein, 560 aa, Arabidopsis thaliana
MARSRSISGYGIWKYLNPAYYLRRPRRLALLFIVFVSVSMLVWDRINLAREHEVEVFKLNEEVSRLEQMLEELNGGVGNKPLKTLKDAPEDPVDKQRRQKVKEAMIHAWSSYEKYAWGKDELQPRTKDGTDSFGGLGATMVDSLDTLYIMGLDEQFQKAREWVASSLDFDKDYDASMFETTIRVVGGLLSAYDLSGDKMFLEKAKDIADRLLPAWNTPTGIPYNIINLRNGNAHNPSWAAGGDSILADSGTEQLEFIALSQRTGDPKYQQKVEKVITELNKNFPADGLLPIYINPDNANPSYSTTTFGAMGDSFYEYLLKVWVQGNKTSAVKPYRDMWEKSMKGLLSLVKKSTPSSFTYICEKNGNNLIDKMDELACFAPGMLALGASGYGPDEEKKFLSLAGELAWTCYNFYQSTPTKLAGENYFFTAGQDMSVGTSWNILRPETVESLFYLWRLTGNKTYQEWGWNIFQAFEKNSRVESGYVGLKDVNTGAKDNKMQSFFLAETLKYLYLLFSPSSVISLDEWVFNTEAHPLKIVARNDPRKPTIALRQRKFGHQINV

SEQ ID NO: 7378 - DNA, 1875 bp, Arabidopsis thaliana
  CDS (1)..(1875)
atggactcaaatttcaagtggcttttgtttgccatcttgatctctctgacattttcgggttttgttcttcaccatggagttctcgctgaaagtgttaagcctgatgaagctaaacagcttagagacgaggtacgtgggatgttttatcatgcctttgatggatatatgaacaatgcgtttccactcgatgaattgagaccgttatcttgccaaggagaagatactcttggaggctatgcgttgactctgattgactcgttggatacattagctttacttggtgaccgagagcgcttcacttcttctgttgaatggattggtaaaaatcttcagtttaatataaataaaacagtctctgtgtttgagacaactatccgagtccttggggggttactatctgctcatctgattgcaagtgattatgcaacgggcatgagaattccatcttacaacaatgaattactagttttggctgagaatttggcacggagaatgcttcctgcatttgatacaccgactggaatcccatttggatctgtgaatttgatgtacggtgttgacaaacatgaaagcaagataacatcaactgccggtggtggtactttgtctttagagtttggcgtgcttagtcgtttaacaaatgatcctgttttcgaacaagttgcaaagaatgcggtgaggggactatgggcacgtcgttcaaatctcgacttggttggtgctcacatcaatgtctttacaggtgaatggacacagaaggatgctggtataggaacaagcattgattccttctatgagtatctactcaaggcttatatactatttggggatgaggaatatctatacatttttcaagaagcttatagatctgcaatgcagtaccttcacaaggatccttggtatgtagaagtcaatatggattccgcagctattgtctggccagtatttaacagccttcaagctttctggccaggacttcaggttttagctggagacgttgatccagcaataagaactcacactgccttctttagcgtctggaaacgatatggtttcacccctgagggttttaatcttgctacacttagtgtccagtatgggcaaaagagttatcccttaaggccggaattaatcgagagtacatactggttgtacaaagctaccagagatcccaggtatcttgatgcaggacgtgactttgtggctagtttgcaatacggggcaaaatgtccttgcggttattgtcacatcacagatgtagaactgcataaacaagaagatcacatggagagcttcttcctcgcagaaacggtgaagtacttatggctactctttgacttagctgttgactcggataacctcgtagacaatggcccttacaagtacatcttcagtactgagggtcatctcttaccaataacaccacaaatatctctagctcgggaacattgctcttactttggtggatactgtccaagcaattccacaaaactagaacaagaagtccttggagaagacagtagtaacgatgatcacagtaacgattatccttaccacgaatcttttccagttaccggtttgataaagggtttatgtccaggactaacacatgctcagaaatatggtttttcgtatgttctaccggagaagacagatcgtgaagatgttaatcaacctaaaccggtagttacaagcagttcaattgtgttaatctcggatcaaacagtggagaagagaccacaggaagaagaaggatttacttctcagtctgaaccaataatgacaatctctggtggtagtagcaacgaccaaacaggtcaagagctaaccttgttagagtcagaaactgatgatcaaagatcatactcttcttaa

SEQ ID NO: 7379 - protein, 624 aa, Arabidopsis thaliana
MDSNFKWLLFAILISLTFSGFVLHHGVLAESVKPDEAKQLRDEVRGMFYHAFDGYMNNAFPLDELRPLSCQGEDTLGGYALTLIDSLDTLALLGDRERFTSSVEWIGKNLQFNINKTVSVFETTIRVLGGLLSAHLIASDYATGMRIPSYNNELLVLAENLARRMLPAFDTPTGIPFGSVNLMYGVDKHESKITSTAGGGTLSLEFGVLSRLTNDPVFEQVAKNAVRGLWARRSNLDLVGAHINVFTGEWTQKDAGIGTSIDSFYEYLLKAYILFGDEEYLYIFQEAYRSAMQYLHKDPWYVEVNMDSAAIVWPVFNSLQAFWPGLQVLAGDVDPAIRTHTAFFSVWKRYGFTPEGFNLATLSVQYGQKSYPLRPELIESTYWLYKATRDPRYLDAGRDFVASLQYGAKCPCGYCHITDVELHKQEDHMESFFLAETVKYLWLLFDLAVDSDNLVDNGPYKYIFSTEGHLLPITPQISLAREHCSYFGGYCPSNSTKLEQEVLGEDSSNDDHSNDYPYHESFPVTGLIKGLCPGLTHAQKYGFSYVLPEKTDREDVNQPKPVVTSSSIVLISDQTVEKRPQEEEGFTSQSEPIMTISGGSSNDQTGQELTLLESETDDQRSYSS

SEQ ID NO: 7380 - DNA, 1725 bp, Arabidopsis thaliana
  CDS (1)..(1725)
atgtcttgtcctatccatcctaggcgtctcttcctctgcttgcttatttctctcactttcttcgtcgtcgacccttcatcgcagcatatcgaggtcaagaagaaacaaatgcgagagaaagtacgcgagatgttctatcatgcgtatgacaattacatgacttatgcatttccgcatgatgagctaaagcctctaactaaaagtttcacagactccctcagtgagcttggaaatcttaagcttgaacacctgccaacagattataatggatcagctgttactcttgttgaatcattatccagccttgctatattggggaacagtacagaatttgaaaagggggttctctggctctcagaaaatcttactttcgatattgatgcccgggtcaacctttttgagtgcaatataagagttcttggaggacttatctctgctcatcttcttgcaattgatccaaataataggttgattcagggttcctacaacaatcagcttcttcgattagctgaagaccttggaaaacgttttttacccgcgtttgaaacacctacaggattaccatatgcatggattaatttgaagaatggagtaatggagaatgagacaactgaaacaagcacttcaggatgtggttctctcgttcttgaaatgggagcattgtcacggctcactggtgacccgaggtttgaatcagctgcactacgtgcgcttcgtcagctatggaggatgcgaagttcgttagatctgcttgggacaacattggatgtggtaactggggaatggatagagtactcctctagcattggagctggggttgactctttctatgaatacctcttgaaggcttatattctttttggaaaagaagactactggcgaatgtttcattctgcttatctggcatctcagaagtacttcagacatgggccttggtaccatgaagctaatatgtggagtggaaaaccaacttactggcagctcacaagtcttcaggcgttttggcctggtctgcaggttcttgttggagatattgcagctgcaaattcatcgcatcgtgagtttttccatgtatgggaaaagtttggtgtattacctgagaggtatctactcgatcatcaaataatacatccgacaatgaagtactatccactacgtcctgaattagcagaatccacgttctacctttaccaagctacaaaagatccatggtatctagatgttggtgaatcaatggtaaaatctcttaatctctacacaaaggtgccagggggatttgcaagtgttagagatgtgacgaccatgcaattggaagatcatcagcacagtttctttctcgctgaaacgtgcaagtacctatatctcctcttcgatgactcatttgtggccaaaaggaattatatatttacaaccgagggccatcctatacaggttgtgagctcctggcatgagaaactaccagaaacttatttctcaggcaactggaccctttcaaagagtggagcatgggaaagtcgagctagcgcattgtcactacaagtctgtccactgatatctcttaactctagacatcctgagcaacaaagagagagtgcttgccatgttcttgacgagcaaatcaatcataagtgttggagcaacaaagagtgcggagttgatgccactacttgtagactaagaacctgcagcggggttggatactgcggcttatggaatcccttataa

SEQ ID NO: 7381 - protein, 574 aa, Arabidopsis thaliana
MSCPIHPRRLFLCLLISLTFFVVDPSSQHIEVKKKQMREKVREMFYHAYDNYMTYAFPHDELKPLTKSFTDSLSELGNLKLEHLPTDYNGSAVTLVESLSSLAILGNSTEFEKGVLWLSENLTFDIDARVNLFECNIRVLGGLISAHLLAIDPNNRLIQGSYNNQLLRLAEDLGKRFLPAFETPTGLPYAWINLKNGVMENETTETSTSGCGSLVLEMGALSRLTGDPRFESAALRALRQLWRMRSSLDLLGTTLDVVTGEWIEYSSSIGAGVDSFYEYLLKAYILFGKEDYWRMFHSAYLASQKYFRHGPWYHEANMWSGKPTYWQLTSLQAFWPGLQVLVGDIAAANSSHREFFHVWEKFGVLPERYLLDHQIIHPTMKYYPLRPELAESTFYLYQATKDPWYLDVGESMVKSLNLYTKVPGGFASVRDVTTMQLEDHQHSFFLAETCKYLYLLFDDSFVAKRNYIFTTEGHPIQVVSSWHEKLPETYFSGNWTLSKSGAWESRASALSLQVCPLISLNSRHPEQQRESACHVLDEQINHKCWSNKECGVDATTCRLRTCSGVGYCGLWNPL

SEQ ID NO: 7382 - DNA, 1875 bp, Arabidopsis thaliana
  CDS (1)..(1875)
atgtcgaaatctctaccatattcagttaaagatattcattacgacaatgccaagttcagacatcgatctcctttaaaggttttttctcaaagcttgcttactcttagtacaaaacgcaactacgctagctgtagcacggggaagttccttatattaatactgttctttggagtagcatgtctaatgctgatgagtaagagtccaaatgaatctggtcttaatgagaaaggaaaggtcacttttgttgggggacttaggctagggggacttttgagaaagccacctaggcttccacctcgtttatcacctgacgaaggacaattaagaggaagttccactaatggctcaactatttcaaattctgacccaaaatgggcagctaggcagcaaagtgtaaaagaggcttttgaccatgcatggtctggctatagaaagtacgccatgggttatgacgagctaatgcctattagccagaaaggtgtggatggtttaggaggattaggtgccactgttgtggatgctcttgatacagccatgataatgggtcttgataatatcgtctctgaagcaggatcatgggttgagactcatctcttggagagaatcagtcaaaaaggtcaagttaatttgtttgaaactacaatacgtgtcttaggtgggcttctaagtgcataccatttgagtggaggagagcagggtacggtgaacatgacccatgttggaccgaaaccagtcatctatctaaatattgctaaggatttggctgaccgtctactttcggcttttacctccagccctactccagttcccttttgtgatgtcatattgcatgaatcgactgctcatccagctccaggaggagcgagcagtacagcagaagttgcctctgtacagcttgaatttaactacctcagttctatttctggtgatccaaagtatagtacagaggccatgaaggtcttagctcatataaaaacacttccaaagacagaaggtcttgttccaatctatatcagccctcaaacaggtgactttgttggtgagaatatcaggttgggatctcgtggtgatagctactatgagtatttaattaaggtgtggcttcagcaaggagctaagttgaatagtaatttcacatatttgcatgatatgtacattgaggcaatgaaaggagtcaggcatttgcttgtgcaaaattcaattccaaaaggtctggtctttgtaggggagttaccttacgggtctaagggagaattcagtccaaaaatggatcatttggtatgcttcttgcctggtactcttgctctcggtgctaccaagggcctcacaaaggaacaagccctgaaggaaaatcttttgtcctttgaggacctagaaaatctgaaacttgcagaagatttagcgaaaacatgctttgagatgtatgaagtaactgccactggccttgctccagaaattgcttactttcacacaaaggattacactgaggatggtcttgatggtgggaataagagttctatgtatgcaaatgacataatcattaagcccgctgatcgacataatctactgcgccctgaaactgttgaatcactctttgtcctctatcgtatcacaaaagatacaaaataccgagatcaaggttggcaaatttttgaagcttttgaaaagtacacaaaggtgaaatcaggtggatacacatcattggatgatgtaacagaagtgcctcctcatagaagagataagatggagacatttttccttggtgaaacattgaagtacttatacttgctctttggagatgactcagtgataccattggataagtttgttttcaacactgaagctcatccattaccaataagaagaaacacctga

SEQ ID NO: 7383 - protein, 624 aa, Arabidopsis thaliana
MSKSLPYSVKDIHYDNAKFRHRSPLKVFSQSLLTLSTKRNYASCSTGKFLILILFFGVACLMLMSKSPNESGLNEKGKVTFVGGLRLGGLLRKPPRLPPRLSPDEGQLRGSSTNGSTISNSDPKWAARQQSVKEAFDHAWSGYRKYAMGYDELMPISQKGVDGLGGLGATVVDALDTAMIMGLDNIVSEAGSWVETHLLERISQKGQVNLFETTIRVLGGLLSAYHLSGGEQGTVNMTHVGPKPVIYLNIAKDLADRLLSAFTSSPTPVPFCDVILHESTAHPAPGGASSTAEVASVQLEFNYLSSISGDPKYSTEAMKVLAHIKTLPKTEGLVPIYISPQTGDFVGENIRLGSRGDSYYEYLIKVWLQQGAKLNSNFTYLHDMYIEAMKGVRHLLVQNSIPKGLVFVGELPYGSKGEFSPKMDHLVCFLPGTLALGATKGLTKEQALKENLLSFEDLENLKLAEDLAKTCFEMYEVTATGLAPEIAYFHTKDYTEDGLDGGNKSSMYANDIIIKPADRHNLLRPETVESLFVLYRITKDTKYRDQGWQIFEAFEKYTKVKSGGYTSLDDVTEVPPHRRDKMETFFLGETLKYLYLLFGDDSVIPLDKFVFNTEAHPLPIRRNT

SEQ ID NO: 7384 - DNA, 1719 bp, Arabidopsis thaliana
  CDS (1)..(1719)
atggcgaggaataaacttgtaagtggtagtcatgggatatggaaatatttcaacccagcgttttatctccgaagaccaagacgtcttgctttgctcatcatcctcttcgtctctgtttcaatggttgtttgggatcgtcaatctctttcccgagactaccagtttgaagtttccaagttaaatgaagaagttttgcggttgcagcagatgttggaagagataaagagcgtcactgaggatgtgtctgtcaatagtttgaaggatgttcaggaagatccagttgatgctcagcgaatgcagagagttaaagaggcaatggttcatgcttggagttcatatgaaaagtatgcctggggacaagatgagcttcagccccagacaaaggatggtgttgacagctttggtggcctgggtgcaactatgatagatgcattagacacactatatataatgggtctagatgagcagtttcagaaagccagagagtgggtagcaagctcattagatttcgacaaggattatgctgccagtatgtttgagacaaccataagagtggtaggagggcttctcagtgcgtatgatctttctggggataaaattttccttgaaaaggctatggatattgcagacagattattgcctgcatgggacactcaatcgggtataccatataatattatcaacttgaagcatggaaatgctcacaatcctacatgggcggggggagacagtattcttgcagattctggtactgagcagcttgaatttattgccctttcccagaggacaggggacccaaaatatcagcaaaaggtagaaaaggttatttcagtgctaaataagaacttccctgctgatggtttacttccgatatatataaatcccgatacagctaatccatcgcagtctacaataacatttggtgccatgggagacagcttttacgaatatttgctcaaagtttgggtgtttgggaacaaaacttcagcagtgaaacactatagagatatgtgggagaagtcaatgaatggtctgctaagcttggttaagaaatcaacacctttgtcgtttacatatatctgtgagaagagtggaaattctttgatcgataagatggatgaattggcatgctttgctcctggaatgttggctttaggagcatctgggtatagtgatcctgctgaaggaaagaagtttctcacactcgctgaagagcttgcgtggacatgttataacttttaccaatcaactccaacaaaactggctggggagaattatttcttcaactctgggagtgacatgagtgttggaacgtcgtggaacatcttgagaccagaaactgtcgaatcactgttttacctctggcggttaactggaaacaagacatatcaagagtggggatggaatatatttgaagcatttgagaagaactcgcgcatagagtctggatatgttggtttgaaggatgttaatacaggcgttaaggacaacaagatgcaaagtttcttccttgcagagacactcaagtatctctatctactcttctcgccgacaacagtcattcctttagacgagtgggtattcaacaccgaagctcatccacttaagattaagtctcgaaacgatcaggtaaatctcaaacaatccaacaaagtactgctacgaaaaccggcatttagaatacgccagaggcattatggtcggataacaaagaagtaa

SEQ ID NO: 7385 - protein, 572 aa, Arabidopsis thaliana
MARNKLVSGSHGIWKYFNPAFYLRRPRRLALLIILFVSVSMVVWDRQSLSRDYQFEVSKLNEEVLRLQQMLEEIKSVTEDVSVNSLKDVQEDPVDAQRMQRVKEAMVHAWSSYEKYAWGQDELQPQTKDGVDSFGGLGATMIDALDTLYIMGLDEQFQKAREWVASSLDFDKDYAASMFETTIRVVGGLLSAYDLSGDKIFLEKAMDIADRLLPAWDTQSGIPYNIINLKHGNAHNPTWAGGDSILADSGTEQLEFIALSQRTGDPKYQQKVEKVISVLNKNFPADGLLPIYINPDTANPSQSTITFGAMGDSFYEYLLKVWVFGNKTSAVKHYRDMWEKSMNGLLSLVKKSTPLSFTYICEKSGNSLIDKMDELACFAPGMLALGASGYSDPAEGKKFLTLAEELAWTCYNFYQSTPTKLAGENYFFNSGSDMSVGTSWNILRPETVESLFYLWRLTGNKTYQEWGWNIFEAFEKNSRIESGYVGLKDVNTGVKDNKMQSFFLAETLKYLYLLFSPTTVIPLDEWVFNTEAHPLKIKSRNDQVNLKQSNKVLLRKPAFRIRQRHYGRITKK

SEQ ID NO: 7386 - DNA, 1827 bp, Magnaporthe grisea 70-15
  CDS (1)..(1827)
atgtctttcgccgtgcccaaacatgtgccgtcgtttacgaacccgcagcgagactttgaggaccggctttgggcgtcggcgcgatccgggaacaacaacagcagagggaaacaaggaggaggaggagtcttaggcaacgtcggcggctacttcgactcgagcaagcgtaacgcctccctgcccatgtacaaagacaagccgtacgcgtatccgccgtcgcaccgccagcgtccggtctacaggcggaagagcggtttcttactgctgctgctggcggtcggggcgctcttctactttttcggcggcgagtcgcacaaggagagggtcagggcgccgctgaggaagctcagctggctgtctaatgacaagaaggcgctacgggaggcggactggctcaagaggagggaccatgtagtggaggcgttcgagctcagctgggcggcgtacgagaggtacgcttggggttacgacgagttccaccccgtgtcaaagaagggcaggcagatggccacgggcgggctcggttggatcatcgtcgactcgctggacacgatgatgctgatgaacctcaccactcagctcagccacgccagggagtggatcgccaactcgctaaagtacgaccaggatcaggacgtcaacacgtttgagacaacgattaggatgatgggcggtctgctgtcggcgcattacctctcgacgacgaccttcgccgaccggctcctggccgcttttgacacgaaatccggcatcccatacgctagcgtcaatctgggcaagtttcaagggatcgagtcgcacgccgacatgggtgcgtcatccacggctgaggctacgactctgcagctcgagttcaagtatcttgccaagctcactggcgagaagctcttttgggacaaggtggagaaggtcatggaagtggtggacaagcaggcgagcaagacagatggtcttgtgcccatcttcatctcgccttcgactggagaaaaggagaaggtctacctcgacatgtgggatgactcgatggacgggatgcgcaagcacctcgtgacgtacactgagcattcgggcttcaccatcatcggtgagaggccagacgggctgaagggttcgctgtcgcccaagatggaccacctagtctgtttcatgccgggcaccatcgcgctggccgtgacgggcggcaagacggaggcagaggcgaggaagtcgcgcacgtggaccaagcagaacgaagaggacatgcggttggcgcgggagttgatgcagacgtgctggggtatgtacaagtacatggccacgggcttggcgcccgagatcacctttttcgagattgcgacgccgccgccggtctatggtgcgcctcacccgaaaccacctgctcagttggacgcgagcccggacgccgagtggcgcaaggactttgtggtcaagggtctggactcgcacaacctgcagcggcccgaaacggtcgagagtctgttctacatgtggcgcatcacgggcgacgtcaagtaccgcgagtggggctgggagatgttcaagtcttttatgaaccacacggcagtcgaggataatggaggatttacgagtctttcaaacgccaacacgataccgcccgagacgcgggataatatggaaagtttttggctggctgagacgctcaagtatttttacctgctgttctctcccaacgacgtccttccccttgacagcgtagtgatcaacacagaggcgcatccgttgccgaggttcgacatgggcccgttattttcgactggatggagtcgtggttcaaaggaggccaagacggaggatgctaaggagtga

SEQ ID NO: 7387 - protein, 608 aa, Magnaporthe grisea 70-15
MSFAVPKHVPSFTNPQRDFEDRLWASARSGNNNSRGKQGGGGVLGNVGGYFDSSKRNASLPMYKDKPYAYPPSHRQRPVYRRKSGFLLLLLAVGALFYFFGGESHKERVRAPLRKLSWLSNDKKALREADWLKRRDHVVEAFELSWAAYERYAWGYDEFHPVSKKGRQMATGGLGWIIVDSLDTMMLMNLTTQLSHAREWIANSLKYDQDQDVNTFETTIRMMGGLLSAHYLSTTTFADRLLAAFDTKSGIPYASVNLGKFQGIESHADMGASSTAEATTLQLEFKYLAKLTGEKLFWDKVEKVMEVVDKQASKTDGLVPIFISPSTGEKEKVYLDMWDDSMDGMRKHLVTYTEHSGFTIIGERPDGLKGSLSPKMDHLVCFMPGTIALAVTGGKTEAEARKSRTWTKQNEEDMRLARELMQTCWGMYKYMATGLAPEITFFEIATPPPVYGAPHPKPPAQLDASPDAEWRKDFVVKGLDSHNLQRPETVESLFYMWRITGDVKYREWGWEMFKSFMNHTAVEDNGGFTSLSNANTIPPETRDNMESFWLAETLKYFYLLFSPNDVLPLDSVVINTEAHPLPRFDMGPLFSTGWSRGSKEAKTEDAKE

SEQ ID NO: 7388 - DNA, 1959 bp, Magnaporthe grisea 70-15
  CDS (1)..(1959)
atggcctaccacacctgtagcatattcaagaggcggccggctgtcttctttctgctaatcggcatcttcttcttgatttccatccatcgcaaacaatcatcatttgtcaccgagacatattggcagtttcaggcccagcccgacttcaacgatggcaactttcactgggctaacgtccctctgaaccaccccatttcccctcagttcatgaccaagatcccatccacaagagccaaggcgatcccaaagatccagcacgcctttaagaaggaaacccctgagcaaaggaaggttcgcctcgcccgcttagagcaggtccgcagtaacttcacccacgcctggtccggctacaagaagttcgcctggctccacgatgaggtgctgcctgttacaggtggcgaacgcgatgtttttggcggatgggctgctactctggtcgattcgcttgattctctctacatcatgggcctcactgatgatttcgacgaggccgttcaagcagtcatcaagatcgactttaccaagacaagcttggacgagataaatgtctttgagactacgatccgctaccttggtggcttgttggccgcctacgacatcagcggagggcgacgaggaaatcatgcaaccgttcttcttcacaaggcaatcgagctgggtgacatgctctacgtagcttttgacacccctaatcacatgcctatactccgttggaagctcaaggcgctcatggatgctgtcaaagctccatatgggggtttaaatggccaaactcaaggtgtggcggcggatggacagaagcggctcatgtcacccccaaaccaagcagcccccgatggcggcctggttgccgagattggctcactcaccctcgagttcactcgtctcagccagatcaccggaaatcccaaatacttcgacgccgtacagcgcatcatggaccttctagcaaagcagcaagacgacacaagactacccggaatgtggccggtcgtcatcgggcccaaccgagcaaactttagagagcacacgggcttctccatcggaggaatggccgacagcgtctacgagtaccttcccaaggaatacattcttctctccggcaagctcccccagtatcaagaaatgtataccaaggccctcggtgccatgaagcgaaacatcttttaccgaccgcgaatcacgagcccctacggcaaggaggctcccagaattttgctccccggcgacatccaagtcgagcctaacgagcctcttctcggacaggagccggagcccagggtccagcacctcggctgcttcgcgggaggcatggtggcgctcgccgcgcgcgccttctccacgcctcaggagatggacacggcacgccagctcgtcgagggctgcatgtgggcatacgaacactccccgggcggtattatgcccgaagtgatgcacacgacgcgctgcccgcgccgcgccggcaagccctcccccgccaccgccgccgacgacgacctagaccacatcccgccctgcgcctgggacgaggacgcctggcacgccgacgtggccgcgcacgccgagctccccgccgacgacgtgcacaggatcggcgggcagatcgcggagcagcacctggtgccgggcgtcgtgcgctacgacgacaggcgctacatactgcggcccgaggccatcgagagcgtgtttgtgctgtaccgcacgacgggcgaccgcgcgctgctggaccgggcctgggccatgttcgagaccattgtgcggctgaccaagacggacattgcgcacgccgcgctggccgactgcaccgtcaaagaccccaagaagagcaactcgatggagagcttctggctcgccgagacgctgaagtacttctttctgctgtattcggagccggacgtcgtcagtcttgacgagtatgtcctcaacaccgaagcgcaccccttgaggatcgccaagtga

SEQ ID NO: 7389 - protein, 652 aa, Magnaporthe grisea 70-15
MAYHTCSIFKRRPAVFFLLIGIFFLISIHRKQSSFVTETYWQFQAQPDFNDGNFHWANVPLNHPISPQFMTKIPSTRAKAIPKIQHAFKKETPEQRKVRLARLEQVRSNFTHAWSGYKKFAWLHDEVLPVTGGERDVFGGWAATLVDSLDSLYIMGLTDDFDEAVQAVIKIDFTKTSLDEINVFETTIRYLGGLLAAYDISGGRRGNHATVLLHKAIELGDMLYVAFDTPNHMPILRWKLKALMDAVKAPYGGLNGQTQGVAADGQKRLMSPPNQAAPDGGLVAEIGSLTLEFTRLSQITGNPKYFDAVQRIMDLLAKQQDDTRLPGMWPVVIGPNRANFREHTGFSIGGMADSVYEYLPKEYILLSGKLPQYQEMYTKALGAMKRNIFYRPRITSPYGKEAPRILLPGDIQVEPNEPLLGQEPEPRVQHLGCFAGGMVALAARAFSTPQEMDTARQLVEGCMWAYEHSPGGIMPEVMHTTRCPRRAGKPSPATAADDDLDHIPPCAWDEDAWHADVAAHAELPADDVHRIGGQIAEQHLVPGVVRYDDRRYILRPEAIESVFVLYRTTGDRALLDRAWAMFETIVRLTKTDIAHAALADCTVKDPKKSNSMESFWLAETLKYFFLLYSEPDVVSLDEYVLNTEAHPLRIAK

SEQ ID NO: 7390 - DNA, 1584 bp, Magnaporthe grisea 70-15
  CDS (1)..(1584)
atgcggcacatgcgactcggagacttgttgtcctttatagggctcgcgtcgctcacctttgcgtcgcccctgaccaagcgggcgatccagtactcgccaaaccctgaaaaggccgaggcagtcaaggctgccttccgcaggagttgggatggctacatgcaacatgcttttccacacgacacgttgaggccggtctctcaaggctgggctgatgacaggaatggttggggtgccagtgcggtggatgcctttggcacggccattgtcatggacgaggaggcgattgttcagcagatcttggactttgtacccactatcgactttgacaagacttcaacagaagtttctctgtttgagacgacgatccgctatcttggaggtctggtctcagcatacgacctcctgacggagcccaatggcaagcacgcaacgggcaacgagaccttggtcaaggcggtgctctcacaggcagagcgactggcgaccaacctcaagttcgccttcgacacgccctccggcatccccgacaactcggtctacttcaacccgtcaaggaggggcgggtcgcaaaccaacgggatcgcaaccatcggcaccctgcagctcgaatggacacggctgggtgatctgacaggcaaccccgtatttacagagctggcgctgaaggccaactcgtatcttctcgacccgaaaccggcactcggcgagccattccccggcctcctcgggaccaacgtcaacatcacgacgggcctgtttactgatggtaacggcggatggggcggtggcactgacagcttttacgagtacctcatcaagatgtacctgtacgatcccgaacgctttggtcagtacagagaccggtgggtgctggctgccgactcgagtatcaagtacatggcgtcacacccatctacacgccctgacttgacgttcctggctgagtggagggatacttctttacgttacatctcgcagcatcttgcgtgtttcgatggtggcaacttcatcctgggaggcttgacgctccagaaccagaagtacgtcgactttggcctcgcactcaccaacgcctgccacgagacatacatccagacggttacagggatcggccccgaggtcttccgctggcaggacgcatccgccgccaacagcagcacaaacccgccagccccagcagggctccaggagttttacaagcgtgcaggcttctggatcccaccttccaacgacatcggcggcgcggcgatctaccagctgcggcccgaggtgattgaatccttctactacgcgtaccgggccacgggcgacacaaagtaccaggactgggcctgggaggcctttctcagcatcaaccgcacctgcgccgccggcacggcatactcgtccatcagtgacgtcaacgcacctggcggcggtagctccttggacttccaggagagcttctggttcgccgagaccatgaagtactcatacctcatccacgccgaggacgcgccgtggcaggtcaaggccgaccgtaccaacggatgggtgttcaacacagaggcgcaccctatcaaggtccacggacgaccgggttaa

SEQ ID NO: 7391 - protein, 527 aa, Magnaporthe grisea 70-15
MRHMRLGDLLSFIGLASLTFASPLTKRAIQYSPNPEKAEAVKAAFRRSWDGYMQHAFPHDTLRPVSQGWADDRNGWGASAVDAFGTAIVMDEEAIVQQILDFVPTIDFDKTSTEVSLFETTIRYLGGLVSAYDLLTEPNGKHATGNETLVKAVLSQAERLATNLKFAFDTPSGIPDNSVYFNPSRRGGSQTNGIATIGTLQLEWTRLGDLTGNPVFTELALKANSYLLDPKPALGEPFPGLLGTNVNITTGLFTDGNGGWGGGTDSFYEYLIKMYLYDPERFGQYRDRWVLAADSSIKYMASHPSTRPDLTFLAEWRDTSLRYISQHLACFDGGNFILGGLTLQNQKYVDFGLALTNACHETYIQTVTGIGPEVFRWQDASAANSSTNPPAPAGLQEFYKRAGFWIPPSNDIGGAAIYQLRPEVIESFYYAYRATGDTKYQDWAWEAFLSINRTCAAGTAYSSISDVNAPGGGSSLDFQESFWFAETMKYSYLIHAEDAPWQVKADRTNGWVFNTEAHPIKVHGRPG

SEQ ID NO: 7392 - DNA, 1860 bp, Magnaporthe grisea 70-15
  CDS (1)..(1860)
atgcaccctatcatgaatgaatttacggtatcgctgcacattggtacaaccattgtgttgggttgcactatcaagtccagggcatttggctgtactttggggatagaaatatcagactctatcagaaacccccacaccctagttatgccatcattacggcgttggcgaccattgaccctggtgacggtcgcctggtggcagaaacgcccagaaaggtatcccgtggcatctctccggtcactcccgccaattccgacaccagctccagccatcccacacattcaaaaggcacagccggatgaaagtaccgaggccaatgcggtgcggctgcagcgcctggcggccgtcaaggagagcttccagcacagttggcgcggctacaaagagcacgcatggctccacgacgaggtttcgcccatcagcggagccgcggtcgacccttttggcgggtgggcggcgacgctcgtcgactcgttggacatcctgtggatcatgggcctaaagagcgactttgaagccgccgtcaaggcggtaggcaagatcgattttggcagggccgaggggcggactatcaacatctttgagacgacgatccggtacctgggcggcttcctggcggcgtacgagctgagcgggcacaagtacccagggctcctcacaaacgccgttgaggtgggcgacttgatcatgtgcgcgttcgacacgccgaaccgcatgcccatctcacggtgggacctggcggcatatgtctccggcgcgcgtcaggaggcaccgcgccagatgctgattgcggagctcggctctatcggcctggagctgaccaagctttcgcagctgacgggagacaacagatactacgacgccgcgcagagggttgcagacgagctggagaagtcacagcaaaagacaaagctgccgggcatgtggcccgtctcggtcaacgccaagcagctcaggtttgatgtcgatcgcatgtttacgttgggtggcatgtcagactcggcgtacgagtatctccccaagcagtacatgatactcggtggagttttggagcaacctaggaagatgtacgaggattttcttggagttgccaagaaatacctattaaagagagttctcaaccggcacaatgagccgctcatcagctccggggatatttacgtcacgggaggcaacggcgccgccgaggcggtcgctcggtattcaccaagggcacagcacctgacgtgttttgccggtggtatggttggcatcggggccaagatattcaacaagccagatgatctcgacattgccctgcagctgacggacgcttgcgtctgggcctacaactcgacagcgtcaggaatcatgcctgagatattttctttcgtggactgcgggtctgtcacgaagcctcggggcgaggactgcacttggagcgagagcaaatggcatgatgctatcgggagtacattgggggtggggaatgacgatgcagggagggatacactcatcgagcatacgattaacaagaaacggctttcgcccgggttcacagatatcaacgacaggaagtacatcctgagacccgaggccatcgagtccgtattcatcatgtatcggattacaggggacgcaaaatggatggacaaggcttggaatatgttcagctccattgaaaagcacacgcggaccaagattgcggcggcaagcctggacgatgtcaccaggagagacccgcacaaggtggacagcatggagagcttttggctcgctgagacgctcaagtacttttatctcgtgttttccgacttcaatgtcgttgaccttgacgattgggtactgaacacggaggctcaccctttgaagagaccgtag

SEQ ID NO: 7393 - protein, 619 aa, Magnaporthe grisea 70-15
MHPIMNEFTVSLHIGTTIVLGCTIKSRAFGCTLGIEISDSIRNPHTLVMPSLRRWRPLTLVTVAWWQKRPERYPVASLRSLPPIPTPAPAIPHIQKAQPDESTEANAVRLQRLAAVKESFQHSWRGYKEHAWLHDEVSPISGAAVDPFGGWAATLVDSLDILWIMGLKSDFEAAVKAVGKIDFGRAEGRTINIFETTIRYLGGFLAAYELSGHKYPGLLTNAVEVGDLIMCAFDTPNRMPISRWDLAAYVSGARQEAPRQMLIAELGSIGLELTKLSQLTGDNRYYDAAQRVADELEKSQQKTKLPGMWPVSVNAKQLRFDVDRMFTLGGMSDSAYEYLPKQYMILGGVLEQPRKMYEDFLGVAKKYLLKRVLNRHNEPLISSGDIYVTGGNGAAEAVARYSPRAQHLTCFAGGMVGIGAKIFNKPDDLDIALQLTDACVWAYNSTASGIMPEIFSFVDCGSVTKPRGEDCTWSESKWHDAIGSTLGVGNDDAGRDTLIEHTINKKRLSPGFTDINDRKYILRPEAIESVFIMYRITGDAKWMDKAWNMFSSIEKHTRTKIAAASLDDVTRRDPHKVDSMESFWLAETLKYFYLVFSDFNVVDLDDWVLNTEAHPLKRP

SEQ ID NO: 7394 - DNA, 2064 bp, Gibberella zeae PH-1
  CDS (1)..(2064)
atgattcgagatccgttcaacctccaccgaaacataaacacttttaatcgaccgccaactcgaaatattccttcgccatcgcgggtcgaggctgatgaagtagctatggccttctctatgccccgaaccgctccggacttcaatagccgtcaaagagagctcgaagacaaattctggggttctggacagagatctggcaagtcagatcgattaccgatgtacaaagacaaaccctacgcgtcgccatacgacgacgaggaccggccatggtggaaacgtaagaaggtgctgggcatcattgccctcgtctttacgttactatactggttcggatcttcctccaagtcacctaagaagagaaccgtaacgaccgactggagctttgcaggcttgtccaaacatgataagaaggtggattgggatcacagaagagaccgcgtggtggaagcattcgagttgagctgggatgcttacaggcgtcatgcttggggatccgacgaatttcaccctatcaccaagacaggcgagaacatggcaccaaaagggctcggttggatcatcattgactcactggacaccatgatcctgatgaacttgacatctcgccttcaagacgcccgccaatggatctcggagtctttgacgtgggatcaagatcaagatgtgaacaccttcgaaaccaccattcgcatgatgggcggtcttctcagcgcacactacctatccaccgagtttccaggtcttgctccactcgcggaggatgacgagggagccattggggaggacttgtatctggagaaggccaaagatctagctgatcgtctcatgagcgctttcgaatccccttctggtatcccctatgcaagcgtcaatcttcaaaaattccagggtatcgaatcgcacgccgataacggggcgtcgtcgaccgccgaagctacaaccctccaactcgagttcaagtaccttgcaaaactcacgggagagaaggacttttgggatagagttgaaaaggtcatgaaggttgtcgatgaccagggggccgaagacggcttggttcccatcttcatctatgcgagcacaggaaagttcaaggacgaaaacatccgactcgggagccgtggcgactcatactacgaatatcttattaagcagtatctccaaacgaacaagaaggagcctatttatagagatatgtggtacgacgcccttgagggtgtccgcaagcaccttgtcacctacacgtcgaaacagaagttcaccatcatcggagagcgacctaatgggttgagcaatgcccttagccccaagatggatcatcttgtatgcttcatgcccggaacaatggcattggcggccacagagggtctcacggaggccgaggcacgcaagctccctacgtggtcaaagaagaacgaagaagacatgaaattggcgcgtgagttaacggagacatgctggggcatgtacaaatacatggcaactgggctggcagccgaaattacctattttgaaattgatgataaaccaccggcttatggcaaccctcgccaggggccagccaactttgaaccaagcccagaggcggaatggcgtaaagatttcactgtcaagtctggcgatgttcacaatctccaacgaccagagacagttgaaagtctgttctacatgtggagaattaccaacgataaccaataccgtgaatggggctgggaaatgttcaaatctttcatgaaccacacagctgtgaggaacggaggaggttttacgagcttgcgcaacgccaatgtcgtgccacccaaggtgcgcgacaatatggaaagcttttggttggccgaaacgctcaagtacttttacctcttgttctcacccccggatctcctgcctctggacaaggttgttatcaatactgaaggacacccgctgcctcggtttgatatgggacatctgtttacgactggatggcaaagacagccaagggatgccagtggtaagattgccaagatggtcaaaattgatggcgatgtgaaggaggcggtcatgcaggataccaaaaaggtgacttag

SEQ ID NO: 7395 - protein, 687 aa, Gibberella zeae PH-1
MIRDPFNLHRNINTFNRPPTRNIPSPSRVEADEVAMAFSMPRTAPDFNSRQRELEDKFWGSGQRSGKSDRLPMYKDKPYASPYDDEDRPWWKRKKVLGIIALVFTLLYWFGSSSKSPKKRTVTTDWSFAGLSKHDKKVDWDHRRDRVVEAFELSWDAYRRHAWGSDEFHPITKTGENMAPKGLGWIIIDSLDTMILMNLTSRLQDARQWISESLTWDQDQDVNTFETTIRMMGGLLSAHYLSTEFPGLAPLAEDDEGAIGEDLYLEKAKDLADRLMSAFESPSGIPYASVNLQKFQGIESHADNGASSTAEATTLQLEFKYLAKLTGEKDFWDRVEKVMKVVDDQGAEDGLVPIFIYASTGKFKDENIRLGSRGDSYYEYLIKQYLQTNKKEPIYRDMWYDALEGVRKHLVTYTSKQKFTIIGERPNGLSNALSPKMDHLVCFMPGTMALAATEGLTEAEARKLPTWSKKNEEDMKLARELTETCWGMYKYMATGLAAEITYFEIDDKPPAYGNPRQGPANFEPSPEAEWRKDFTVKSGDVHNLQRPETVESLFYMWRITNDNQYREWGWEMFKSFMNHTAVRNGGGFTSLRNANVVPPKVRDNMESFWLAETLKYFYLLFSPPDLLPLDKVVINTEGHPLPRFDMGHLFTTGWQRQPRDASGKIAKMVKIDGDVKEAVMQDTKKVT

SEQ ID NO: 7396 - DNA, 1845 bp, Gibberella zeae PH-1
  CDS (1)..(1845)
atggcgggtcccttacggcgaggccgtctctggattggtgtcgtcctcatctggatctttggcttttggtactggtcaagtacggactcaactttcgccttgttcggcaaggatgatccccttgctggaacaggcgccagtgcttggacgcgaagactacccaagtatccaattcctcaagagaaactggctgtgttgcctgagattaaaggagatgtcaaggtacccaagattcaagccaatgcgccggttgagagcgctgcggcaaaggaaacgcgattggcacgtcttgctgccgtcaagaagagtttcgaacacagctggagcggttattccaattacgcatggatgcatgacgaagtgaccccgttgactggcaagtccaaggacccttttggtggttgggctgcaacactggtcgacgctcttgacacgctctggattatggacatgaaggaagagttcaccaaagctgtcgccgctgccgatggcattgatttcaccagaagtcccatgaccactatcaacattttcgagacaactattcgttatctaggcggtttcttgtcagcatatgaattgagcggaagagcgtatcctattctgctcaagaaggccatcgagcttggagatctcctcatggtggcatttgacacacccaaccatataccagttactcgattggagtggaagaaagccgcttacggccagtcccaatctgcctcacgagagactcttgtctctgagttgggctctatgagtctggaacttaccaaactatctcaaatcactggtaacatgaagtactacgacgccgtcaagaggctcggagaccagtttgagtctacgcaacttaacactcgtcttcctggcatgtggccgatagtcgttgatgcctacacaccagcattccacgctggctcggaattcacccttggtggtatgtctgattcattgtacgaatacctccccaagtggtatcttcttcttggtggtcaacttgagcagcctcgaaagctgtacgagaatttcattcctgtcgccatcaagcaccttttcaagagagcaatgacaccctcggacaagcccatcatcatttctggcgactaccaggtaacggatttgccaggagaacagcccaagtatacctctgtagctcgaggtcagcatctaacctgcttcgctggtggcatgatggcaatggctagcaagatattcaaccgcccggctgacctagagattgccactcaacttacagatggctgcatctgggcttatcaggccaccaagactggccttggacctgaggtgttcaatttcatctcatgcggcagcgtcgatgtcaaggagacaggcgattgcacctggagcgaagagcgatggctgaaggccattgaagagcagcatgcgcctgacttcaaggctcccccgatgaggggacctgagtggaagagacctaccgtccaggatgtcgtgaaaaagcataatctaccacagggcatgattgatgtgagcgaccctcgatatatcttgagaccagaggctatcgagtccatcttcgtcatgtatcgaaccactggcgacgcgcagtggatggagaaggcatggaccatgtttgaaacaattgagaaggtgacaagaaccgagatcgcagcttcggcaatcgacgatgttacgaaagcggagcccaccaagatggacagcatggagagtttttggttggccgagactctcaagtacttttatcttattttcagcgagtttgatgtgattagccttgatgagtgggtgctgaacactgaggcacatcctctgagtcgtcttgatgtaaaacgagggcagtag

SEQ ID NO: 7397 - protein, 614 aa, Gibberella zeae PH-1
MAGPLRRGRLWIGVVLIWIFGFWYWSSTDSTFALFGKDDPLAGTGASAWTRRLPKYPIPQEKLAVLPEIKGDVKVPKIQANAPVESAAAKETRLARLAAVKKSFEHSWSGYSNYAWMHDEVTPLTGKSKDPFGGWAATLVDALDTLWIMDMKEEFTKAVAAADGIDFTRSPMTTINIFETTIRYLGGFLSAYELSGRAYPILLKKAIELGDLLMVAFDTPNHIPVTRLEWKKAAYGQSQSASRETLVSELGSMSLELTKLSQITGNMKYYDAVKRLGDQFESTQLNTRLPGMWPIVVDAYTPAFHAGSEFTLGGMSDSLYEYLPKWYLLLGGQLEQPRKLYENFIPVAIKHLFKRAMTPSDKPIIISGDYQVTDLPGEQPKYTSVARGQHLTCFAGGMMAMASKIFNRPADLEIATQLTDGCIWAYQATKTGLGPEVFNFISCGSVDVKETGDCTWSEERWLKAIEEQHAPDFKAPPMRGPEWKRPTVQDVVKKHNLPQGMIDVSDPRYILRPEAIESIFVMYRTTGDAQWMEKAWTMFETIEKVTRTEIAASAIDDVTKAEPTKMDSMESFWLAETLKYFYLIFSEFDVISLDEWVLNTEAHPLSRLDVKRGQ

SEQ ID NO: 7398 - DNA, 1638 bp, Gibberella zeae PH-1
  CDS (1)..(1638)
atgttgttttcgtctttcttttatagcctcgggctaccactccttgtatctgcttcgcagaagaacctaaaatccgacagtaaccttcgttatccggaacaacgtggacgtgactatgactacaccagctttgaaccagaccagaacaagcgcgcagatgagattgttgaaatgttccgtttcgcgtggaacggatactatgaacatgccttccctcatgactctctacgacccaagtacaacaactacacagatgatcgaaatggatggggcgtcacagctgttgatggcctcgacactgccattctgatggagcaaactgacattgttgaaacaattctggacttcattcccactattaatttcacaaagacgaataccccaaaacctagttccgtcagccttttcgagactaatattcgttatcttggtggtttgctcagcgcatacgatttgctcaagggaccgtttcgtcatctcaagattgatgagaagaaggttgatacgctactcacccaagccacgacactagcagacactctcaagtttgcttttgacacaccaactggcattcccctgaacgacatctttatcgagaacagaacttccagtgatggtagtgatagtttgacgcaagatggacagcgaaccacaagcttagctgtcatgggttcgcttgttctcgaatggcaacatctctctgatttgaccggagaccctcagtacggagaacttgccaatcgcgctgaggattactggctttcaccctcttcagaagtgtggcctggtctcacaggcggaaacttcagtatcgagacgggagaaattttggataactacggagggtggacatcgggtaacgattcggcttacgagtatcttatcaagatgttcgtctatgatcccgagcgcttcagtcactatggtgaacgatttaccaaggctgccgactcaaccatcaagcatctggtctcacatccctcctcgagaccagacttgaccttcgtgtcgacatttgcaggcacagagcaagttaattatacagagtttcttgcctgctttatcggcggttccttcattctgggaagctcagcgatggatcgtccagattggctagactatggcctgtcttttagcgagtattgcgccaacggctaccgatacaccgcatcgggcattggcccaacactgtacagctgggatacagatctcctgtcgcagcctgaaaacaacaaccaaacagagttgtattcacgcgcaggctttttcattccggacggacttttcgcagctggccaatccccagaggcggtggagagctggtattatgcctaccagcataccaagtctcagtactggcgcgacgtggcttgggcttacaccctagcgcagaacaggacgatgcgtgtcggtgacggatttgcgagcatcaacaatgtgctctctccgtctggcgacggaccccgagggggcatcatggctagtttcatgctcgctgaaacactcaagtaccaatggctgatccagacagaaagcaagggcgaatgggatgtgttgggcggagacgagggaactaatctgtttgtttacaacactgaggctcatccgctaaaggttgctgcccggaggcctgtttaa

SEQ ID NO: 7399 - protein, 545 aa, Gibberella zeae PH-1
MLFSSFFYSLGLPLLVSASQKNLKSDSNLRYPEQRGRDYDYTSFEPDQNKRADEIVEMFRFAWNGYYEHAFPHDSLRPKYNNYTDDRNGWGVTAVDGLDTAILMEQTDIVETILDFIPTINFTKTNTPKPSSVSLFETNIRYLGGLLSAYDLLKGPFRHLKIDEKKVDTLLTQATTLADTLKFAFDTPTGIPLNDIFIENRTSSDGSDSLTQDGQRTTSLAVMGSLVLEWQHLSDLTGDPQYGELANRAEDYWLSPSSEVWPGLTGGNFSIETGEILDNYGGWTSGNDSAYEYLIKMFVYDPERFSHYGERFTKAADSTIKHLVSHPSSRPDLTFVSTFAGTEQVNYTEFLACFIGGSFILGSSAMDRPDWLDYGLSFSEYCANGYRYTASGIGPTLYSWDTDLLSQPENNNQTELYSRAGFFIPDGLFAAGQSPEAVESWYYAYQHTKSQYWRDVAWAYTLAQNRTMRVGDGFASINNVLSPSGDGPRGGIMASFMLAETLKYQWLIQTESKGEWDVLGGDEGTNLFVYNTEAHPLKVAARRPV

SEQ ID NO: 7400 - DNA, 1761 bp, Gibberella zeae PH-1
  CDS (1)..(1761)
atgctggccactttccaagggcgacccggtcgtcgctatattagcctttttcttttcatcgccatcacatggttccttgtccacaactttcgtccctacgaacgttaccgtactgtgagaataggaacgtacaactaccttcctagtagttacgattggagcaagcagcagatcttccaccccgtcgaagacatcaggggccccccgaatggcacattcaagctgctgcccaagattcaaaaagaacgccccaacggttacacagaagacagcgagacgactgctagaaaagcggccatcaagcaggctttcaccaagacctgggaggcctataagaagcatgcgtggggttgggacgagctggcaccagtctccctcaagggaaagaccactttctctggctgggccgcccagattgtcgatgctctcgacactctctggattcttgacatgaaggatgagttcaaagaagctgtccagattgttgccatgatcgattgggcacgtactggtgatagctacctcaacctgtttgaggtagctattcgtcaccttggtggcctcctctctgcttacgagctctctgacgaagctgtcttgctcggtaaggccattgagctaggcgagatgctctacgctgcattcgacacccccaaccgcctgccatctcactggctttacttcaagtctgcgaaaaatggagaacagcaagccgatgaagaaatgtctggcgctgcaggtggttcaatgtgcctcgagttcactcgcctatcccagattactggcaaccccaagtactatgatgccaccgaacgcatcaagaagttcttttatcgtaaccaggacaatactaaaattcctggtttgtggccacatgtcatgaactatcgtgaggaaaacgttgacgacgatcgctttaccctcggagctggcgcggattccctctacgagtacctacccaagatgcacgccttgctaggcggtctagatcctgaatacgttgagatgaccaccaaagctctcgacaccgccactaagaacttgctcttcaaacctcgtaaccctagtgacctggacatactgatgtcaggcaacgcagtgccaggcgaggatggtgccaagcccaagcttactgctgaaatgcagcacttgacatgctttatcggtgggacttatgctctggctggcaagcttgtttcacgagctgatcttgtagacctcggttctcgtttaacagctggttgtgtctgggcatacgatgctttccccaccaatatcatgcctgagattgctgagcttgaagcatgcgagtctatcaccagcaagtgccgctggagtgataagcctgtggagaaaaaggacaagctgcctgagggtttcgtccgagtccgcaactcagaatacagactgcgccccgaggctattgagagtgtcttctacatgtggcgtatcacaggcgacgatgtctggcgcaccgctgcttggcgcatgtgggataacattgtcaagcagactgagactcaggaggcctttgctacaatcactgatgtcaacagaaagggtagcgataagcgcgataacatggagaccttttggatgtccgaaacaattaagtacttctacctcacctttgaggatcccaatgttatcaacctggatgattgggtgcttaataccgaggcacaccccctgaagcgtcccaagggcgaggagctcgagactcctcagaagaagacatcgtggtggaaattcggccattaa

SEQ ID NO: 7401 - protein, 586 aa, Gibberella zeae PH-1
MLATFQGRPGRRYISLFLFIAITWFLVHNFRPYERYRTVRIGTYNYLPSSYDWSKQQIFHPVEDIRGPPNGTFKLLPKIQKERPNGYTEDSETTARKAAIKQAFTKTWEAYKKHAWGWDELAPVSLKGKTTFSGWAAQIVDALDTLWILDMKDEFKEAVQIVAMIDWARTGDSYLNLFEVAIRHLGGLLSAYELSDEAVLLGKAIELGEMLYAAFDTPNRLPSHWLYFKSAKNGEQQADEEMSGAAGGSMCLEFTRLSQITGNPKYYDATERIKKFFYRNQDNTKIPGLWPHVMNYREENVDDDRFTLGAGADSLYEYLPKMHALLGGLDPEYVEMTTKALDTATKNLLFKPRNPSDLDILMSGNAVPGEDGAKPKLTAEMQHLTCFIGGTYALAGKLVSRADLVDLGSRLTAGCVWAYDAFPTNIMPEIAELEACESITSKCRWSDKPVEKKDKLPEGFVRVRNSEYRLRPEAIESVFYMWRITGDDVWRTAAWRMWDNIVKQTETQEAFATITDVNRKGSDKRDNMETFWMSETIKYFYLTFEDPNVINLDDWVLNTEAHPLKRPKGEELETPQKKTSWWKFGH

SEQ ID NO: 7402 - DNA, 1644 bp, Candida glabrata CBS 138
  CDS (1)..(1644)
atggcgtatatactgagtgccgtggtgctatgtgtgtcgcttgcgctgtggttttataacctgcagacgtctggtttcgatggagatgccgctgctatgaggaacaaagtcgaggaagtattcctcgagagctggagagattatagtcagtatggttggggttacgatgtttacagcccgacctctcatcacagacataatatgcttggggaggagcgccctatgggttggatcatagtcgattccctggacactttgatggttatgtacaactcgagcgccaattacaaggatgagtttagagagcacatcaatgcagctacagaatggattgatcgcgaattaaactttgattatgacaattcggtgagcttgtttgagactactattagattgttgggtgggctcctctccgcatatcacttgtctaccgagttagatctgccacaacgttactcaaatatatacctagataaggcccaagacttaggtcgtcgtttggctgttgcattggaagtgaataaagatggggtcccctttcagaccgttaatttgaagcacggcattactgcgatggatggtggcgggtatactaccacaccaactgctgaattcaccactctacagatggagttcaagtatttagcttatttgacagacaattcaactctgtggcaactatctgagaaactatatgctccattatacctcaacaataacttgatgaatcaattcaacggcttggtaccaatcttaacaaattcccaaaacggtaggttcagtactgctacaataagactcgggtccatgggagactcgttctacgagtacttgttaaagcaatatcagctcaccggtgaagaaatatatcgtcaattgtacttggtgtcacttgatgggatcgcgaagcatttacttggccgcacaactccaagcaaccttctgttcattggtgaaagggagcagggtctaaatggacctttttccacaaaaatggatcatctagtatgtttcattggtggtgtgttaggtatgggcgctacgaatggattacatttagagcaagcaagaaaagcttcattctggaattctgaaagagagagtgagtggctacttgctaaggagttaacgaagacttgttacgagatgtaccatcaagtccctacgggactcgcaccagagattgtggttttcaatgatggcaaagctaggccaggtcatgattggtggaagagtaaaaaaggtgatttctggatcaaacccaatgatgcccacaaccgtcaaagacctgaggctgtagagtctattatgttcctatatcaactcagtggtaatgaaatgtatagggaatggggttatgagatattccaaaacttcatacaaaacacttgtgttgattgtgacgatcctaagagccgtaagtatgttaacttaggcgatgttacgaagcccggttcacttggtgataacatggaaacattctggttatcagagactttgaagtacatgtattacttgtttaatgacaacgtagatttgacttcgatggtattcacaacagaggcacacattttcccaagactctcgcatgctacattgctcaagaagggcttcgagaccaattggcacaaatcaaagaaataa

SEQ ID NO: 7403 - protein, 547 aa, Candida glabrata CBS 138
MAYILSAVVLCVSLALWFYNLQTSGFDGDAAAMRNKVEEVFLESWRDYSQYGWGYDVYSPTSHHRHNMLGEERPMGWIIVDSLDTLMVMYNSSANYKDEFREHINAATEWIDRELNFDYDNSVSLFETTIRLLGGLLSAYHLSTELDLPQRYSNIYLDKAQDLGRRLAVALEVNKDGVPFQTVNLKHGITAMDGGGYTTTPTAEFTTLQMEFKYLAYLTDNSTLWQLSEKLYAPLYLNNNLMNQFNGLVPILTNSQNGRFSTATIRLGSMGDSFYEYLLKQYQLTGEEIYRQLYLVSLDGIAKHLLGRTTPSNLLFIGEREQGLNGPFSTKMDHLVCFIGGVLGMGATNGLHLEQARKASFWNSERESEWLLAKELTKTCYEMYHQVPTGLAPEIVVFNDGKARPGHDWWKSKKGDFWIKPNDAHNRQRPEAVESIMFLYQLSGNEMYREWGYEIFQNFIQNTCVDCDDPKSRKYVNLGDVTKPGSLGDNMETFWLSETLKYMYYLFNDNVDLTSMVFTTEAHIFPRLSHATLLKKGFETNWHKSKK

SEQ ID NO: 7404 - DNA, 1656 bp, Kluyveromyces lactis NRRL Y-1140
  CDS (1)..(1656)
atgaggtggatcgctaagccaatcgtcagtgtggtggtggcggtattagcgtaccaaataaccctaaggtacttgaaagacacgtataagtctcatgaccctcaatttgccatagaaagaacttttctagaatcctggatcgattatagatcaaatggctggggtttggatgtttatggccctatctcgaaaaagggtagaaacatgggcaaatcaggggatcctttgggatggatcatcattgactcagttgatacaatgatgttgatgcataataagactaaagatgatactcacaggaaacgctttgcggaagaaataaatatagccgaaagttggatcaaaaacactttagattataatgttgactccgaagtcaaccttttcgaaaccactattagaatgctgggaggtcttctttcctcctactattgctcagaaacgtaccatatcggtaattccacggtgtatttagaaaaagcgatcgatcttgctgataggctagtgccttcattccttcagtctgagaccggaattccatattcgagtataaatttagcatctggcaaagctattaagaatcatgccgataatggtgcctcttctactgctgaatttacgactttacagatggaattgaaatatttgagttacatcacaggtaatactacttactggaaattgtgtgagaaggtttacgatccactatacaggaataacaatctagtaggacgccactaccagggactaatccctatcttcaccaatccagataccggtgttttccaaggatcaataattagatttggttctcgtggagactcgttttacgaatatctcttgaaacaaaatttacttaccggtgaagttctctacagaaagctctacgatttttcgatggatagtatgaagaggcatctactaggcgagagtaaaggtcaattgcatcttaaatacattggggagaaggattatggcttagctggaccaacatcgtccaaattcgaccatttggtatgtttcatgggtgggttattagcgatgggagccacgaatggtaaaccatactctgaagctgcgaatggtcctgactggaatcctacgaaacaaaatgactgggaactcgctgaggatttgacaaagtcttgttatgaaatgtatcaccaaatcccatcaggattgtcaccagaaatcgttgttttcaatagtaactaccctaacgctgaacctaactggtggagatctgagtccgaagactatttcgtaaagccctttgacaaacacaacatccaacgcccagaaactgtcgaatctctaatgtttttgtatcatttatcaggaaatgaacaatatagacactggggatgggaaatctttagcaatttcatcaagcatactaaagtcattaaagtcgcggcggatggcgaagaaaaggtcgcatacacttcgttgcataatgttatttcattaccaacagacaaagctgacaatcttgagagtttctggctagcagagactttgaaatatctttaccttttgttcgacgatgatgttgagctaagcaagattgtatttaatactgaggcccatccattccctgtatttaatcaatcaagactcaatgagttaaacttaaccacaggttggaaattataa

SEQ ID NO: 7405 - protein, 551 aa, Kluyveromyces lactis NRRL Y-1140
MRWIAKPIVSVVVAVLAYQITLRYLKDTYKSHDPQFAIERTFLESWIDYRSNGWGLDVYGPISKKGRNMGKSGDPLGWIIIDSVDTMMLMHNKTKDDTHRKRFAEEINIAESWIKNTLDYNVDSEVNLFETTIRMLGGLLSSYYCSETYHIGNSTVYLEKAIDLADRLVPSFLQSETGIPYSSINLASGKAIKNHADNGASSTAEFTTLQMELKYLSYITGNTTYWKLCEKVYDPLYRNNNLVGRHYQGLIPIFTNPDTGVFQGSIIRFGSRGDSFYEYLLKQNLLTGEVLYRKLYDFSMDSMKRHLLGESKGQLHLKYIGEKDYGLAGPTSSKFDHLVCFMGGLLAMGATNGKPYSEAANGPDWNPTKQNDWELAEDLTKSCYEMYHQIPSGLSPEIVVFNSNYPNAEPNWWRSESEDYFVKPFDKHNIQRPETVESLMFLYHLSGNEQYRHWGWEIFSNFIKHTKVIKVAADGEEKVAYTSLHNVISLPTDKADNLESFWLAETLKYLYLLFDDDVELSKIVFNTEAHPFPVFNQSRLNELNLTTGWKL

SEQ ID NO: 7406 - DNA, 2541 bp, Debaryomyces hansenii CBS767
  CDS (1)..(2541)
atgttctatacttcaataaacaatcgaattgcacttgtgacatgtatacttgcgtgtttctgttgcgtgcaatcattgaaataccaatacgaatcatccttcactccaaatcatatacaatatttgaaaaatgagacgagacttctattcaaacatgcatggtcgtcatacatgcaatatggatttccagcagatgaggtattaccggatacgtgtgagccttatggcccagattacaataatgtcgataacgtggtaagaaatgatgctttgggcaatacttctctgacgattctagacaatttggatactttaatgataatggaagaatgggaagagttagagagggctttagaataccttaaatcagaagagaagaccttatttaataaagatacaatagtgcaagtttttgaaactaccattcggtcgttaggtgggcttttatcgacacatctacttttgacagatgttactaaaggcaataaaatattgccatcaagataccaaaaattcaaggaaatatctgataactatgatgggtccttatcaaatatggcatatgatttgggacttaagttacttccagccttcaagacatccacagaaatacccgttcctcggattaatttggcaaaaggggtcttaaaagtaccatcaaatcttcaaaaagaaacttgtacatctggtgctgcgtcgccggttcttgaatttactcttctctcaaagctctcaggagacccgcaatttgaatactattcacaattgacgttttggaaactttggtcttccagactggcgcttgatttaatgccaatgtcaatagatccaattgcaaataaatggaaggatcaaattacaggaataggagcttccgttgattcattttatgagtatgcggctaaggcatctatactatttaatgatgattatatgtggcatgtatttaaaacctcgtataaagcattactagcccacctggtccaaggaggtggagataatgaaggagtgatgatatttggaaatgtaggggttaatgatggctcattggcttctatatggatagatctgctcggtgcattttggtcgggtctacaagtcttgactgggcaattgcaagatgcaattaaaacgcacttgatgtacttaaaattatgggatcattttgacctgattcctgaaagatggaactttttactaaataaatctcaattagagaacgatgattctgaagcgataatgcttgagtggtatccactaaggcccgagtttatcgagtctacatattacttatatagagcgactcgagacccaatgtacctacagatcggagctagagtacttgaattattacaaactaagtacaagacaatttgcggattccatggattacaggacataagaacaggaaattttcagaatagaatggagaccttcgttatgagtgaaacattgaagtatttaatgttattatttgatgctgataatgagatatttcttcatacaagcatgatgagcaataagaactggattttttcaaccgaagcgcatcctatgtggtttgataaacgattagatccatacaacttcacacattccagatctgccgataaacaaaacatgggtacgttgaaaaacctgctttttgctaagatgaagtcaaagtttagtagaagcaagcggaaattgaccactgctgatgaaaagacattctaccgaaacattactacaccacgagtgatcacatacgagatgcccggaataatagaaaatggggatatacacaagatcgatccattggaaagtaagtttgacaaatgtgaagtaaacgtatttaataataagccatcgatgttaacagtatccgggtattaccaattgagctctttcttctatccagatcatgcattcaaatactccctaataaagccacgttatcttctgaaatcggctcttgatggaagctgtgtagaattgacgccgtctttcctcagaatttttgcaatgtcaggacctgataatactaccaaataccatcaccagtgtcctagaacatcgaccactacataccttgaactagttttaggaaatatcgaaaaagcccaaagtgtcgagatttcaagattaaagtataagagaaagcaaccaactgagtatatttctcttcaagaagatgatttatgggttcctgacttttcctcgattagactaaagattgagaaattatcgtctggcttgatcgattccgaaaatatgttaatcactgactcattcatacaatccattagagttgacgattataatgccgagataggaatgtctgccgcgaatcaatctgtttctactacaaaggatatcctgttggtactcagaatcaagaaaatcaacggtatatctgttaagcccggccaggttgtatggacattaccatttgaaattaatacatcaatcataggtgactcatcaattggggttgcaagtgacaatagagtagtattacaaggcaatgtagttgaaaacttgaaggtatggtatggttaa

SEQ ID NO: 7407 - protein, 846 aa, Debaryomyces hansenii CBS767
MFYTSINNRIALVTCILACFCCVQSLKYQYESSFTPNHIQYLKNETRLLFKHAWSSYMQYGFPADEVLPDTCEPYGPDYNNVDNVVRNDALGNTSLTILDNLDTLMIMEEWEELERALEYLKSEEKTLFNKDTIVQVFETTIRSLGGLLSTHLLLTDVTKGNKILPSRYQKFKEISDNYDGSLSNMAYDLGLKLLPAFKTSTEIPVPRINLAKGVLKVPSNLQKETCTSGAASPVLEFTLLSKLSGDPQFEYYSQLTFWKLWSSRLALDLMPMSIDPIANKWKDQITGIGASVDSFYEYAAKASILFNDDYMWHVFKTSYKALLAHLVQGGGDNEGVMIFGNVGVNDGSLASIWIDLLGAFWSGLQVLTGQLQDAIKTHLMYLKLWDHFDLIPERWNFLLNKSQLENDDSEAIMLEWYPLRPEFIESTYYLYRATRDPMYLQIGARVLELLQTKYKTICGFHGLQDIRTGNFQNRMETFVMSETLKYLMLLFDADNEIFLHTSMMSNKNWIFSTEAHPMWFDKRLDPYNFTHSRSADKQNMGTLKNLLFAKMKSKFSRSKRKLTTADEKTFYRNITTPRVITYEMPGIIENGDIHKIDPLESKFDKCEVNVFNNKPSMLTVSGYYQLSSFFYPDHAFKYSLIKPRYLLKSALDGSCVELTPSFLRIFAMSGPDNTTKYHHQCPRTSTTTYLELVLGNIEKAQSVEISRLKYKRKQPTEYISLQEDDLWVPDFSSIRLKIEKLSSGLIDSENMLITDSFIQSIRVDDYNAEIGMSAANQSVSTTKDILLVLRIKKINGISVKPGQVVWTLPFEINTSIIGDSSIGVASDNRVVLQGNVVENLKVWYG

SEQ ID NO: 7408 - DNA, 1773 bp, Debaryomyces hansenii CBS767
  CDS (1)..(1773)
atgctatttaaaggattcatagcgtctttggtattctacgtaatctattactatgcgtctacaggggcacttgactttgaatttggaggaagtagcaaaacttgggctgacaagcaacaggaagtgaaagatgtgtttttggaaagttggagttcatacgagaatcatgcctggggtaaggatgtatatcaccctataaaagaaacgggaagcaacatgggacccaagcctttgggatggatgattgttgattcgttggatacattgatgattatggattgtcctgaacaattggcccgtgccaggaagttcgtcaaggatgacctcgactatcattttgattacaatgtcaatgtatttgaaacgacaattcggatgcttggggggttactctcggcccatcacatttctgaggatgatatgtacttggacaaggccatggacttggcaaatgggttaatgggtggtttcgacagcaacagtgggttgccttatgcttccgtgaacttgatgacgggcgaaggtatcaagaatcatgttgataatggtgcgtcatctacagcagaagtggcaacattgcaattggagttcaaatacttatcgaagttaacaggagagaccttattctgggaaaaagttgaaaaagtgatgaaagttctcgatgaaaataagccgcaagatgggttggtacctatttacgtccaacctgataccgggaaatatcagggtaagttaatcagattgggctccagaggtgattcatactacgaatacttattgaagcagtacttacaaacgaacaaccaggaacctatctattgggacatgtaccgtgaatctgtagatggagtcaaaaagcacttggtaagaaaatcatcgccaaatggattgacctacattggtgaattagagcatggaattggaggtggattatcgccaaaaatggaccacttggtgtgtttctatggtggattattggccgttggggccaccaacgggttgccatacaaagaggctaagaagttaccaaattgggatgctgataaagaatctgacttcaagttgggtgaagaattgacttactcctgctacaagatgtaccacgatgtaccatcgggattatcgcctgaaattgcagtatttaacgaaaaccctcaggttaaaagtgacttctacatcaagccactcgatagacataacttgcaacgtcctgaaaccgtcgaatctttattctacttatatagacttacaggtgacgtcaagtaccgtgaatacggatatgagatcttccagaatttcctcaagcacactaaggtcaccaacgcaaaaggggaggtgtcttacacctctttggatgatgtcacgcaggtccccccaccaaagagagacaatatggaatcgttctggtttgctgagaccttgaaatacttgtacttattattcgacgatactaacaagttccccttggacaaatatgttttcaacacagaagcgcatccatttccaagattcgatttgggtcttttacacaagactgactggaccagagataagccgtatctcaagtctcctcaagccaacttcaagcttcctgaccaaaaaatacaggacactcctaagaatgatccgaaaaatattcctgaagctgcaccagctgataagcccgctatcgaggaggctatgaaggaggctcaaaagaatccagaaatcctaaaagatgcaaaggcagagaagaaggagaagctaaacaaaatgttacaagatcttgattag

SEQ ID NO: 7409 - protein, 590 aa, Debaryomyces hansenii CBS767
MLFKGFIASLVFYVIYYYASTGALDFEFGGSSKTWADKQQEVKDVFLESWSSYENHAWGKDVYHPIKETGSNMGPKPLGWMIVDSLDTLMIMDCPEQLARARKFVKDDLDYHFDYNVNVFETTIRMLGGLLSAHHISEDDMYLDKAMDLANGLMGGFDSNSGLPYASVNLMTGEGIKNHVDNGASSTAEVATLQLEFKYLSKLTGETLFWEKVEKVMKVLDENKPQDGLVPIYVQPDTGKYQGKLIRLGSRGDSYYEYLLKQYLQTNNQEPIYWDMYRESVDGVKKHLVRKSSPNGLTYIGELEHGIGGGLSPKMDHLVCFYGGLLAVGATNGLPYKEAKKLPNWDADKESDFKLGEELTYSCYKMYHDVPSGLSPEIAVFNENPQVKSDFYIKPLDRHNLQRPETVESLFYLYRLTGDVKYREYGYEIFQNFLKHTKVTNAKGEVSYTSLDDVTQVPPPKRDNMESFWFAETLKYLYLLFDDTNKFPLDKYVFNTEAHPFPRFDLGLLHKTDWTRDKPYLKSPQANFKLPDQKIQDTPKNDPKNIPEAAPADKPAIEEAMKEAQKNPEILKDAKAEKKEKLNKMLQDLD

SEQ ID NO: 7410 - DNA, 1890 bp, Yarrowia lipolytica CLIB122
  CDS (1)..(1890)
atgagcttcaacattcccaaaaccacgccgaatttctcagccaaagcgcggaaactcgaagatcaactgtggcaagctagtgggctcgaaaaatctaaggactccacgttgccgctatacaaagacaagccgtatggagaggggtttgtggcccggaccacctctggccgccgaagacgcaacatcatctacggagtggtggtaggtcttctgttctgggcgatctacaccttctcgcgctccctggacggaaatgtgtctctgaaggacggaatcaaggactatgagttcaagggatggaagggacgaggcaagcccaaaaccaattgggtagcggaacagaatgccgtgaagcaggcctttgtcgacagttggaacggctatcacaagtacgcctggggcaaggatgtgtacaagccccagaccaagactggcaagaacatgggacccaagcctctgggctggttcattgtggactctctggactctctgatgctcatggggctggagaaggaactggctgaagctcgatactgggtcgacaaggatctggactacaacatagactacgaagtcaacacttttgagacgacaattcggatgctgggaggtctgctttcggcacactacctctccaaggacgacttgtaccttgacaaggctgtgaatcttggaaaccgacttctaggtgcctttgacagcgaatctggagtgccttatgcttctgtcaacctcaagacccgaaagggagtcaaaagtcacgcagatggaggagcttccagtaccgccgaggcggccactgtccaactggagttcaagtacctctccaaactcaccggagaggctctgtactgggagactgctgagaaggtgatgaaggttatggaggctaacaaggctgaggagggtctggttcccattttcatccagccggatactggcaagttccagggcaaccagattcggctcggctcgcgcggcgactcgtactacgagtatctcatcaagcaatatctgcagaccgaaaagcgggaggaaatctaccgagacatgtacgaggaggctgtggacggaatcaagcaccatatggtgaaacagagcgtccctggcgatctggcgttcattggcgagcttgaccggggtattagtggccccttctccaccaaaatggaccatctggtctgttttgcaggcggtatgtttgctctgggtgccaccgaaggatacactcaaaaggaggtggagcgatctgagtcgtggactcagacccgacaggtgaacctgagacttggagttgagctcactcgaacctgttacgaaatgtaccaccagactgtcaccggtctgtctcctgaaatcgttttcttcaacgaccacaacactctcagcaaggacttttctgtcaagccccaggacgcccataacctgcagcgtcccgagacagttgagtcgctcttctacctctggcgaatcacccgaaaccccatctatcgagaatggggctgggagattttccaggcgttccaaaagtacaccaaggttcctggagacgccggttacgactccatcaacaacgtcgagtcgacagagccatcttggagaaacaatatggagtccttctggctgtccgaaaccctcaagtacctgtacctgctgtttgacgactccaaggaggaggtgctgcctcttaccgatattgtcttcaacaccgaggctcatcccttccccaagtttgatatggagcctctgtttaccactggttggactcgagctcctgtgcaggctgccaagaaggagccccaggtggagcagaaagtggagaagattcctgacgagcctgccgcggagtttaagcctgcgcaggttcctgctgatcctattaggggttga

SEQ ID NO: 7411 - protein, 629 aa, Yarrowia lipolytica CLIB122
MSFNIPKTTPNFSAKARKLEDQLWQASGLEKSKDSTLPLYKDKPYGEGFVARTTSGRRRRNIIYGVVVGLLFWAIYTFSRSLDGNVSLKDGIKDYEFKGWKGRGKPKTNWVAEQNAVKQAFVDSWNGYHKYAWGKDVYKPQTKTGKNMGPKPLGWFIVDSLDSLMLMGLEKELAEARYWVDKDLDYNIDYEVNTFETTIRMLGGLLSAHYLSKDDLYLDKAVNLGNRLLGAFDSESGVPYASVNLKTRKGVKSHADGGASSTAEAATVQLEFKYLSKLTGEALYWETAEKVMKVMEANKAEEGLVPIFIQPDTGKFQGNQIRLGSRGDSYYEYLIKQYLQTEKREEIYRDMYEEAVDGIKHHMVKQSVPGDLAFIGELDRGISGPFSTKMDHLVCFAGGMFALGATEGYTQKEVERSESWTQTRQVNLRLGVELTRTCYEMYHQTVTGLSPEIVFFNDHNTLSKDFSVKPQDAHNLQRPETVESLFYLWRITRNPIYREWGWEIFQAFQKYTKVPGDAGYDSINNVESTEPSWRNNMESFWLSETLKYLYLLFDDSKEEVLPLTDIVFNTEAHPFPKFDMEPLFTTGWTRAPVQAAKKEPQVEQKVEKIPDEPAAEFKPAQVPADPIRG

SEQ ID NO: 7412 - DNA, 2325 bp, Yarrowia lipolytica CLIB122
  CDS (1)..(2325)
atgcaacgacttcgaatgcgaaaactgctccggccgttgctgctggcatgtgtgattgcaggcctcttgctgtggtttgtgcctctggactcgggcgtccgtctgtccagcttgaagcaatcggtcgaggagactcctgtgccggaacaccctggaaagccctctgaagaagaaaatgagaagaagaaggaacccaatgtgcccgacatgaatgtgggagccaacgcccggctcaagggcggcgcgcctcctcagttggccgactcctacacccccaaggacgggaccattgagctgatttctcctattggaggccaatctcgaattggaggagtgggagccaagctgctgcccaagcccaagcagatcccccgaaaagaaaagtaccccgtcaaggacccctacaagctgccgtccaagtctaccaaccactggcttcccaagatccaggccgcagagcacagggagtgcaaagaccggatggatcgactcaaggaggtcaagaccgtcatggaccagacgtggcagcggtacaagcaatttggatttggccacgacgagatccatcccattactggtgaggcccgagatccctttctcggatgggctgccactcttgtggacgctctggacactctgtggatcatggacatgaaggacgagttcaagctggctgcagacagggtggccgaaatcgactttactcggtctggtcgagacgtgattcccgtatttgaaactactatccgataccttggtggtcttctgtctgcctacgacctctctggtgacaaaagactctactacaaggctattgagctgggtgataacctcattggtgcgtttgatacacccaaccgaatgcctcttctgtactacagatgggaagataagagcaccaacactcgtcgacgacctgcccagggagctattgttgctgagcttggttccatgaccatcgagtttacccgcctcgctcagctgactggaaataacacttattttgatgctgttcaccgaatcacaaaggagtttgagaaggccgctgaccagcaggtgattcctggcctgttccctgctctggttgacatttctggctgtgatctgacacaacccggtgaggagaccgaccctatggtccagctccccgtggcctttgcttctcctcagcgatgcaaaaagaagggtattactcccatgactgcacatgctggagttgaacagactgtatctttcggaggccgaatcgactcactctacgagtattatatcaaggagtacattcttctgggcggtgccgacgacacgtacaagaacatgtacatccagtctgcagaccaaggagccaaaatgctgctctacaagcccaacaccacctcctcagaggagatcctcttctctggagacctccatattaaccctgccaatcttcaggacattgtcttctctcctaccatggctcacttgtcctgtttcctgggaggcatgtatgctatggggggcaaggttttggagcgaccaaaggacgtggagattggcaaacggcttgctcagggctgtgtctgggcctatggcgccacgggaactggagtcatgcccgaagacctgtctgtgtctccatgtggggactctggggagggcattgatgagacctgtgagtttgaggcgcccaagctgactctgcacaagtacctgcttgccggagacggtaccgtggtcgacacttctgaagaggaagagggcaaggtcgttgaggagaagattggtggccagaagccaaccatggagaagtcgccgtactcgctccacgagctcggtatcgcccctcgatccagacgagaaaagtacccccacattcgtctggagcaggtggccgacttcactcctctcatcaagcttgacgaggatgagctcaagaagatccccaagaagtttgcaggccagacgcacaggtggcggcagtctggagtctacgacttgccccgagactttgtcaaggcttcccctcactacctgatgcgtcccgaagccattgagtcagtctattacctctatcgaatcacaggcgaccctgtttggcaggaacgcggctgggagatgttccgatcagtggttaacctttgttgggctggtcatggagcctatgctgccatcagggacgttactgattggcgaatggactctaatcggttctatgacgagcaggagtctttctgggtgggtgagaccttgaagtactactacctgctgtttgccgactcggacgttatctccctagacgagtgggttttcaatacggaggctcatcctgttaagagacagtag

SEQ ID NO: 7413 - protein, 774 aa, Yarrowia lipolytica CLIB122
MQRLRMRKLLRPLLLACVIAGLLLWFVPLDSGVRLSSLKQSVEETPVPEHPGKPSEEENEKKKEPNVPDMNVGANARLKGGAPPQLADSYTPKDGTIELISPIGGQSRIGGVGAKLLPKPKQIPRKEKYPVKDPYKLPSKSTNHWLPKIQAAEHRECKDRMDRLKEVKTVMDQTWQRYKQFGFGHDEIHPITGEARDPFLGWAATLVDALDTLWIMDMKDEFKLAADRVAEIDFTRSGRDVIPVFETTIRYLGGLLSAYDLSGDKRLYYKAIELGDNLIGAFDTPNRMPLLYYRWEDKSTNTRRRPAQGAIVAELGSMTIEFTRLAQLTGNNTYFDAVHRITKEFEKAADQQVIPGLFPALVDISGCDLTQPGEETDPMVQLPVAFASPQRCKKKGITPMTAHAGVEQTVSFGGRIDSLYEYYIKEYILLGGADDTYKNMYIQSADQGAKMLLYKPNTTSSEEILFSGDLHINPANLQDIVFSPTMAHLSCFLGGMYAMGGKVLERPKDVEIGKRLAQGCVWAYGATGTGVMPEDLSVSPCGDSGEGIDETCEFEAPKLTLHKYLLAGDGTVVDTSEEEEGKVVEEKIGGQKPTMEKSPYSLHELGIAPRSRREKYPHIRLEQVADFTPLIKLDEDELKKIPKKFAGQTHRWRQSGVYDLPRDFVKASPHYLMRPEAIESVYYLYRITGDPVWQERGWEMFRSVVNLCWAGHGAYAAIRDVTDWRMDSNRFYDEQESFWVGETLKYYYLLFADSDVISLDEWVFNTEAHPVKRQ

SEQ ID NO: 7414 - DNA, 1755 bp, Aspergillus nidulans FGSC A4
  CDS (1)..(1755)
atgtcatctgaaaccatccctcagaagcagaagcacccgcaaggacagggcgccaagagctcccgatggcgtaacgcgcttggcagggactgggctttggtatcccttttcaccggcttaatgaccgcagtaatcggttggtggcttggaatcctgaatgcagaaatggcgttggaagcgccttttggatttttccagcgtatcgatatagacagccattgggaggagcaccgaaaagaggtgaaagacactttcatggccagctgggacgcctacgccaaacatgcctggggacaggaccgttttcatccaatctccaagactggttcgcagatgagccccagcggcctagggtggattatcgttgacagcttggatactctgatgataataaatctgacgagtcaactctcggatgcgcgaaaatggcttaaccgtggcctgacttatggccaggatcaggatgtgaacacttttgagacaacaatccggatgcttggaggactcctatctgcccactatctgtcgactgtgcttcatgatgtctcgtctcaacgggactatatttatctgtccaaagccgtcgatttggcagatcggctgctcggcgcgtatgagtctagatcaggaataccgtacgccagtgtcaacattgggacccggcaaggacttccctcgcacgcagatggtggagcatcttcaactgccgaggccaccagtgttcagctagagatgaagtatctcgctcatctcactggtaaggaggttttctggcggaaagctgagcaagttatgaaggttgtcgatgatcagcaaagaccggacggcctcctacccatttttatccatccagacactggacggttcagacaccaggaaatccgtcttggcagtcgcggagattcttattacgagacagaagctcatctgaatccagagtacttgattaaacaatacctacagacttctggacaggagcccgtttaccgtgaaatgtgggaagaagcgttgaccggtattcagaaacacctggttacttcgaccaagcattcgaaactccagttcattgccgagcttccacagggaattggtgggcaattatcgcccaagatggatcatctcgtttgcttcctccccggaacaatcgcactcggcgctactgaagggctaaccgagaaggaagcacgcaagctgcctagctggactccccaaaaggaacagcagatgcaactagctcgggagctcatgaagacgtgttgggcaatgtacgcggttaccgccaccggcctgtccccagaaattgcttggttcagggccgatgaagccgaccttcgatctactttcgggtcatctatacgacctccaagcaagaatgacgaagcttcgtggaaacgagaccttattattaaacctcaagacacacataacttgcagcgaccagagacggttgaaagtctgttcttaatgtaccgaataacgaacgaccctctctaccgaaaatggggctggaagattttcaaggcgtttagaatgcacacggcagtaggcgataatgggggatacacatcattacaagacgtcacaaaggttccggcaccacagcgagataatatggaaagtttttggctagccgagacattgaagatggaggcgtttgaagcgtcattgaagaccctgcttgtgcacggcccagtctcaccggccgagctattagtggtatcaactcagcctcaagacgacaatttggagaaatga

SEQ ID NO: 7415 - protein, 584 aa, Aspergillus nidulans FGSC A4
MSSETIPQKQKHPQGQGAKSSRWRNALGRDWALVSLFTGLMTAVIGWWLGILNAEMALEAPFGFFQRIDIDSHWEEHRKEVKDTFMASWDAYAKHAWGQDRFHPISKTGSQMSPSGLGWIIVDSLDTLMIINLTSQLSDARKWLNRGLTYGQDQDVNTFETTIRMLGGLLSAHYLSTVLHDVSSQRDYIYLSKAVDLADRLLGAYESRSGIPYASVNIGTRQGLPSHADGGASSTAEATSVQLEMKYLAHLTGKEVFWRKAEQVMKVVDDQQRPDGLLPIFIHPDTGRFRHQEIRLGSRGDSYYETEAHLNPEYLIKQYLQTSGQEPVYREMWEEALTGIQKHLVTSTKHSKLQFIAELPQGIGGQLSPKMDHLVCFLPGTIALGATEGLTEKEARKLPSWTPQKEQQMQLARELMKTCWAMYAVTATGLSPEIAWFRADEADLRSTFGSSIRPPSKNDEASWKRDLIIKPQDTHNLQRPETVESLFLMYRITNDPLYRKWGWKIFKAFRMHTAVGDNGGYTSLQDVTKVPAPQRDNMESFWLAETLKMEAFEASLKTLLVHGPVSPAELLVVSTQPQDDNLEK

SEQ ID NO: 7416 - DNA, 1761 bp, Aspergillus nidulans FGSC A4
  CDS (1)..(1761)
atgccgagacggtggtcctccctcatcagcatcacagccatcttcttggtcctcttcttcctccttcataggaatacagacacaccacgcgccgccaatagggctacaaacggccctgccaacggctttgctaggcagcaaagcatatgtccatcaacaccccctcagcctccatataaccgaaccagcacgggagggttcaactggggtgaaatcccagtcagataccctgtatccgacttcatcccgctgtcaaccaactctcctgcaacacttccgcgcatccaacgctcttccttcccacttcaatcctcaatcactaaatcccgccaggcagcagtcaaaggtgcctttcagcgcgcatggacctcctacacaacccacgcctggaaggcggacgaggtacggcccatcacggccggatctcgaaacaactttggcggatggggagcgaccctagtcgacaatctcgacacactgctaatcatggggctggacgaggagttcgcagcggcagtcgacgcgctcgcagatatagaattcagcccgcactcgtccccatcctcctcccagagcacaatcaacatattcgaaacgacaatccggtatctgggcggcttgctcgcggcgtatgatctcactggctgtcgagagactcggctgctggacaaagcaatccagcttggggagatgatctacacctccttcgacacagagaaccgcatgcccgtaccacggtggaatctgcacaaagcaggcaacggagagcctcagcgcgcggcagtgcagggcgtgctcgctgaactcgccagcagcagtctcgagttcacgcggctgtcgcagctgacgggggatatgcggtatttcgatgcggcatcccgcattaccgatctgcttgactcccaagccggccatacccggatcccggggttgtggccagtcagcgtgaacctgcagaaaggcgatctgacccgtgggtcgacattcagttttggcgggatggccgatagcgcctacgagtatctcggcaagacgtatcggctcctcggtggtgtggggaaagggccacagtacgagcgtctggcgcgaaacgcactagatgccgggattcgacatctcctcttccgaccgatgacgcctgatcatgcagatatcctcctacccggggtcgcgcacgcaaccagctcttccgtgggactcgagccccggacagagcatctcgcctgttttgtgggtgggatgtacgcgctcgccgggaagcttttctcaaaccagacgtacctcgacaccggccggaagctgacagacggttgtatctggtactacgataattcaccgctaggtatcatgccggagatgttcaccgtgccggcttgtccgtcagtggctgaatgtccttgggacgaaacaaggggtggtatctacacctacgtgcgtgatgggcactactttctgcgtcctgaggcaatggagagtatcttctatatgtggcgcattacaggggacgaaaagtaccgcgaggctgcatggagaatgttcacggctatcgaagcggttacaaagacggagtttgggaatgcggcggtgcgggatgttatggttgaggaaggaaatgtaaagagagaagatagcatggagagtttctggatggcagagacgttgaagtatctgtatctgatatttggggagaccgatttggtcagcttggacgactgggtgttcaatacggaggcgcaccctttgaggggtgcagggagttga

SEQ ID NO: 7417 - protein, 586 aa, Aspergillus nidulans FGSC A4
MPRRWSSLISITAIFLVLFFLLHRNTDTPRAANRATNGPANGFARQQSICPSTPPQPPYNRTSTGGFNWGEIPVRYPVSDFIPLSTNSPATLPRIQRSSFPLQSSITKSRQAAVKGAFQRAWTSYTTHAWKADEVRPITAGSRNNFGGWGATLVDNLDTLLIMGLDEEFAAAVDALADIEFSPHSSPSSSQSTINIFETTIRYLGGLLAAYDLTGCRETRLLDKAIQLGEMIYTSFDTENRMPVPRWNLHKAGNGEPQRAAVQGVLAELASSSLEFTRLSQLTGDMRYFDAASRITDLLDSQAGHTRIPGLWPVSVNLQKGDLTRGSTFSFGGMADSAYEYLGKTYRLLGGVGKGPQYERLARNALDAGIRHLLFRPMTPDHADILLPGVAHATSSSVGLEPRTEHLACFVGGMYALAGKLFSNQTYLDTGRKLTDGCIWYYDNSPLGIMPEMFTVPACPSVAECPWDETRGGIYTYVRDGHYFLRPEAMESIFYMWRITGDEKYREAAWRMFTAIEAVTKTEFGNAAVRDVMVEEGNVKREDSMESFWMAETLKYLYLIFGETDLVSLDDWVFNTEAHPLRGAGS

SEQ ID NO: 7418 - DNA, 2127 bp, Aspergillus nidulans FGSC A4
  CDS (1)..(2127)
atgtcttttccaaatactcacggcagtcccgcataccctacctcacggtccccttcagaaaaatactggcaggccagtcgcagcccgggagccaacgggctagggggttacggtttctcccaatcagccggtgtcacgaacaacctcaacaatttcttctccggtgaccgcaccctgcccatgtacaaggacaaaccgtactttgcgccgcgccgaactggccctaggctcaggcggaggagggttctccaaggcataatccttctgcttggtctttttagtttgtggtatattgttactgggtctagtgatacctaccggtctccctggactcctgatacagttaagggggaggagttatggaggtgggtgcagcgcttggactcagagcagccctatgacggtactccgctgaagggcattgactgggcagcacgacgagagaaggtccgggatgctttcattgtcagctgggatggttacgagcagtatgcctggggctttgacgagtatcatccggtcaccaaaaagggcaaacagatgatcgagggtggaatgggctggcagattgtggatgcactggacacgttgatgatcatgaacttgacatctcgtgtacaacatgcgcgcacatggattcataactcgctacaatatgaccaggatcacgatgtgagcacttttgaaacgacaatacgcatgctcggtggtctgctctctgctcattatctctctacggagtattccaaccttgcccccattcccgacgacgacgttggttccccaggggaggatctctatattgaaaaggcaaccgaccttgcggaaagactacttggggctttcgaatcggaaacaggtattccgtatgccagtgtgaacctcaatacatcgactggtatcccgtcgcattcagaccgcggcgcctcatctacggctgaggccacctccgtacaactggaattcaagtacctagccaaactgacgggcgaggctgagtactggcgcgttgtggagaaggtaatgcaagtggttgacgccaatcaagcccctgatggccttctcccgatctatatctatccagatacgggaacgttcaggggagcgaacattcgcctcggtagcagaggcgactcttattatgagtatcttgttaagcaataccttcagacgtcagaagaaatatacaaggacatgtgggacgaggccctcgtcggaattcgcaaacacctcatcacattttccaagaatgccaagttgactgtcctgggcgagcgacaggccggtcttgacggccctctaaccccgaaaatggaccacctcgcctgcttccttcctggaacaattgctctcggggctacagaaggaatccctctctctgaagccaaaaagtccgccgcatggactcgccgtaaggacgaagaaatcctcctcgccaaagaactcatgaaaacttgctgggcaacctatctagccacccgcaccggcctagcccccgaaattacctacttcgacatcgacaccccgcacgtctccgagctagaccggtatcccgactccacgctcgccgcaggcaacgcggacaagaagcccgcggacaaagatctaccgctgaaatcccaagcgctgtaccctctcgcagactcaaattcagaccctaactcctggcgtcgcgacattatcatccagcctcaggatagacataatctccagcgcccggaaaccatcgaatccctcttctacatgtaccgcatcacgggagacgaaacataccgccactggggatgggaaatgttcaagtcctttatcaagcataccgccgtcgtcgaaaggtcgtctcattatgagaccgagtccggagacgcaacggcataccgcattgtcggcttcacctccctctccaatgtgaactccgagccgcctatgcagcgcgataatatggaaagcttctggatggctgagacgctgaagtatttctatctgctcttttcggaccgcgacttcatctcgcttgaggagaacgtatttaataccgaggctcatccaatgcccagattcaagcctacaggggagttgagtacgggctgggtcaggagtgcgagggtgcctaagtctgtacctgtataa

SEQ ID NO: 7419 - protein, 708 aa, Aspergillus nidulans FGSC A4
MSFPNTHGSPAYPTSRSPSEKYWQASRSPGANGLGGYGFSQSAGVTNNLNNFFSGDRTLPMYKDKPYFAPRRTGPRLRRRRVLQGIILLLGLFSLWYIVTGSSDTYRSPWTPDTVKGEELWRWVQRLDSEQPYDGTPLKGIDWAARREKVRDAFIVSWDGYEQYAWGFDEYHPVTKKGKQMIEGGMGWQIVDALDTLMIMNLTSRVQHARTWIHNSLQYDQDHDVSTFETTIRMLGGLLSAHYLSTEYSNLAPIPDDDVGSPGEDLYIEKATDLAERLLGAFESETGIPYASVNLNTSTGIPSHSDRGASSTAEATSVQLEFKYLAKLTGEAEYWRVVEKVMQVVDANQAPDGLLPIYIYPDTGTFRGANIRLGSRGDSYYEYLVKQYLQTSEEIYKDMWDEALVGIRKHLITFSKNAKLTVLGERQAGLDGPLTPKMDHLACFLPGTIALGATEGIPLSEAKKSAAWTRRKDEEILLAKELMKTCWATYLATRTGLAPEITYFDIDTPHVSELDRYPDSTLAAGNADKKPADKDLPLKSQALYPLADSNSDPNSWRRDIIIQPQDRHNLQRPETIESLFYMYRITGDETYRHWGWEMFKSFIKHTAVVERSSHYETESGDATAYRIVGFTSLSNVNSEPPMQRDNMESFWMAETLKYFYLLFSDRDFISLEENVFNTEAHPMPRFKPTGELSTGWVRSARVPKSVPV

SEQ ID NO: 7420 - DNA, 1848 bp, Candida albicans SC5314
  CDS (1)..(1848): transl_table=12
atgtctttttcatttggtataaataatatatcgaaaggcaataatacatataaagacaaaccagcaggaggagcattaccattattctacaaagacaaagtaccagcattccacccagcccacacttcaaaaaataaaaaacgtattctcatgctattaaaaggttttatgttgtctttagtattatatgctgtgtaccatttagcatcaaatggtgggcaatttatgtttgatttctcgggtcaatcaaaatgggaaagagctcaactggaagttcgtcaagccatgttagattcatggcatacctatgaaaagtatggttggggttatgatgtctatcatccaattaagcaagaaggggaaaatatgggtccaaaaccgttggggtggatgattgtggattcattagatactttgatgattatggattgtccagaagaagtcagtcgagccagagattggatcaagaatgatttggattacacttttgattataatgtcaacacatttgaaaccactattagaatgcttggtggtttattatcagcttatcatttcagcaatgacgatgtctatttggataaagcggtacaattggccaatgcattacacggggcctatgatagtccatcaggaataccatatctgtctgtcaatttgaaatcaggtaaaggtataaagaatcatgttgataatggtgcctcatccactgctgaagctgctactgttcaattagaaatgaaatatttatcgaaattgactggagaaattttgtggtggaacttggcagagaaagtaatgcaagtgttagaaagtaataaacctcaagatggtttggtgccaatttatgtcaacccagatactggtaaatatcaaggccatttgattagattggggtcacgtggagattcttattacgaatatttgttgaagcaatacttgcaaacaaataagcaagaacttgtctattgggatatgtatcgtgaatcggttgaaggtgtcaagaaacatcttgtgagtgattcttatccttcaggattgacgtttattggggaattggataatggtattggtggcaaattgtcaaccaagatggaccatttagtttgcttttacggtggattgttagcccttggtgctactggaggattgacattgaacgaggctcaaagtttaaaatcatggaatgaagaaagagaagctgactttaaacttggtgaagagttgacttatacttgttataagatgtaccacgatgttagtccaactggattgtcaccagaaattgttgttttcaatgaagatacttcaaaatccaaagattttattattaaacctttggatagacataacttacaacgtccagaaacagttgaatcattgttttatctttatagattaactggtgatgtcaaatatcgtgaaatgggatatgaaattttccaaaattttatcaagtacactaaagttgttaattcggaaggtgaagtttcattttcctcgctttccgatgtcacttctttcgattctaatggcttaccgaaattcaaagataacactgaatcattctggtgggcagaaactttgaaatatttgtatcttttgtttgatgacaccaataagattccattgacagattatgtctttaatactgaagcccatccattccctagatttgatactaatgattatttcaaaactggttggagaagaaaaattgatgagaatgaaaaggcacaaatgagagaatccaaagttattgataaaagtaatcttccggaagctcaaccagttgataaatcagctgatcaagaagctaaagaaattattgaagaaattgctgggtaa

SEQ ID NO: 7421 - protein, 615 aa, Candida albicans SC5314
MSFSFGINNISKGNNTYKDKPAGGALPLFYKDKVPAFHPAHTSKNKKRILMLLKGFMLSLVLYAVYHLASNGGQFMFDFSGQSKWERAQSEVRQAMLDSWHTYEKYGWGYDVYHPIKQEGENMGPKPLGWMIVDSLDTLMIMDCPEEVSRARDWIKNDLDYTFDYNVNTFETTIRMLGGLLSAYHFSNDDVYLDKAVQLANALHGAYDSPSGIPYSSVNLKSGKGIKNHVDNGASSTAEAATVQLEMKYLSKLTGEILWWNLAEKVMQVLESNKPQDGLVPIYVNPDTGKYQGHLIRLGSRGDSYYEYLLKQYLQTNKQELVYWDMYRESVEGVKKHLVSDSYPSGLTFIGELDNGIGGKLSTKMDHLVCFYGGLLALGATGGLTLNEAQSLKSWNEEREADFKLGEELTYTCYKMYHDVSPTGLSPEIVVFNEDTSKSKDFIIKPLDRHNLQRPETVESLFYLYRLTGDVKYREMGYEIFQNFIKYTKVVNSEGEVSFSSLSDVTSFDSNGLPKFKDNTESFWWAETLKYLYLLFDDTNKIPLTDYVFNTEAHPFPRFDTNDYFKTGWRRKIDENEKAQMRESKVIDKSNLPEAQPVDKSADQEAKEIIEEIAG

SEQ ID NO: 7422 - DNA, 2061 bp, Ustilago maydis 521
  CDS (1)..(2061)
atgccggtcaaaaacgatgcgagtgatgctaccctcaaaaagcggtccggaattcgctcatcatcatctccagcagcgccgagaaagcaagcttccagcaagaaaacgtcagaaaccgaaaccaaaccgaagttgctatcgcgagtgacttccccatggcgtttactctcgtgggcatgttcggcagccctgttcgtactagcatatctcacctacaagaacaacggtcagctacctctgcatctcattagcagatcatcactgtcagatcatcagcagcatcagcctttacggcaacatgactccgataccgtcgcaagagacacgtggggagctccacggaagcctttcaccagttcgaacaaaagagagccctcgctgctttacccattaccaccgacacgaccgcttcccgagcagccattgcgccatgctgaccaatacaggcgcgacgccattttgaacgccttcaatcactcttggtctgcctacaaacgagacgcatggggctacgacgagtaccaccccatcagcaagcatggttcaaaccttagcggaaagcaaggccaaggcattggctacaccatcgttgacacgctcgacacgctcatccttatgggcctcaaggacgagtatgagcgagctcgtgaatgggttgcagaagagctaaactggaatgttgcaggacgaatgaacgtgtttgaaactacgattcgcacgctcggcggtttgctatctgcggcggcgttgataagagaccctccgcatgctgcgttcgcagctaacgaggaggatgcaaacatgtttatcggaaaagccgtggaactcgcagagcgtctcaagcctgcatttgataccccctcgggtgtgccgttgcgcgaagtcgatctgcaaacgggtgaagcgttccctgatctcaacaacaacaactcgtccagccttgccgaagcgacaacggttcaactcgaattcaagtacctcgcgcatctcaccggagagatggaatactggcgtatcgcagaacgacccatgcaagtcgtgcgcgacgccacgcagcggttgccacactaccaaggtgtactgcccatctttttggacccgatgactggccatttttacaacggagaggtgcgactcggctctcgtggcgattcatactacgaatacctcatcaagcaatggttgcagaccggtcgaaccgagaaggtctaccgagacatgtacgacaatgcgttgcgcgggatcaagcgtttgttgaccaagccatccattcactcgaaaccgccgttgatgtttaccatcgagctagcaccaaggagatcggcagacggtcgaccgtatatgcagcttgtgcccaagcaagaccacctcgtctgctttctgggcggatccatgatgctcggctccacttcgacgcacgacattttcggtgacacagccaaacgacctctgcctcccatctctgaccttggtataggcgacgagacggacaaagaagactggcgattgggtcacgaatttgtgcgcacatgtatggacacctacacgaaaacaaagacgggtctctctcccgaaatcgtgtttttcaaaacgcctcaagatgctaacctgaccgatgcgcagatgcttgcctcgaaccgggcgcccatcccagccaatgtcgactggtacatcaagaaacctccgccctcgtactcgcaccggccaaacccactcatcgattcgcgcaacatcctgcgtcccgaaacggtcgaatcgctctttatcggcttcagcctcaccggcgatcccatctaccgcgaatggggatggcaaatcttccaagctttcgaaacgcactgcaaagtagaaaccggaggctattcgagcattgacgatgtagacgcggacgaacctgctaaggtggacaagatggagacattttggttgtccgaaacgctcaagtatctgtatctgttgtttgaggacagagatctgttgccgttgaacaagtgggtactcaataccgaggctcatccgttgcctgttttcgagccagtctttgccactggtcttatctag

SEQ ID NO: 7423 - protein, 686 aa, Ustilago maydis 521
MPVKNDASDATLKKRSGIRSSSSPAAPRKQASSKKTSETETKPKLLSRVTSPWRLLSWACSAALFVLAYLTYKNNGQLPLHLISRSSLSDHQQHQPLRQHDSDTVARDTWGAPRKPFTSSNKREPSLLYPLPPTRPLPEQPLRHADQYRRDAILNAFNHSWSAYKRDAWGYDEYHPISKHGSNLSGKQGQGIGYTIVDTLDTLILMGLKDEYERAREWVAEELNWNVAGRMNVFETTIRTLGGLLSAAALIRDPPHAAFAANEEDANMFIGKAVELAERLKPAFDTPSGVPLREVDLQTGEAFPDLNNNNSSSLAEATTVQLEFKYLAHLTGEMEYWRIAERPMQVVRDATQRLPHYQGVLPIFLDPMTGHFYNGEVRLGSRGDSYYEYLIKQWLQTGRTEKVYRDMYDNALRGIKRLLTKPSIHSKPPLMFTIELAPRRSADGRPYMQLVPKQDHLVCFLGGSMMLGSTSTHDIFGDTAKRPLPPISDLGIGDETDKEDWRLGHEFVRTCMDTYTKTKTGLSPEIVFFKTPQDANLTDAQMLASNRAPIPANVDWYIKKPPPSYSHRPNPLIDSRNILRPETVESLFIGFSLTGDPIYREWGWQIFQAFETHCKVETGGYSSIDDVDADEPAKVDKMETFWLSETLKYLYLLFEDRDLLPLNKWVLNTEAHPLPVFEPVFATGLI

SEQ ID NO: 7424 - DNA, 3429 bp, Ustilago maydis 521
  CDS (1)..(3429)
atggcattgcaagctgcccgactcgcacaaggacaagagcaggtctcgtcttcttcccatcttgacaagctcaccggcgatcctcctctcgatccgagagtctcgaatgtctcccaaccatcgtcccttgtacagccctcatcgtcacacccagcctcgtcaagtcaaccatcttcgtcgctagacacacgtcccatttcacctcgctctggcgagcacttgggtctcgcttccggaatcaaagcttcggacgaatcatcctctgcacagctcgaaccttgcacgtctcatagctaccagcccacctcctcctcctcctcctccaccaccaccaccacctcctcctcctcctcctcctcctcctctgcctctgcctctgcctctgcgcagagcttagtctgctcctgcgaatctggcgcttgtccgaggtcagcaccccaatcacccagttctttaacacatacaactcctgacgtggatgcaaccattcgggacagtctggtgccacactcgacgcttcgtctgcgcaagtccgtagccgcacccagcgaccacgcacccggttcagctgcccaacagataggaaaatcgccaacccaaacatcgcatcatcagcacggcgacatgtttggaagcacatccaccgcctcctacttgcctctcaacacgccaaggcgcataagtcctttcagctcgtcccatctcgtatcatggatcgccaaacacaaggtcttggtcatctttgtgctcgtcgcgctcattgtatcggtccaagtgcttctcgtcggccccgtcgtgatggacatggaaccagtgaaaaagttgcgagaacaaggtttgccgtccatcaagtcgcccaactggttcggctcttcctcagagtctgccagctcttggtttccctcgtccagcgagacctcggcacccgttgcagtccaaccgctcggccccaactcgtttcctccaccattgagccaagtgagcagcttgaccggcgttacacagtctcaagccacgctctacaaggacacggatccacaccgtggcgagatccccacgtatctcgaagaccttctcaacaaagagcccgtgcatcatcctccaccttggccgcaaaaggcaccctccatctcgcccgaaatatggacaacgcgcttgtggcaagatcgctctacgacacacgccagcgacgccgacactccagccaagcagcctctggagcccgagtggcgcaccgccccgtggaccggctggagaccgccgcttgacgagctttctcagccaatcaagccgatagccaaggtgcaacatgcattcgaggatcctacgcgtcactcgggtcgtcgcaacgatcaagctcgagatgagcttatcgctcaacgccaaaagatggtacgcaacgcctttatccatgcatgggagggctataagaagcacgcctggggtcacgacgagctgagacccgtgtcaaggaccgcagaagatccattcaacggctggggcgccagcatcgtcgacgctctcgacacgttgctcgtcatgcgtcttcccaacgagtatgacttggcacgccagcatgtgcgcgatatcgatttccgtctgatcggcggctcgcgcagtgcctatggcagtgcagatggtaagattccggtgtttgagaccgcaatccgttatttgggcggcttcctgtcagcatacgatctgagcggcgacattctgatgcgagatcgagctgaagagttggcacagctgatcctgcccgcgtttgacacggtcactggtgtgcctaatggccgaatcaggatggtcgagactgcagagtaccctcacaaacgtccacagcaacagaacagcgtcattctcgctgaagctggcagtttgctcctcgagttcactcggctctggcaggtgaccgggaatcgcacctactttgaccgtgtccagcgcaccaccgactggctcgatcacaacatgacggctgccggtcggatcgaatcgctcttcccttgccaaatctatccggagcgcaacatctcgtacggaacgatcggattcggcggcatggccgattcgtactacgagtacttggtcaaagagtatcagctgcttggtgggcggctcaagcagtacagccgcatgtactcggctgccattgaaggagccaagaagctgctcatctctcgcatcgatacggtaccgggaatcagcttgatcacactcggagagctatccggctcgaggtacactgccaagctggaacatcttgcctgtttcagtggaggcatgctgggactgggttcgcgcatcataagccagcgtgccgatgatctcgatctggccaagggcatcacgggcacttgctggtgggcgtacaacagctcgactaccgggatcgggcctgagaacatgatcttctacacgaatgacgacgatgatcgtttcgagctgatcagccttgccgacggcacgtcaaggcgaggccaaccacgtgggagtcctatcgtcggcgtgcgaagtgtacatacgagctatctgaatcggcctgagacgatcgagtcggtgctgtacatgtggaggatcacgggcgacaccgagtggcaggagcgcggctggcagatgtttgcatcgtgggtgacgcactgcatgaccgacgtaggattcagcgcgatctacgacgtgaatcgcacaccggcgggctggacggacagcatggagagctttacatttgccgagacattcaagtactactacctgctgttttcgccgccagacgtgatctcgctggacgagtacgtgttcaccaccgaggcgcatccgctcttggtgcccaaggacgggcagtgggcgcgcgccggaaacggaagcagcaagttctgggatccacacgccagtgcacacctcgccgatccacgcgtctaccccggtggcgagatgcgccagcccggaggcctgaccaacaaccagaagcagatgctctggtcgcagtggcaggcgaaatcgtcggcgaccaagatccgcgatctcatcaacgcgctcggtgcagacgcactcaagagcaagctgcgcagcttggtggagcgtgcagatgcgacgacgctgtcggggctggatgcggggctggatgcgacgattgtaccggatgcggggccacaggcagcgagtgatactcagcaccgcggtctgctcgcttcggtaggcggcacgtcggtctacgaggcacacgaccgctcgttacacgtcgagtttgccccccacacgcacgcgcatacgcagcagcgcgtgctggaacagctcgacgcacagcccctagatgcatccacgatagatagcgtgctccgctcagcccagcacgtcagcgtcgtccacgagcagcaccaacacgaacaccaacagcatctagctcggttaaggtccaaaggtattcgctag

SEQ ID NO: 7425 - protein, 1142 aa, Ustilago maydis 521
MALQAARLAQGQEQVSSSSHLDKLTGDPPLDPRVSNVSQPSSLVQPSSSHPASSSQPSSSLDTRPISPRSGEHLGLASGIKASDESSSAQLEPCTSHSYQPTSSSSSSTTTTTSSSSSSSSSASASASAQSLVCSCESGACPRSAPQSPSSLTHTTPDVDATIRDSLVPHSTLRLRKSVAAPSDHAPGSAAQQIGKSPTQTSHHQHGDMFGSTSTASYLPLNTPRRISPFSSSHLVSWIAKHKVLVIFVLVALIVSVQVLLVGPVVMDMEPVKKLREQGLPSIKSPNWFGSSSESASSWFPSSSETSAPVAVQPLGPNSFPPPLSQVSSLTGVTQSQATLYKDTDPHRGEIPTYLEDLLNKEPVHHPPPWPQKAPSISPEIWTTRLWQDRSTTHASDADTPAKQPLEPEWRTAPWTGWRPPLDELSQPIKPIAKVQHAFEDPTRHSGRRNDQARDELIAQRQKMVRNAFIHAWEGYKKHAWGHDELRPVSRTAEDPFNGWGASIVDALDTLLVMRLPNEYDLARQHVRDIDFRLIGGSRSAYGSADGKIPVFETAIRYLGGFLSAYDLSGDILMRDRAEELAQLILPAFDTVTGVPNGRIRMVETAEYPHKRPQQQNSVILAEAGSLLLEFTRLWQVTGNRTYFDRVQRTTDWLDHNMTAAGRIESLFPCQIYPERNISYGTIGFGGMADSYYEYLVKEYQLLGGRLKQYSRMYSAAIEGAKKLLISRIDTVPGISLITLGELSGSRYTAKLEHLACFSGGMLGLGSRIISQRADDLDLAKGITGTCWWAYNSSTTGIGPENMIFYTNDDDDRFELISLADGTSRRGQPRGSPIVGVRSVHTSYLNRPETIESVLYMWRITGDTEWQERGWQMFASWVTHCMTDVGFSAIYDVNRTPAGWTDSMESFTFAETFKYYYLLFSPPDVISLDEYVFTTEAHPLLVPKDGQWARAGNGSSKFWDPHASAHLADPRVYPGGEMRQPGGLTNNQKQMLWSQWQAKSSATKIRDLINALGADALKSKLRSLVERADATTLSGLDAGLDATIVPDAGPQAASDTQHRGLLASVGGTSVYEAHDRSLHVEFAPHTHAHTQQRVLEQLDAQPLDASTIDSVLRSAQHVSVVHEQHQHEHQQHLARLRSKGIR

SEQ ID NO: 7426 - DNA, 2595 bp, Cryptococcus neoformans var. neoformans B-3501A
  CDS (1)..(2595)
atgggtcgctctctttcccccaagcctacaggccgcaacatgccgtacgcccccgcctatccttcctcgtactcggaccctgagaaaggcctcccttcatccccgtcctcattagcccgtcatatgcttgtgccgaggaagccaagatggatcctgggcggcttgttgatatgcgtagtgatactgtactatatgaccagtaacaaagacgaaacggcatggggtcatggtggatcttgggatgcggaaggcgatgattcgagggccggttcgaaaccttcagacgacaaaagtgagagccccacttacagtgactacattgtcgacgcccacgggaaccactttgtcaagggatggcaacagcccatcacgcccatgcacccagatgtcgacctccttccacgcgcaccttccatcttcccttatctcaacgtctccgagtccgagctgcccgaagaaaagatatatcccgattccgatcttcgtttgatcatttctcagccaccggatctgcctgaagagcattccaatagcatgccagaggatgcatggtcccaaaaatggagtggaccaacggtctgggatcagcccaaaggagagatgaaaagagtccagtgggaagggttcgccggtggaagggaccgttgggaaagcgagaatgatagaaaggtcagggaggaaaggaaggaagcggtgaagagaggtttcaaacatgcctgggaagcttataaacgccatgcttggggacacgacgaagtcagaccagtttcgttgacacattcagatcccttcaatggctggggggctaccattgtcgactctcttgacacgttgcttcttatgggcttttcaaatgagtacaatctatgtcgcccacatgttaatcagctcaatttccattgggttaatgggcgcgattggaacgacggatacgtttcggaggaactaagcggcagcggtgaggtgtatgctctcaatcgtgataaaactgtcggtctggctgtatttgagaccggtatcaggtaccttggcggtcttcttggagcttatgacctttccggcgatgatcttcttcttgaaagggctgtagatctggcagatattctgagcaccgctttcaagacaggctcaggtctaccggccggccggatggaccctggtacaaaagatgagatgattcggctgggcactgtttcgttggccgaagtaggcagtatgtcgcttgagctcattcgcttgtctcaaataaccaaagatcgtaaatggttcgatctcgcacaaagagcgatggattatatccatgaacgagttatcccccgcggcacccattctcctctgattcctatgtggttccaacccgatgctcctctgaccacttcgatgcacggcggcctcacctttggtggccttgccgattcttattacgagtaccttatcaagacgtacaaacttttgggcactagcgaagtctcacaagtgtggcgagatgtatatgagcgctcaattgacaaagccaaggagaccctgtatgtcgacattgacattgtacccggtcgcaatattctagcagttggtaagcttgagaatgggagactcattccagagctcgaacatctcacatgcttcatcggtgctatgcttggtcttggagcgaaacttctggacaggcctggtgacatgcgggatgctgagagagtcaccgcatcgtgctattggctctcagcagatacgccaactggtcttcagcctgaagttgtcgaatggtatgctccccatgaaacctcggccatgtacgagaatgtttcgatatctggtggcggtaggcaccaccccctgattttcagcgaggacgaatctaaagacagagatgggatgtacagggatagaaacggtgtcttaaggtggactgaggacaatgagcccgttttatacaccgatcgcgagaaaaagaagaacggacagacacctatcaaatatgcccagagactgaaaggcacgcctaccggcgccagaaaagtatcgacccgaggcctcaaccgacctgaaaccattgagtcgatattttacatgtatcgtatcactggcgatcgtaaatggcaagagaagggatggaagatgtttacatcatggatgaacgcttccacagtggatgggggattcagtagtgtcgaagatgtcacaaagttgcctgtaagattcggtgacaacatggaaagctttgctctggcggaaacgttcaaatatcatttcctacttcaatcagagccggatgtcctttctttggatgactatgtgctcaacacggaggcccatcctttcctcaccaaccccaagcttgatcctaaagctcacacgacccacactcgcttttggtcaccccctccttcacaggatcttggagtgcgaggacaaggtactaatgcccaaaagtttgcccgtcttgaggtcattgaacgggcttcattgcctttccttcctgcccctcctcagaatgctcctgggggaggcggtggaagaggaatgggcggcggaggaggaaaacctggggttattccgaaacttcctccagagattttaaaaaagttaaatcagtga

SEQ ID NO: 7427 - protein, 864 aa, Cryptococcus neoformans var. neoformans B-3501A
MGRSLSPKPTGRNMPYAPAYPSSYSDPEKGLPSSPSSLARHMLVPRKPRWILGGLLICVVILYYMTSNKDETAWGHGGSWDAEGDDSRAGSKPSDDKSESPTYSDYIVDAHGNHFVKGWQQPITPMHPDVDLLPRAPSIFPYLNVSESELPEEKIYPDSDLRLIISQPPDLPEEHSNSMPEDAWSQKWSGPTVWDQPKGEMKRVQWEGFAGGRDRWESENDRKVREERKEAVKRGFKHAWEAYKRHAWGHDEVRPVSLTHSDPFNGWGATIVDSLDTLLLMGFSNEYNLCRPHVNQLNFHWVNGRDWNDGYVSEELSGSGEVYALNRDKTVGLAVFETGIRYLGGLLGAYDLSGDDLLLERAVDLADILSTAFKTGSGLPAGRMDPGTKDEMIRLGTVSLAEVGSMSLELIRLSQITKDRKWFDLAQRAMDYIHERVIPRGTHSPLIPMWFQPDAPLTTSMHGGLTFGGLADSYYEYLIKTYKLLGTSEVSQVWRDVYERSIDKAKETLYVDIDIVPGRNILAVGKLENGRLIPELEHLTCFIGAMLGLGAKLLDRPGDMRDAERVTASCYWLSADTPTGLQPEVVEWYAPHETSAMYENVSISGGGRHHPLIFSEDESKDRDGMYRDRNGVLRWTEDNEPVLYTDREKKKNGQTPIKYAQRLKGTPTGARKVSTRGLNRPETIESIFYMYRITGDRKWQEKGWKMFTSWMNASTVDGGFSSVEDVTKLPVRFGDNMESFALAETFKYHFLLQSEPDVLSLDDYVLNTEAHPFLTNPKLDPKAHTTHTRFWSPPPSQDLGVRGQGTNAQKFARLEVIERASLPFLPAPPQNAPGGGGGRGMGGGGGKPGVIPKLPPEILKKLNQ

SEQ ID NO: 7428 - DNA, 1812 bp, Cryptococcus neoformans var. neoformans B-3501A
  CDS (1)..(1812)
atgtcgcaagtacgctcaagagcctcccagggtgggaaaggcaaggatgagccccagaaaaggctggataagaaggacattgacagaaaagtcgagcaaatacaagcccttggcgtattaaggacgattctttcatgcttgggtcttgtagctgtcttgtggttcggctggaagaccgtggcacccatcttggagaaaaagacaagccctcctgtgattccgcaagcaaagcttcctggaagcaaattcggcactatcaagccttcggatcttcctaaaatcaacctaagcaccaagcttgaagcagacattgaaaagagggaggcagtcaaggaagcttttgagtggagttggcatgcatatgagaagcacgcttggggagccgacgaataccaacccttgacccagacaggctccaacttgacttctgccggtggcgttgggtacacaatcgtggattctattgattctttgctcatcatggacttgattccagagtaccaaagggctcgagactgggtccgcgatcatcttaactttgacaaggatgcccagttcaacacatttgaaactaccattcgtctcctcggtggccttctctctgcgcactatctcagctctacccactcgtcccctgccatccaggccgatgctcctctttacctcgatctcgccatcgacctcggtgaacgtcttctcggcgccttcacctcccctaccggcatcccttggtcaggaatcaaccttgctactcgtcagggtattcctgatagagacaaccagggcgttgccagtttggctgaagccgctagtttgcaattggaactcaaatatcttagtcatttaacaggagactatgtgtactggaagaaggcagagaaggtgaccgagatcattcgagcgcaggcaatccatgatggtattgctcccatcttcatctctcccgtgaatgggcagtttgtggcttctgagatccgacttgggtccagaggtgattcttactacgaatacttgctcaagcaatggcttcaaactaaccgacaagagcccgtttaccgcgatatgtatgacgaagctatggtcggtattaagaggcacctcattggacaaactagcaaatccaacctcatcttcacccaggaactccatcctgctcgacacccgcgagatcaaagtgccacatggcaagtcgtccccaagcaagaccacctagtctgcttcttgggcggatcgttcctgctcggtatcacagaaggcggaaagagagatttagattgggagaatatggaagaaaaggacagggaggatttcctcgttggtcaggggatcatcgaaagttgtatgaagacccatgacactgcaaccggattggctcctgagattgccatgtttgtgcaatggagcgatgatcgagctaatgaggaggattggtacatcaaacctaaccacaacggcatcctcatcgatgggcgcaatatccttcgacccgagactgttgagtctctctttctcgcctaccgagccaccggtgatgagaagtaccgccgatggggatggcaaatattcgaggctttccagaagtggtgtagggtcgaagacggcggttatgcgggtattgaggatgtgcaatctatgccgcccaagcagttggacagaatggagacgttttggctcggagaaacactgaagtatctgtacttgctcttcgatgatgcagatcacatcccacttgacaaaaacatcttcaacaccgaagcccatatccttcccgttttcacgcccgaatacgtctcttctttcgccctttcatag

SEQ ID NO: 7429 - protein, 603 aa, Cryptococcus neoformans var. neoformans B-3501A
MSQVRSRASQGGKGKDEPQKRLDKKDIDRKVEQIQALGVLRTILSCLGLVAVLWFGWKTVAPILEKKTSPPVIPQAKLPGSKFGTIKPSDLPKINLSTKLEADIEKREAVKEAFEWSWHAYEKHAWGADEYQPLTQTGSNLTSAGGVGYTIVDSIDSLLIMDLIPEYQRARDWVRDHLNFDKDAQFNTFETTIRLLGGLLSAHYLSSTHSSPAIQADAPLYLDLAIDLGERLLGAFTSPTGIPWSGINLATRQGIPDRDNQGVASLAEAASLQLELKYLSHLTGDYVYWKKAEKVTEIIRAQAIHDGIAPIFISPVNGQFVASEIRLGSRGDSYYEYLLKQWLQTNRQEPVYRDMYDEAMVGIKRHLIGQTSKSNLIFTQELHPARHPRDQSATWQVVPKQDHLVCFLGGSFLLGITEGGKRDLDWENMEEKDREDFLVGQGIIESCMKTHDTATGLAPEIAMFVQWSDDRANEEDWYIKPNHNGILIDGRNILRPETVESLFLAYRATGDEKYRRWGWQIFEAFQKWCRVEDGGYAGIEDVQSMPPKQLDRMETFWLGETLKYLYLLFDDADHIPLDKNIFNTEAHILPVFTPEYVSSFALS

SEQ ID NO: 7430 - DNA, 1494 bp, Ostreococcus tauri
  CDS (1)..(1494)
atgtggtctcggacgcgccggcgcgggtggtcgggcgaggaggggcgtggaaggaggtattgggcgacgacgcgcgcggacgcgcggcggcgagacgcggtgcgggacgcgtttcgggagtgtttgacggcgtacgtgacgtacgcgagtggacacgatgaactcgcgccggcgtcgagacggggggtggatgattttggtggcgtcgatacgacgctggcggatgcgttggacacgatgttcatcatggggatgaagaaggagttcgcggagggactcgggcggttgaaggcggagacgagcgggtttcgggcgttgatcaacggcgaggtcgatcgagacgtgagcgtgttcgagacgaatattagggttttaggtgggttactcgcggcgcacgatctgagcggcgatggtgacgcgttggagctcgcggagtcgttcgcggcgaggctgtcggcggcgttcgacacgccgagcggcgtgccgaagtccttcgtgaacgtcaagactggcaagtcgttcacgctccagtggacgggggggaagagcattctcgcggattttgggtcgatgcatctggagtgggcgaccttgagcgctcgtacgaaaaatcccgtgtacgaggcgcacaccgggcacgtttttgaacaaatcgcgcgcgcgcggaggaacagcggcgcgccagtcggattattcccgcatctttacgacacggacgcggggaaattcgccggtgggacggttacctttggggcgttgggcgatagtttctacgagtacttgattaagtgttggcgatcgctcgcggatttgaaggacgcgcccttgtggcgagagatgtttgacgacgccgtggccgccatgacggcggcgaacatgacgcgcgagtggaagcgagagggagacgacgtgtacctagcgttgtctcccatcggttctacttataccatggagcacttggcgtgctttgcgccgggtatgctcgtcttggggggcgccgaggcgccgacaaaggcgctcgcggaggaatacgtcgagctggcgagaaaaatcgcgcgcacgtgcgtggctatgtacgactctcagccgtctgggttggcgcccgatcacgtcaagttggttccgtctccttcgtcgccatccatgaacgtcatcgacggcaagaacattcagcgtccagagacggtggaatcgttgttctatctataccgtaaaaccggcgaagagcagttccgggaccaggcgtggaaaattttccaatccatgaaagcagcgtatagcgtgcccgggagcggttggcagggcgttcgcgacgtgcgacagtctccggcgcagggcgacgataagatgcaatcatttttcctcgccgaaacgctcaagtatttgtacctcatcttctccgactcggacgagatgcacctcgatgagtgggtcttcaatacagaggcacacccgtttcgaatcacaaagactcgggcgaagagcgatggttag

SEQ ID NO: 7431 - protein, 497 aa, Ostreococcus tauri
MWSRTRRRGWSGEEGRGRRYWATTRADARRRDAVRDAFRECLTAYVTYASGHDELAPASRRGVDDFGGVDTTLADALDTMFIMGMKKEFAEGLGRLKAETSGFRALINGEVDRDVSVFETNIRVLGGLLAAHDLSGDGDALELAESFAARLSAAFDTPSGVPKSFVNVKTGKSFTLQWTGGKSILADFGSMHLEWATLSARTKNPVYEAHTGHVFEQIARARRNSGAPVGLFPHLYDTDAGKFAGGTVTFGALGDSFYEYLIKCWRSLADLKDAPLWREMFDDAVAAMTAANMTREWKREGDDVYLALSPIGSTYTMEHLACFAPGMLVLGGAEAPTKALAEEYVELARKIARTCVAMYDSQPSGLAPDHVKLVPSPSSPSMNVIDGKNIQRPETVESLFYLYRKTGEEQFRDQAWKIFQSMKAAYSVPGSGWQGVRDVRQSPAQGDDKMQSFFLAETLKYLYLIFSDSDEMHLDEWVFNTEAHPFRITKTRAKSDG

SEQ ID NO: 7432 - DNA, 1914 bp, Phaeosphaeria nodorum
  CDS (1)..(1914)
atgggcaagatcaaagtcggcggcggcgggcgaccctaccaagcaatgtcgagacagcacaaacgaaccctcacatggctcctgcttgggaccatcgcgttcggcgcatactacatgtggtcggcatatccagaccggcttgccgtacccttcgcatcgcacgagacatatatgaacactcgacaagctcaaagtccgctcaaatcacagcagtcctatgactggagacaggcgccctttatcaacaagatcaaagagtacataccgctgccgcagcaacccgttcgaaacctcccgcaagtgcaggccgacttccctcccgagacaaggtcacaaagacggtggagagaagagcggagagtagctgtccgggatgagtttcagcgctcatgggagagctacagagagttcgcatttggattggacgagctcctgccggccacgggtggaagcgtaaatacatttggcggctggggcgccacgttggtcgactcgctcgacacgttatggataatgggcttcaaggactacttctacgaggctgtagaggcggtggctgtgattgactttggcaagtcagacatggaaagcatcagcgtcttcgaaaccaccatcaggtacctgggcggcctcctcagcgcatacgatctgagccaggagccggtgctgctggagaaggctatccagctgggagaaatgctgtacagagctttcgataccacgaatcataccccactcggcggcttgaatatcgaagatgccaagaacactcatcgctctgagtttccggctgatatgaacctttgctttgcatgtcttggttctctcaccgtggagttcacgcgcctggcgcaaatcacagaaaataaaaagtactatgatatcgtagcgaggatcagcaagatgatgcgccatgcacaagacaccacccaaatgccagggctgtggcccacgaccatcaacgctgcgaaagaagacttcaactcatcacgttacttctccattggagcactcgcagactcgacatacgagtactttcccaagatgcacgcgctcttgggcggcgtagaaccaatctacgagaaactgtacaaagactctgccgccatgattgacaagcacatgctctttcgcgcctcaatcccagacgagaaactcggcgccgacctgctcttctccggcgacgtgtactctcccagtcagggcgaagcgaaactgaacaccgatctccagcatctaacgtgcttcatcggcggcatgttcgctctcggcgggcgtctcttccaagacgagcaccacgttgacctcggcgccaaactaacaaaaggatgtatatacacctacgccgcctttccaaccggcatcatgcccgagaccttctccatgatgccctgcgacagccgctcttcctgccccttcaatcacacccaatggaccgaagagaagcacgagacgtgcacttcacccgccacagacgataccacttccgagacgaagcaatgccgcattcccccaggcttcatcggcatatccgacccccgctacctgctcagaccagaagcgatcgaatctgtattcatcatgtaccgcatcactgccgaccgcgcatatctgcatcatgcatgggacatgtttatatcgatcgtcaccgcatctcgcacgccgtttgcaaatggccaggtgcgtgacgtcacattcatcccaccgacgatgccgggcaataaggtccctggtgtccgcggccagatgcgcacgcgcgaagacaatgtggaagataaaatggagagtttttggaccgcggagacgctcaagtacttttatctggtgttcagtcgcgaggatatgattaatttggacgagtgggtgtttaatacggaggcgcatccgttaaggcggccgacggttggggactga

SEQ ID NO: 7433 - protein, 637 aa, Phaeosphaeria nodorum
MGKIKVGGGGRPYQAMSRQHKRTLTWLLLGTIAFGAYYMWSAYPDRLAVPFASHETYMNTRQAQSPLKSQQSYDWRQAPFINKIKEYIPLPQQPVRNLPQVQADFPPETRSQRRWREERRVAVRDEFQRSWESYREFAFGLDELLPATGGSVNTFGGWGATLVDSLDTLWIMGFKDYFYEAVEAVAVIDFGKSDMESISVFETTIRYLGGLLSAYDLSQEPVLLEKAIQLGEMLYRAFDTTNHTPLGGLNIEDAKNTHRSEFPADMNLCFACLGSLTVEFTRLAQITENKKYYDIVARISKMMRHAQDTTQMPGLWPTTINAAKEDFNSSRYFSIGALADSTYEYFPKMHALLGGVEPIYEKLYKDSAAMIDKHMLFRASIPDEKLGADLLFSGDVYSPSQGEAKLNTDLQHLTCFIGGMFALGGRLFQDEHHVDLGAKLTKGCIYTYAAFPTGIMPETFSMMPCDSRSSCPFNHTQWTEEKHETCTSPATDDTTSETKQCRIPPGFIGISDPRYLLRPEAIESVFIMYRITADRAYLHHAWDMFISIVTASRTPFANGQVRDVTFIPPTMPGNKVPGVRGQMRTREDNVEDKMESFWTAETLKYFYLVFSREDMINLDEWVFNTEAHPLRRPTVGD

SEQ ID NO: 7434 - DNA, 2769 bp, Phaeosphaeria nodorum
  CDS (1)..(2769)
atgtttcgataccggagatatcgtgttttcttggtgtttgccgttgttgcgctgtttgcgctgtacaagtttggagcatctgggacgacatggcgcgacgctgcatcgactgcagcggaactaaagaatgaggccgaggatgctctaggattcgggttcaagccacgccctcccatagcacacgacacgaagaagctggaactggatattccggtcgcaagcagaacgcaagcgctgcagacgccgccgcccgcgaagacgattccatcgctgtcgccctcgagtcctgtcgtgacagagaagccgcagccacagaagcccgcgatcccgccccctctgcaacccaaaccacacggcaaccctgcgccgctcgacgacgcctccaccagcattgaacccattcactggtctaagttgcccgagaagttccctgtccccacgcagtccatcatcaagctgcccacgggcaaacctcgcgacatacccaagatacagcacaagttcaagcccgaagatgcggcagcaaagacagaccgattagcaaagctggatagaatccgcgctgtcttccaaaagtcgtggagcggatacaaagagttcgcctggttgcacgatgagctgaaaccgcactcgggcacttttagggatccttttgctggctggggcgcaacgctggtcgatgccctggacacgctgtgggtcatgggcatgaaggacgagttcagcgccgcggcccaggccgtggaccagatcgacttcaccacgacaccccgcgccgacatccccctcttcgagaccactatccgctatctaggaggtctgcttgcggcttacgatctaagcggcaagaagcacaagaacttgctggccaaggcaactgagctggccgacatcctactaagtgcctttgacaccccaaatcgcatgccagagacgtactactactggaggccacagttcgcttcgcaaaatcaccgtgctagcgtacgtgtggtactggcagagattggatccatgtccatggaattcacccgcctcgcccagctcaccggtgaccacaaatactatgatgcgatagcgcgcatcacggacaacctcgaagagttccagaacaatacgagactgactggcatgtggcccacgtacctggatgcctcggggtgtgggaaggtacatgcagatccactagcccaagcacggctcaatgatcataatactccgcttcaaccatccactgttccggcacccacgcagggcaagaaggaaattcctctccagttgccagatcctgtagtcctcgcacccaatggcgtgaatccgacttacgtagcatccccggaggaagacaccatcgcgctaggtaacgctggcaagggcacaatccgcaattgggatggcaagcctctggagaggcggcaacttgacgtcgaagtcgaggaccctccgatggtccaagcaggttcccaggatgattcgctacccgacgtagccccggctgaaactgcgttacctacactacccgtgtgtgtagaacagggtttcgtatcatcatctgagtttggccgtgaggagtataccctcgggggtttgtctgactcaacctacgagtatctacctaaacagtacttgctcttgggaggtcaagttgagaaatatcagaccatgtacgaacagtccatggacgtggtgaaggagcacttgatcttcagaccaatgttgccgaaagaggatgacgttctgttctgtggcaagctgaatgtgccatcgcgcgtgaaggacttggtccctggcgatttgactggcgaatatgcccatcttacatgctttgctggcggcatgttcggcatgggtgctaagctattcaatcgaccaaacgatcttgagattgcgaagaagctgaccgaaggctgcgtctgggcctatgacatgactcaaactggtatcatgccagagtcatttgaagcgataccctgcgagaatgcacaagagtgtgcttggaacgaaacactgtatttcgaaacaatcgacccaaatgcggatctccgccacgaagcctacaaggggcaaatgcaaatttttcactctcaggtggcgtccgcatcgtcttggtatgaggaacagcttgctgccatgaccgcgcctgcgaaggtggtagatccctcatatccagttttggcaacgccaacgcccatatatgcggataccttggacaagcgccaactggctcatttggtagatgatgcggagacaatagtaggtggagctgaagagccccagcacctgccaacgaaggtccaacctctgcaagatgacggggaagccaacctcgagcaaagtcaaacactacctgcatttccctatatctacacacccagtccaccgttaaaccataaggactatgtacagaaccgaatcaaagacgagcgtcttccaccaggcgtcacaaggatcggagcgcggaactacattctacgcccggaagccattgaatctgtatggtacatgtaccgcatcacgggcgacaaccactggcgcgaagtcggctggcgcatgtttctcgccgtggacaagcacacctcgactaagtacggcaattccgccattgatgatgtcacacagttgtccccgagcctcaatgacgaaatggagagcttctggctcgcggagacgttgaagtatttctacttgctttttgagacagaggacgtactaagcttggacgactgggtattgaatactgaggcccacccttttcgcaggcctacgtaa

SEQ ID NO: 7435 - protein, 922 aa, Phaeosphaeria nodorum
MFRYRRYRVFLVFAVVALFALYKFGASGTTWRDAASTAAELKNEAEDALGFGFKPRPPIAHDTKKLELDIPVASRTQALQTPPPAKTIPSLSPSSPVVTEKPQPQKPAIPPPLQPKPHGNPAPLDDASTSIEPIHWSKLPEKFPVPTQSIIKLPTGKPRDIPKIQHKFKPEDAAAKTDRLAKLDRIRAVFQKSWSGYKEFAWLHDELKPHSGTFRDPFAGWGATLVDALDTLWVMGMKDEFSAAAQAVDQIDFTTTPRADIPLFETTIRYLGGLLAAYDLSGKKHKNLLAKATELADILLSAFDTPNRMPETYYYWRPQFASQNHRASVRVVLAEIGSMSMEFTRLAQLTGDHKYYDAIARITDNLEEFQNNTRLTGMWPTYLDASGCGKVHADPLAQARLNDHNTPLQPSTVPAPTQGKKEIPLQLPDPVVLAPNGVNPTYVASPEEDTIALGNAGKGTIRNWDGKPLERRQLDVEVEDPPMVQAGSQDDSLPDVAPAETALPTLPVCVEQGFVSSSEFGREEYTLGGLSDSTYEYLPKQYLLLGGQVEKYQTMYEQSMDVVKEHLIFRPMLPKEDDVLFCGKLNVPSRVKDLVPGDLTGEYAHLTCFAGGMFGMGAKLFNRPNDLEIAKKLTEGCVWAYDMTQTGIMPESFEAIPCENAQECAWNETLYFETIDPNADLRHEAYKGQMQIFHSQVASASSWYEEQLAAMTAPAKVVDPSYPVLATPTPIYADTLDKRQLAHLVDDAETIVGGAEEPQHLPTKVQPLQDDGEANLEQSQTLPAFPYIYTPSPPLNHKDYVQNRIKDERLPPGVTRIGARNYILRPEAIESVWYMYRITGDNHWREVGWRMFLAVDKHTSTKYGNSAIDDVTQLSPSLNDEMESFWLAETLKYFYLLFETEDVLSLDDWVLNTEAHPFRRPT

SEQ ID NO: 7436 - DNA, 1839 bp, Phaeosphaeria nodorum
  CDS (1)..(1839)
atgtatcccttccatcgcctgcccttcctcgtaccggtcgctgagatgccgcgcattcgcacacgacacattctgatatgcacaattaccatactatggatttattacttcctcccacgcgatgaagctgtaccctttatatctcgccgcttctccaagcgcgatacagacgcattggcacgatacatgaacgatccgtctcatcgatcgaatatcacagcgaccaaaagcagcttcgattggctttctgtgaatttcacatacccaccgccacgcacgccgagactcccagcacccgtgacgaagcgtccacgcatacaagctcgattcaagaccgactcgcaggaggccgcagccatccaagacaagaggaggagagaagtcaaaagagtgtttggaaagagctgggctagttacaaaaaacaggcatggatgaaggatgcgctcaagcccatcagtgggcaggatgtcaaccagttttctggctgggcggcgacgctggtagacactttggatacgctttggatgatgggactgcgcgacgaattctacgagggcgtagaggcggtggcgacgatcgattttggccagagtactgcaccggctgtcaacatgtttgagacgtgtatacgatatctaggcggtctgattgctgcatacgatctcagtggccacaaggttctgaaagaaaaggcgattgaggttgggaacctgctgtacgctggtttcaacactgagaacggcatgccagtcgatttcatcaatttcgaggcggcgaagaccggggaggggctttccgtggagggccaagttgtgagcgcgagtcctggaaccattaccctggagttcagccgactgagccagatcactggagacgacaaatactacgcagcagtctcgcaggtcatggatgttttccgccaaggtcagaatgagacaaagttgcctggaatgtggccgatgtatgtaggaatggcagccaaagacgttgtatctggctttcaatttaccattgggggtaatgcagattctctgtacgagtatctacccaaggcgtttgcgttgcttggatcagcagatccaagttcgaaaaagtacgaggatatggcacgcttcttcatggacacggcgatggaaaacctcttctttcgacccatgatacccgaagaagagtatgacatcctgatttctggaaattgcgacgtcctcgaagatggaccacgccttgatcctgagagtgaacatctttcctgctttattggaggtctttatgccctaggtggacgactattcgagaataaaaaatacctcgagatgggcgtaaagctagcacgaggctgtgcatatgcctaccattcaatgcctaccggcattatgcctgagaggtataacatggccatgtgtccaggttcagatcgcctggaatcatgcgcgtggaacgagtcctacttcgaagcagaaacattgaagcgtcctgaatacaaatcccatcttcccaagggcttcaccacggcaaaggacccacggtatatcctccgacccgaggcgattgaatctgtcttcatcctttggcgcatcacaggggatccgtggtggcgcgagactgcgtgggatatgtttgaagcagtggccaaagcgacagacaccgagtacgcgaatgcagcggttttggacgttacggttcttggcgcagagaaggaagactatatggagagcttttggatggcagagacgttgaaatatttttatctatgctttacagacgcggatctgatcagtctagatgattttgtgttcaacacagaggcacatccgtttaggttggcgaagagaagatga

SEQ ID NO: 7437 - protein, 612 aa, Phaeosphaeria nodorum
MYPFHRLPFLVPVAEMPRIRTRHILICTITILWIYYFLPRDEAVPFISRRFSKRDTDALARYMNDPSHRSNITATKSSFDWLSVNFTYPPPRTPRLPAPVTKRPRIQARFKTDSQEAAAIQDKRRREVKRVFGKSWASYKKQAWMKDALKPISGQDVNQFSGWAATLVDTLDTLWMMGLRDEFYEGVEAVATIDFGQSTAPAVNMFETCIRYLGGLIAAYDLSGHKVLKEKAIEVGNLLYAGFNTENGMPVDFINFEAAKTGEGLSVEGQVVSASPGTITLEFSRLSQITGDDKYYAAVSQVMDVFRQGQNETKLPGMWPMYVGMAAKDVVSGFQFTIGGNADSLYEYLPKAFALLGSADPSSKKYEDMARFFMDTAMENLFFRPMIPEEEYDILISGNCDVLEDGPRLDPESEHLSCFIGGLYALGGRLFENKKYLEMGVKLARGCAYAYHSMPTGIMPERYNMAMCPGSDRLESCAWNESYFEAETLKRPEYKSHLPKGFTTAKDPRYILRPEAIESVFILWRITGDPWWRETAWDMFEAVAKATDTEYANAAVLDVTVLGAEKEDYMESFWMAETLKYFYLCFTDADLISLDDFVFNTEAHPFRLAKRR

SEQ ID NO: 7438 - DNA, 2142 bp, Phaeosphaeria nodorum
  CDS (1)..(2142)
atgcgcgcggagcttggatccctgccgatccattgctcaagtaacaatgaacacctggtcggaaccgcgcgttcgatgaactcgacacgcgacccgttcaacctccgatccaaagccaccccggcagcattttccctcctccaagccgccgcgcaaaagacagcgcactcgtccgcgcaagccctcgcctcgactagacaggctgtcgaggccaccacccaggcgctcagggactcagatatgtccttcgctgtcccgcgcaacgtgccgaatttcgaaaacgcccagcgtcgctttgaagataatgtctggaataagttctcggggactgagaagggattgccaatgtacaaagataaaccggaggggaaaagtcatgcgtatggggtcaaggggcggaggggttttttgaggagtaggaggggtgtgggcgtggttgcattggtgctgctggcgctggtgtattggtttgggtggagcagtgcgccggctgaggcggcggataagacgaaggagaagggcgcgagttggggcgccattgggggcggcgcgaagaagagcaatgttgattgggagaagaggagggaggatgtcaagaatgcgttcttgctgagctggcacgcgtatgagaagcatggatgggggtacgatgaataccacccagtgtcgaggaagggcaggtacatggcagaaccgaatggcatgggctggatcatcgtggatgcgctggacacgctgatgctcatgaacctcacgacggagctgaagcatgcgagggaatgggtgtcgacgactttggactacaacaaggaccaggatgtcaacactttcgagacgacgattcggatgctgggtggactcctctctgcgcattacttgcaagagacgctaccgggcatgaagccagacaaccaaaaagaggaagacttgttcctggagaaggcagacgacctcgccgaccgtctgatgggcgcatacgaatccccatctggcgtcccctgggccagcgtcatccttaaagacggcaaaggcgaggcctcccacgcagacggcggcgcatcctccaccgccgaagcaacctcactccagctcgaaatgaagtacctagcctacataactggcgaaggccactactgggagaaagctgagaaagtcatggaagtcgtcgacaacaacggtgccaaagacggccttctccccatcttcatctacgccgaccgcggctccttccgcggcaacgaaatccgtctcggcagcagaggcgacagctactacgaatacctcatcaagcagcatctccagaccggcgagtccatctaccgcgacatgtgggacgagtccctcgcaggcgtgaagaagcacctcctcacatacaccaagaacagccacttcaccgtcctcgccgagcgcccatccggtctcgacggccatctgcaccccaaaatggaccatctcgtctgcttctaccccggcaccatcgcgctcgccgccaccggcggcctctccgtctccgaagcacgaaaattgccctcttggggcaaacagcaggaagaagacctgatcctcgcccgcgaactcaccaagacatgcatgggcatgtaccgcgtaacccccacgggcctcgcgcccgaaatcgcacacttcgagctcgccgacccgccgcgcatgtacgccgacggcgtactcgagtctacatcgcccatggccgtcgagccccccgcagatgatcactggaaagacgacttcaccatcaagcccgcggacgcacacaacctgcagcgccccgagacggtcgagtcgctgttctacatgtggcgcatcacgggcgacgagctgtaccgcgagtggggctgggaaatgttcgaggcgtttgtcaagcacacgcttgtggagaatggagggggatttacgagcgtcggagacgttatggaggccgagacgctcaagtacttctacttgctcttcagcccgaatgatttgttgccgctcgatcagattgtgcttaataccgaggcgcatccgttcccgcggttcgatccgagtaagaagcgcttcaagacgaattggacgaggctgccgagggataaggaggggaatgtggtgcgtgagaagaaggcggaggaaactgctgcacatcgttga

SEQ ID NO: 7439 - protein, 713 aa, Phaeosphaeria nodorum
MRAELGSLPIHCSSNNEHLVGTARSMNSTRDPFNLRSKATPAAFSLLQAAAQKTAHSSAQALASTRQAVEATTQALRDSDMSFAVPRNVPNFENAQRRFEDNVWNKFSGTEKGLPMYKDKPEGKSHAYGVKGRRGFLRSRRGVGVVALVLLALVYWFGWSSAPAEAADKTKEKGASWGAIGGGAKKSNVDWEKRREDVKNAFLLSWHAYEKHGWGYDEYHPVSRKGRYMAEPNGMGWIIVDALDTLMLMNLTTELKHAREWVSTTLDYNKDQDVNTFETTIRMLGGLLSAHYLQETLPGMKPDNQKEEDLFLEKADDLADRLMGAYESPSGVPWASVILKDGKGEASHADGGASSTAEATSLQLEMKYLAYITGEGHYWEKAEKVMEVVDNNGAKDGLLPIFIYADRGSFRGNEIRLGSRGDSYYEYLIKQHLQTGESIYRDMWDESLAGVKKHLLTYTKNSHFTVLAERPSGLDGHLHPKMDHLVCFYPGTIALAATGGLSVSEARKLPSWGKQQEEDLILARELTKTCMGMYRVTPTGLAPEIAHFELADPPRMYADGVLESTSPMAVEPPADDHWKDDFTIKPADAHNLQRPETVESLFYMWRITGDELYREWGWEMFEAFVKHTLVENGGGFTSVGDVMEAETLKYFYLLFSPNDLLPLDQIVLNTEAHPFPRFDPSKKRFKTNWTRLPRDKEGNVVREKKAEETAAHR

SEQ ID NO: 7440 - DNA, 1713 bp, Medicago truncatula
  CDS (1)..(1713)
atgattcctcgtcgctactttttgacatgtctccttatctttcttctcgtactttccaccttctccttctctcactctcaaccccattggtcttccaagaaaaaacgcctcggagaaaaagttcgcaatatgtttcaccatgcctatgacaactatatgactcatgcatttccgcacgatgagctaaaacctctcacgaaaactttcaccgattccctaagcgagctgggaaatttgaagcttgaacgtttgccgcaagactacaatggttctgccctttcgctaattgaatcactgtctagccttgtgattatgggcaacaataccgaattcgagaagggagtacgctggctttcagaaaatctaaaatttgacgttgatgctcgcattaatctttttgagtgcaacattagagttcttggaggacttgtctctgctcatttactggcatctgattcttcaaagaagttgctacaaggatcttacaagaatgagctactaggcctggctgaagatttagggaaacgttttctaccagcgttcaatacgcctactggattaccatatgcatggattaacttgaagtatggagtaatggagaatgagactacagaaacaagcacttcagggtgtggttcgttgattcttgaaatgggtgctttatcaaaactgactggtgaccccatatatgaatcagtagctttacgagctctccgtaagctatggagtatgcagagcttattaaaattatttggaaccacacttgacgtgtcaactgggcaatggattgaacattcttcaggaattggagctggtgtagattccttctatgaatatctacttaaagctcatatccttttcggaaaggaggactattggagaatgtttcattctgcttatgttgcagtgcagaagcatttcagacacggtccctggtaccacgaagctgatatgaggacaggaagagcaacttattggcagcttacaagtcttcaagcattttggcctggcctacaggttcttattggggatatatctgctgctaattcatctcaccgtgagttcttctatgtgtggaagaaatttggagtgctgccagagaggtatttgctggaccatcagatgcttcatcctactgaaaaatattatccgttacgccctgagtttgctgagtcaacattctacttatatcaagctactaaagatccatggtatattgaagttggcgaattaatagtcaattcccttaatttacacacaagagtagaaggtgggtttgcaagcatcaaggatgtgacaactatgcagttagaagatcatcaacatagtttttttcttgctgaaacgtgtaaatatttgtatcttctctttgatgattcatttatggtcgacagtaattacgtatttaccactgaaggtcatccccttccagtactaagcacttggcatgaagagcttccacaaacatacattccaactaattggacaactctgaagagacaaccagcaaatcgagccagtgcaatgtcattgcaagtatgtcctgctatgactttaaattcaggtcaacatatagagagtgcttgccacatctccgatgttcgtagtgatcataggtgtttgactgataacgattgtggagttgatgcaactacctgtagaagaagatcatgtagcatggctggttattgtggactatggctcttcatttga

SEQ ID NO: 7441 - protein, 570 aa, Medicago truncatula
MIPRRYFLTCLLIFLLVLSTFSFSHSQPHWSSKKKRLGEKVRNMFHHAYDNYMTHAFPHDELKPLTKTFTDSLSELGNLKLERLPQDYNGSALSLIESLSSLVIMGNNTEFEKGVRWLSENLKFDVDARINLFECNIRVLGGLVSAHLLASDSSKKLLQGSYKNELLGLAEDLGKRFLPAFNTPTGLPYAWINLKYGVMENETTETSTSGCGSLILEMGALSKLTGDPIYESVALRALRKLWSMQSLLKLFGTTLDVSTGQWIEHSSGIGAGVDSFYEYLLKAHILFGKEDYWRMFHSAYVAVQKHFRHGPWYHEADMRTGRATYWQLTSLQAFWPGLQVLIGDISAANSSHREFFYVWKKFGVLPERYLLDHQMLHPTEKYYPLRPEFAESTFYLYQATKDPWYIEVGELIVNSLNLHTRVEGGFASIKDVTTMQLEDHQHSFFLAETCKYLYLLFDDSFMVDSNYVFTTEGHPLPVLSTWHEELPQTYIPTNWTTLKRQPANRASAMSLQVCPAMTLNSGQHIESACHISDVRSDHRCLTDNDCGVDATTCRRRSCSMAGYCGLWLFI

SEQ ID NO: 7442 - DNA, 1776 bp, Aspergillus fumigatus
  CDS (1)..(1776)
atgtggaagtggctgcagagtcttggggatccgacgaccgagattgaagatggccagcaccagaatatcgattggaatgcgcgaagggaaaaggtcagggatgcgttcattattagctgggatggatatgagcagcatggatggggatatgacgagtacaagccgatcacgaaagaaggaaaacagatggtcccaggagggttgggctggatcattgttgacgccctcgatacgctcatgatcatgaatctgacctcgcgggttcagcacgcgcgcaactggatccacaattcgctacaatacaaccaggaccacgacgtcaacacattcgagacgaccatccggatgttgggtggccttctgtcggcgcattatctttcgaccgcccatcccggactggccccaatcgcggacgacgatgcgggctcaccaggagaggatttgtatattgagaaggcgaccgacttggcggacagactgcttggggcttttgagtccaagtctggagtgccatatgccagcatcaatctgaatacgtcgactggtattccatctcatgcagacaatggggcttcatctacggcggaggctaccactgttcaacttgagttcaagtacttggccaagttgacgggagaagcggagtactggcgggtggtggagaaggtgatgcaagtggtcgatgaccagaagatggaagacggcctgctcccgatctatatctatccagactctggacatttcagaggagacaacatccgtctgggaagtcggggggattcttactacgagtatctcatcaagcagtatttgcaaacatctaaacaggagcccatctataaagagctctgggatgaatcgttgatgggcgtccgcaagcatctgattgcgtacaccaaaaatgctcagctaatgattttgggggagaggccgtctgggctccatgggaaactgtcgccgaagatggatcacctggtgtgcttcatgccgggaaccattgctcttggagccaccggcggcgtgccgttgagcgaagcccggaagtctcctgactggaatcaacggcgggacgaagaaattctgattgctcgggaattgatgaaaacatgctgggcgacatacctcgcgacgaagacgggtctggctccggaaatcacctacttcaccttggacgaccctccaaagatgttccacgacatgtacccggactcgacggcgagcgccggcaaccgcaagtcccagggggctgatttgccaatgaagtcacagcctctttacccgctggacgacgaaaccctcaagtggcgggaggacatccagatccaaagccaggaccgccacaatctccaacggccggagacggtcgagtcattgttttatatgtaccgcatcaccggggacgagatatatcgccagtggggatgggagatgttcaagtcctttatccgccacacggcagtggttgaacatgaccactcgcacgagaccgattcccctgccgatgccgctgccggaagccaatccgagaaagtcgcgcgtccctcgcggattacgggattcacgtcgctgagcaacgccaacaccgtgccccctgtaccccgagacaacatggagagtttctggatggcagagacgctcaagtatttctacttgttgttttccgaccgggactttatctccctggaggaccatgtgttcaacacggaagcgcatccgctgccacggtttcagcctacgggtgatttgaagacggggtggacgcggaagcctcggtag

SEQ ID NO: 7443 - protein, 591 aa, Aspergillus fumigatus
MWKWLQSLGDPTTEIEDGQHQNIDWNARREKVRDAFIISWDGYEQHGWGYDEYKPITKEGKQMVPGGLGWIIVDALDTLMIMNLTSRVQHARNWIHNSLQYNQDHDVNTFETTIRMLGGLLSAHYLSTAHPGLAPIADDDAGSPGEDLYIEKATDLADRLLGAFESKSGVPYASINLNTSTGIPSHADNGASSTAEATTVQLEFKYLAKLTGEAEYWRVVEKVMQVVDDQKMEDGLLPIYIYPDSGHFRGDNIRLGSRGDSYYEYLIKQYLQTSKQEPIYKELWDESLMGVRKHLIAYTKNAQLMILGERPSGLHGKLSPKMDHLVCFMPGTIALGATGGVPLSEARKSPDWNQRRDEEILIARELMKTCWATYLATKTGLAPEITYFTLDDPPKMFHDMYPDSTASAGNRKSQGADLPMKSQPLYPLDDETLKWREDIQIQSQDRHNLQRPETVESLFYMYRITGDEIYRQWGWEMFKSFIRHTAVVEHDHSHETDSPADAAAGSQSEKVARPSRITGFTSLSNANTVPPVPRDNMESFWMAETLKYFYLLFSDRDFISLEDHVFNTEAHPLPRFQPTGDLKTGWTRKPR

SEQ ID NO: 7444 - DNA, 2031 bp, Oryza sativa subsp
  CDS (1)..(2031)
atgcagccggcgctgcgacggcggcggcggcgccaaggcttcctcctccccttcgcctgcctctccgccgccctcatcgccgctgccctgctccccggcgccgctttcgccgatggcgtcacgccctccgaggcccgccggctccgcgacgaggtcaaagatatgttctatcatgcatttgatgggtacatgcaacatgcttttccacttgatgaattgcggcctttaagttgccaaggagaagattcacttggtggctatgcacttactcttatagactctttggataccttggctttactaggggataaggagagatttgatgctgccgtggagtgggttggtaagaatgtccgctttgatattaataaaactgtctctgtttttgaaaccaacatacgcattcttgggggtctgctatcagctcacctgattgccagtgattatgcaactggaatgagaattcaatcttatgatgatcagttgcttcatttagcggctgacttagctcaaagattgctacctgcatttgacactccaacaggtattccatttggatcagtaaatttattgtatggagtcgatgaaaatgaaagcaagataacttcaacagctggtggtggcactttgacactggaatttggtgtcctgagtcgtttgactaatgatagcgtttatgaacgagttacaaaaaactctgtgcgtggaatatgggcacgcaggtcgaaacttgaccttgttggtgcccatataaatgtatttactggtgaatggacacagaaggatgcaggaattggcacaagcattgactcattctatgagtatcttctaaaggcgtatttattatttggagatgaagaatatttgtatatatttcaggaggcttacaaggctgccatgcattatctccatcatgatccctggtatgtggaggtaaatatgaattctggtgctactgtttggccactattcaacagtctccaggcattctggccaggacttcaggtgttagctggagatgttgatcctgccattcgaactcatgctgccttcttcagtgtatggaaaaaatatggcttcaccccagaagggtttaatcttgctacatccactgttcagaatggacaaaggagctacccgctgcggcctgaattgattgaaagcacatattggctgttcaaggctactagagattataggtaccttgatgttggaagggatatattagcaagccttcaatatggtgctaaatgtccatgtggttactgccatatttcagatgtagaaacccaccagcaggatgaccacatggagagttttttccttgcagaaacagtcaaatatctctggcttctttttgatttagctgcaggccctgataatattgttgaaaatgggccatataaatacatatttagtacagaaggtcatctgttgcctgctactcctcagataaccttgttagatgagcattgcttgtatgctggagcattctgcaatggtactgcaggccatggatatggtaccggtgatagttctaataagcatcaaaatgcaaactctgttccgttcgatgatagtcgaacaccttccgatcaatctttatccaatattttgtctacgacaagagggtacatcaagggagtttgtccaggattaactcatgcccagaaacttggcatatcatactctgccgaggaggataactcaatacagcagaattctggaagtagtgagaatcttgatgaatcacacgtgatcaaatccagtgtccaagctcaatcaagttctgttatattgatatcgcatccagtcgcaagccaaactgaggagcctacgtcgggcagaagtcagtacaatgcaaacattgtggcaactgctgagtctgtagggactgatactgccggcgcctcatcccaccccgaggatcttgttaaggaaactgagagcgtctctgaacagaaagaaatcaatgacaaagagatcgcttctcagggtagtcaaccgaccgaaggaagatacctgacctaa

SEQ ID NO: 7445 - protein, 676 aa, Oryza sativa subsp
MQPALRRRRRRQGFLLPFACLSAALIAAALLPGAAFADGVTPSEARRLRDEVKDMFYHAFDGYMQHAFPLDELRPLSCQGEDSLGGYALTLIDSLDTLALLGDKERFDAAVEWVGKNVRFDINKTVSVFETNIRILGGLLSAHLIASDYATGMRIQSYDDQLLHLAADLAQRLLPAFDTPTGIPFGSVNLLYGVDENESKITSTAGGGTLTLEFGVLSRLTNDSVYERVTKNSVRGIWARRSKLDLVGAHINVFTGEWTQKDAGIGTSIDSFYEYLLKAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYGAKCPCGYCHISDVETHQQDDHMESFFLAETVKYLWLLFDLAAGPDNIVENGPYKYIFSTEGHLLPATPQITLLDEHCLYAGAFCNGTAGHGYGTGDSSNKHQNANSVPFDDSRTPSDQSLSNILSTTRGYIKGVCPGLTHAQKLGISYSAEEDNSIQQNSGSSENLDESHVIKSSVQAQSSSVILISHPVASQTEEPTSGRSQYNANIVATAESVGTDTAGASSHPEDLVKETESVSEQKEINDKEIASQGSQPTEGRYLT

SEQ ID NO: 7446 - DNA, 2106 bp, Oryza sativa subsp
  CDS (1)..(2106)
atgagcggcggcggcggcggctcgggccccctcccctactcgatgcgcgatgtggacggccgcggcgcctacaacaacgccaagttccgccaccgatctcgcctcaaggttttgctccctcccgatccccttccacccctcccatttctttccccgcgaggagatgtagaaggtgtggaatctggttggcttgagggattcatggctccccgatctgtgggtttagctgctgccgaattagttcttggtcatgtccgtgggcgtctgcgccttaggatggcctctcaggctctgtttaccaatagcagcaagtaccaatgtggaaagttcactgttggaaaatttttgagtcttttaatggtttctggcgtaatatacttacttgtgcacaaaagttcggatggttttgtatccggtgagctccatgaaaaagtagggaatacacataccaagaaagattttcccaaaattcgtacattttggagaaagccaccaaggctgccgccacgtcttcctccaaatgaaatctatagaaacaattcattgcttctacagtctcctcaatctgaatggacactcagacagaagaaagttaaagaagcatttgaacatgcatggtctggctatcgaaattatgcaatgggttatgatgagcttatgcctttaacccgccgaggtatagatggactaggaggtctaggcgctactgttgtagattctttagacactgcaataataatgggtgctgatgatgttgtttccgaagcatcaaaatggattgaagataatctcatgaaaaagttaagtgagaaagggcaggtcaatctatttgaaactactatccgtgtcttgggagggcttcttagtgcctatcacttgagtggtggtgacaaagcaagaggtgactctgggataccaatgacatctaaaagggctaatccggagcgtcttttggaagtttcaaaggacttggcagacagattattgttagcctttacatcaagcccaactgctatacctttaagtgatgttgttcttcgagatcgaactgcacatgcagcccctgatggtttaagcagtacctctgaggctacaacattgcagctggagtacagttaccttagcacaatatcaggagatccaaagtatgacttagaggcaatgaaagtgttagagcatatgcgaacactcccaacagtggagggtttggttcctatttacatcaatccctcctctggtcaatttagtggagaaaatattcgattaggatctcgtggtgacagttactatgaatacctattgaaagtatgggttcagcaagaaagatatcgtgacactagtttgaagtatctatttgaaatgtatacagaagcaatgaaaggggtcaagcatcttcttgttcgaaaaactattccaaatgggctggtcttcgttggggagctcccctatggacgaaatagtggttttagccctaaaatggatcacctggtgtgttttcttcctggtacccttgctctgggtgcaacgaagggtataaccaagaaaaaagctcttgaaaatcatttattgactgcggaagacatagacaatctgcagcttgctgaagatttggccaaaacttgtgttgaaatgtactttgtgacatctactggacttgctcctgaaattgcttattttcacattgagggtaattctgagggaggacctgatggtgggaacaaaagttctcaatatgttaatgatatcataatcaaacctctggatcgtcacaatcttttacgcccagagactgtagaatcactatttgttttatatagaatcacagaggatccgaagtatagggaatggggttggcagatttttcaggcttttgagaagtatacaagagttgattctggtggctatacttcattggatgatgtcacaagcttgcccccacctaggagagacaaaatggaaactttcttccttggagaaacactgaaatacttgtatttgctgtttggtgaaagcaatattcttccattagataagtatgtattcaacacagaggcccatccacttccaatcattcagtctgcacaacagatctctcattcggtatag

SEQ ID NO: 7447 - protein, 701 aa, Oryza sativa subsp
MSGGGGGSGPLPYSMRDVDGRGAYNNAKFRHRSRLKVLLPPDPLPPLPFLSPRGDVEGVESGWLEGFMAPRSVGLAAAELVLGHVRGRLRLRMASQALFTNSSKYQCGKFTVGKFLSLLMVSGVIYLLVHKSSDGFVSGELHEKVGNTHTKKDFPKIRTFWRKPPRLPPRLPPNEIYRNNSLLLQSPQSEWTLRQKKVKEAFEHAWSGYRNYAMGYDELMPLTRRGIDGLGGLGATVVDSLDTAIIMGADDVVSEASKWIEDNLMKKLSEKGQVNLFETTIRVLGGLLSAYHLSGGDKARGDSGIPMTSKRANPERLLEVSKDLADRLLLAFTSSPTAIPLSDVVLRDRTAHAAPDGLSSTSEATTLQLEYSYLSTISGDPKYDLEAMKVLEHMRTLPTVEGLVPIYINPSSGQFSGENIRLGSRGDSYYEYLLKVWVQQERYRDTSLKYLFEMYTEAMKGVKHLLVRKTIPNGLVFVGELPYGRNSGFSPKMDHLVCFLPGTLALGATKGITKKKALENHLLTAEDIDNLQLAEDLAKTCVEMYFVTSTGLAPEIAYFHIEGNSEGGPDGGNKSSQYVNDIIIKPLDRHNLLRPETVESLFVLYRITEDPKYREWGWQIFQAFEKYTRVDSGGYTSLDDVTSLPPPRRDKMETFFLGETLKYLYLLFGESNILPLDKYVFNTEAHPLPIIQSAQQISHSV

SEQ ID NO: 7448 - DNA, 1936 bp, Arabidopsis thaliana
  CDS (83)..(1801)
aattcatggtttcaatttcttcttcttctcctttttcaaaaatttgtcacctccgagatcagatctgatcgtcggaattgagatggcgaggaataaacttgtaagtggtagtcatgggatatggaaatatttcaacccagcgttttatctccgaagaccaagacgtcttgctttgctcatcatcctcttcgtctctgtttcaatggttgtttgggatcgtcaatctctttcccgagactaccagtttgaagtttccaagttaaatgaagaagttttgcggttgcagcagatgttggaagagataaagagcgtcactgaggatgtgtctgtcaatagtttgaaggatgttcaggaagatccagttgatgctcagcgaatgcagagagttaaagaggcaatggttcatgcttggagttcacatgaaaagtatgcctggggacaagatgagcttcagccccagacaaaggatggtgttgacagctttggtggcctgggtgcaactatgatagatgcattagacacactatatataatgggtctagatgagcagtttcagaaagccagagagtgggtagcaagctcattagatttcgacaaggattatgctgccagtatgtttgagacaaccataagagtggtaggagggcttctcagtgcgtatgatctttctggggataaaattttccttgaaaaggctatggatattgcagacagattattgcctgcatgggacactcaatcgggtataccatataatattatcaacttgaagcatggaaatgctcacaatcctacatgggcggggggagacagtattcttgcagattctggtactgagcagcttgaatttattgccctttcccagaggacaggggacccaaaatatcagcaaaaggtagaaaaggttatttcagtgctaaataagaacttccctgctgatggtttacttccgatatatataaatcccgatacagctaatccatcgcagtctacaataacatttggtgccatgggagacagcttttacgaatatttgctcaaagtttgggtgtttgggaacaaaacttcagcagtgaaacactatagagatatgtgggagaagtcaatgaatggtctgctaagcttggttaagaaatcaacacctttgtcgtttacatatatctgtgagaagagtggaaattctttgatcgataagatggatgaattggcatgctttgctcctggaatgttggctttaggagcatctgggtatagtgatcctgctgaaggaaagaagtttctcacactcgctgaagagcttgcgtggacatgttataacttttaccaatcaactccaacaaaactggctggggagaattatttcttcaactctgggagtgacatgagtgttggaacgtcgtggaacatcttgagaccagaaactgtcgaatcactgttttacctctggcggttaactggaaacaagacatatcaagagtggggatggaatatatttgaagcatttgagaagaactcgcgcatagagtctggatatgttggtttgaaggatgttaatacaggcgttaaggacaacaagatgcaaagtttcttccttgcagagacactcaagtatctctatctactcttctcgccgacaacagtcattcctttagacgagtgggtattcaacaccgaagctcatccacttaagattaagtctcgaaacgatcaggtaaatctcaaacaatccaacaaagtactgctacgaaaaccggcatttagaatacgccagaggcattatggtcggataacaaagaagtaaaactccctggagaggtcacagtgtgattcgtaggaggggctctatggatatatcttaacagagcaattggatttagcttggctattcaaagacccttttatttaagaaaccatttttgcaaaaaaaaaaaaaaaa

SEQ ID NO: 7449 - protein, 572 aa, Arabidopsis thaliana
MARNKLVSGSHGIWKYFNPAFYLRRPRRLALLIILFVSVSMVVWDRQSLSRDYQFEVSKLNEEVLRLQQMLEEIKSVTEDVSVNSLKDVQEDPVDAQRMQRVKEAMVHAWSSHEKYAWGQDELQPQTKDGVDSFGGLGATMIDALDTLYIMGLDEQFQKAREWVASSLDFDKDYAASMFETTIRVVGGLLSAYDLSGDKIFLEKAMDIADRLLPAWDTQSGIPYNIINLKHGNAHNPTWAGGDSILADSGTEQLEFIALSQRTGDPKYQQKVEKVISVLNKNFPADGLLPIYINPDTANPSQSTITFGAMGDSFYEYLLKVWVFGNKTSAVKHYRDMWEKSMNGLLSLVKKSTPLSFTYICEKSGNSLIDKMDELACFAPGMLALGASGYSDPAEGKKFLTLAEELAWTCYNFYQSTPTKLAGENYFFNSGSDMSVGTSWNILRPETVESLFYLWRLTGNKTYQEWGWNIFEAFEKNSRIESGYVGLKDVNTGVKDNKMQSFFLAETLKYLYLLFSPTTVIPLDEWVFNTEAHPLKIKSRNDQVNLKQSNKVLLRKPAFRIRQRHYGRITKK

SEQ ID NO: 7450 - DNA, 2138 bp, Arabidopsis thaliana
  CDS (190)..(1875)
atgtcgaaatctctaccatattcagttaaagatattcattacgacaatgccaagttcagacatcgatctcctttaaaggttttttctcaaagcttgcttactcttagtacaaaacgcaactacgctagctgtagcacggggaagttccttatattaatactgttctttggagtagcatgtctaatgctgatgagtaagagtccaaatgaatctggtcttaatgagaaaggaaaggtcacttttgttgggggacttaggctagggggacttttgagaaagccacctaggcttccacctcgtttatcacctgacgaaggacaattaagaggaagttccactaatggctcaactatttcaaattctgacccaaaatgggcagctaggcagcaaagtgtaaaagaggcttttgaccatgcatggtctggctatagaaagtacgccatgggttatgacgagctaatgcctattagccagaaaggtgtggatggtttaggaggattaggtgccactgttgtggatgctcttgatacagccatgataatgggtcttgataatatcgtctctgaagcaggatcatgggttgagactcatctcttggagagaatcagtcaaaaaggtcaagttaatttgtttgaaactacaatacgtgtcttaggtgggcttctaagtgcataccatttgagtggaggagagcagggtacggtgaacatgacccatgttggaccgaaaccagtcatctatctaaatattgctaaggatttggctgaccgtctactttcggcttttacctccagccctactccagttcccttttgtgatgtcatattgcatgaatcgactgctcatccagctccaggaggagcgagcagtacagcagaagttgcctctgtacagcttgaatttaactacctcagttctatttctggtgatccaaagtatagtacagaggccatgaaggtcttagctcatataaaaacacttccaaagacagaaggtcttgttccaatctatatcagccctcaaacaggtgactttgttggtgagaatatcaggttgggatctcgtggtgatagctactatgagtatttaattaaggtgtggcttcagcaaggagctaagttgaatagtaatttcacatatttgcatgatatgtacattgaggcaatgaaaggagtcaggcatttgcttgtgcaaaattcaattccaaaaggtctggtctttgtaggggagttaccttacgggtctaagggagaattcagtccaaaaatggatcatttggtatgcttcttgcctggtactcttgctctcggtgctaccaagggcctcacaaaggaacaagccctgaaggaaaatcttttgtcctttgaggacctagaaaatctgaaacttgcagaagatttagcgaaaacatgctttgagatgtatgaagtaactgccactggccttgctccagaaattgcttactttcacacaaaggattacactgaggatggtcttgatggtgggaataagagttctatgtatgcaaatgacataatcattaagcccgctgatcgacataatctactgcgccctgaaactgttgaatcactctttgtcctctatcgtatcacaaaagatacaaaataccgagatcaaggttggcaaatttttgaagcttttgaaaagtacacaaaggtgaaatcaggtggatacacatcattggatgatgtaacagaagtgcctcctcatagaagagataagatggagacatttttccttggtgaaacattgaagtacttatacttgctctttggagatgactcagtgataccattggataagtttgttttcaacactgaagctcatccattaccaataagaagaaacacctgaaggcttagttttgaagactactccagacaatacacacacacacacacatacacaaacttaagagagggtatggagaaagtgatgtatagtacactgccaattggagaagaagttagttcgttgaggaaaaaaagtcataactttcaatgtaagataagcttctgcatccaaattataacttaactcgtaaaagtttttgcttgtagtagtaggtttcttgagactaatattctctcttttcgttaagctctcacttggcaaaa

SEQ ID NO: 7451 - protein, 561 aa, Arabidopsis thaliana
MSKSPNESGLNEKGKVTFVGGLRLGGLLRKPPRLPPRLSPDEGQLRGSSTNGSTISNSDPKWAARQQSVKEAFDHAWSGYRKYAMGYDELMPISQKGVDGLGGLGATVVDALDTAMIMGLDNIVSEAGSWVETHLLERISQKGQVNLFETTIRVLGGLLSAYHLSGGEQGTVNMTHVGPKPVIYLNIAKDLADRLLSAFTSSPTPVPFCDVILHESTAHPAPGGASSTAEVASVQLEFNYLSSISGDPKYSTEAMKVLAHIKTLPKTEGLVPIYISPQTGDFVGENIRLGSRGDSYYEYLIKVWLQQGAKLNSNFTYLHDMYIEAMKGVRHLLVQNSIPKGLVFVGELPYGSKGEFSPKMDHLVCFLPGTLALGATKGLTKEQALKENLLSFEDLENLKLAEDLAKTCFEMYEVTATGLAPEIAYFHTKDYTEDGLDGGNKSSMYANDIIIKPADRHNLLRPETVESLFVLYRITKDTKYRDQGWQIFEAFEKYTKVKSGGYTSLDDVTEVPPHRRDKMETFFLGETLKYLYLLFGDDSVIPLDKFVFNTEAHPLPIRRNT

SEQ ID NO: 7452 - DNA, 1878 bp, Ophiostoma novo
  CDS (1)..(1878)
atggccacccgctggaataaacggcgattggccgtcacccttttgctcacgggcatcattggccttttgtactaccagtcgaaccaccaggaggctggagcttacccgtcatcgcggctgaccgacgaccagacgttctcatcgccggcagacagcagcacccccaacacgccgacacttgaccttcacgatggcaagtttcattttgcatcactgaagctactcaacccaatcgaccccgagaagatgcggcggctgccgcgcgtcagcccggtgatgctcaatggcatccccaagatccagcacacatttggcgcagagtcggccgacgccaaggccgtgcgattggcccgcctggagcaggtgcgcaacaactttacacacgcatggacgggctacaagaaacatgcatggatggcggacgagctgaagccggtcaagggcacgggtgcatcgcactttggcggctggtcggccacgctggtggacacactggacacgctttggatcatgggattccgcgacgagtttgagatcgccgtggctgccgctgagaagattgacttttccaaaacagacgtgcaggaggtcaatgtgtttgagacgaccattcgctaccttggcggcttcctggcggcctatgacttgtccgagggccagtacccgtcgctgctgctcaaggccattgagctgggcgacatgctgtacttggcctttgacacgcccaaccatgtgccggtgacgcggtggaagatgtctgagcgccgcaagggcaatgcgcaggtgccgcacaagacctcgctggtgtcggagctgggctcactgtcgctcgagtttactcggctgagccagctgacgggcaacaacaagtactttgacgccatccagcgcatcatggacatgttttccctgcagcaggacctgacgcacctgccgggcatgtggcctgtgattgtggacgctgagcacggtgactttacaggcagcaccgcttttacgattggcggcatggccgactcgctgtacgagtacctgcccaaagagcacctgctgctgggcggcgctgtgtcgccgtaccgcgaaatgtacctcaagtcgctcaacgcgatgaacaatcacatcttcttccggccgcacgtcaataacgccaagccaatcctgtttgccggcgacaagaacaccaatggccgcatccccttgagcgagattaagattcagcccaaggtgcagcatctgggctgttttgccggaggcatggtgggactggcatcgcgcttgtttgcccgcccagaggacatggagattgccaagcagctggtcgagggctgtatgtgggcctacgagtcggcaccggcgggtgtcatggccgagatctttacagtctcgccatgcccggccggcaccacggacccgtgcgagtggagcgagaaggcgtggctggaggacgtggccgccaagcaccggatcaagatgactgacgccaacggccagcccagtctcgacggcgtcaaggaggtcgtgcgcaacaacaagctctcaccgggtgtgctcaagtacgacgacaagcggtacattctgcggcctgaggctattgagagtgtgtttatcctgtaccgtctgacgggcgacaagacgctgatggaccgtgcctggggcatgtttgagtcgattgtggccaacacgcagacaccaattgcacacacggcggtgagagactgcacgaaccccaaggacacatgggccgacagcatggagagtttctggctggcagagacgctcaagtacttttaccttatctttgagacgcccgatgttgtcagcctagacacgtatgtgctcaacacggaagcacaccctctgcggcggccatcattgtag

SEQ ID NO: 7453 - protein, 625 aa, Ophiostoma novo
MATRWNKRRLAVTLLLTGIIGLLYYQSNHQEAGAYPSSRLTDDQTFSSPADSSTPNTPTLDLHDGKFHFASLKLLNPIDPEKMRRLPRVSPVMLNGIPKIQHTFGAESADAKAVRLARLEQVRNNFTHAWTGYKKHAWMADELKPVKGTGASHFGGWSATLVDTLDTLWIMGFRDEFEIAVAAAEKIDFSKTDVQEVNVFETTIRYLGGFLAAYDLSEGQYPSLLLKAIELGDMLYLAFDTPNHVPVTRWKMSERRKGNAQVPHKTSLVSELGSLSLEFTRLSQLTGNNKYFDAIQRIMDMFSLQQDLTHLPGMWPVIVDAEHGDFTGSTAFTIGGMADSLYEYLPKEHLLLGGAVSPYREMYLKSLNAMNNHIFFRPHVNNAKPILFAGDKNTNGRIPLSEIKIQPKVQHLGCFAGGMVGLASRLFARPEDMEIAKQLVEGCMWAYESAPAGVMAEIFTVSPCPAGTTDPCEWSEKAWLEDVAAKHRIKMTDANGQPSLDGVKEVVRNNKLSPGVLKYDDKRYILRPEAIESVFILYRLTGDKTLMDRAWGMFESIVANTQTPIAHTAVRDCTNPKDTWADSMESFWLAETLKYFYLIFETPDVVSLDTYVLNTEAHPLRRPSL

SEQ ID NO: 7454 - DNA, 2150 bp, Trichoderma reesei
  CDS (333)..(1904)
cgcatctgcagggggcgccatgtcttaaattggaagaggaggaattttatgcttcgcatgaggtacccgcttggccgcttgaagaacaattcgcattctggtggcgtaggcagtgtcgcgtcgcatgagggaccccctcttctcattctcctggctctgctgattccggaggaggaggaggagcatttgagaaagcattgaaatggacgtctctcccacccgtggcacttttatctgcagccccgtctcatgccttgagcctgggcaagtgtctctctcctcttcgccttggcgtccttgttgtcaaagcctgaactacagctgctgccaacatgagattccctagcagctccgtccttgccctcgggctcatcggacctgcgctggcgtatccaaagccgggcgccacaaaacgtggatctcccaaccctacgagggcggcagcagtcaaggccgcattccagacgtcgtggaacgcttaccaccattttgcctttccccatgacgacctccacccggtcagcaacagctttgatgatgagagaaacggctggggctcgtcggcaatcgatggcttggacacggctatcctcatgggggatgccgacattgtgaacacgatccttcagtatgtaccgcagatcaacttcaccacgactgcggttgccaaccaaggatcctccgtgttcgagaccaacattcggtacctcggtggcctgctttctgcctatgacctgttgcgaggtcctttcagctccttggcgacaaaccagaccctggtaaacagccttctgaggcaggctcaaacactggccaacggcctcaaggttgcgttcaccactcccagcggtgtcccggaccctaccgtcttcttcaaccctactgtccggagaagtggtgcatctagcaacaacgtcgctgaaattggaagcctggtgctcgagtggacacggttgagcgacctgacgggaaacccgcagtatgcccagcttgcgcagaagggcgagtcgtatctcctgaatccaaagggaagcccggaggcatggcctggcctgattggaacgtttgtcagcacgagcaacggtacctttcaggatagcagcggcagctggtccggcctcatggacagcttctacgagtacctgatcaagatgtacctgtacgacccggttgcgtttgcacactacaaggatcgctgggtccttggtgccgactcgaccattgggcatctcggctctcacccgtcgacgcgcaaggacttgacctttttgtcttcgtacaacggacagtctacgtcgccaaactcaggacatttggccagttttggcggtggcaacttcatcttgggaggcattctcctgaacgagcaaaagtacattgactttggaatcaagcttgccagctcgtactttggcacgtacacccagacggcttctggaatcggccccgaaggcttcgcgtgggtggacagcgtgacgggcgccggcggctcgccgccctcgtcccagtccgggttctactcgtcggcaggattctgggtgacggcaccgtattacatcctgcggccggagacgctggagagcttgtactacgcataccgcgtcacgggcgactccaagtggcaggacctggcgtgggaagcgttgagtgccattgaggacgcatgccgcgccggcagcgcgtactcgtccatcaacgacgtgacgcaggccaacggcgggggtgcctctgacgatatggagagcttctggtttgccgaggcgctcaagtatgcgtacctgatctttgcggaggagtcggatgtgcaggtgcaggccaccggcgggaacaaatttgtctttaacacggaggcgcacccctttagcatccgttcatcatcacgacggggcggccaccttgcttaaaggcgctgagagttctctcgcctgtttttttgctcgtattattcattttctgctgctcgtcccgaatcgctccgtagatattttgacacatgcgtctggatagagcggctgggaccaccgaatatggtatgtcattcgagatatgaagcgcaagagatctttaagatccaagttctctggtattatactggatgagatagatctataggaaaccctgtccgaattgtgtggaaaaaaaaaaaaaaa

SEQ ID NO: 7455 - protein, 523 aa, Trichoderma reesei
MRFPSSSVLALGLIGPALAYPKPGATKRGSPNPTRAAAVKAAFQTSWNAYHHFAFPHDDLHPVSNSFDDERNGWGSSAIDGLDTAILMGDADIVNTILQYVPQINFTTTAVANQGSSVFETNIRYLGGLLSAYDLLRGPFSSLATNQTLVNSLLRQAQTLANGLKVAFTTPSGVPDPTVFFNPTVRRSGASSNNVAEIGSLVLEWTRLSDLTGNPQYAQLAQKGESYLLNPKGSPEAWPGLIGTFVSTSNGTFQDSSGSWSGLMDSFYEYLIKMYLYDPVAFAHYKDRWVLGADSTIGHLGSHPSTRKDLTFLSSYNGQSTSPNSGHLASFGGGNFILGGILLNEQKYIDFGIKLASSYFGTYTQTASGIGPEGFAWVDSVTGAGGSPPSSQSGFYSSAGFWVTAPYYILRPETLESLYYAYRVTGDSKWQDLAWEALSAIEDACRAGSAYSSINDVTQANGGGASDDMESFWFAEALKYAYLIFAEESDVQVQATGGNKFVFNTEAHPFSIRSSSRRGGHLA

SEQ ID NO: 7456 - DNA, 2528 bp, Glycine max
  CDS (338)..(2074)
gcacgagattgaagcctccgcttcctctctccatgaaatttcttcactttgcaaaaccaaaacagattgaattgctattatccaaattcatctacttcttcttcttcttcatagccatgtacaggttttaattttaacgcctttttttattattagcctaacgaatcttcttataaaccctcaaacctcttgtgctgttcgcattccgataaacaaacacgcagatttgaaggaacgaaagaacgaccggccgttttgtttttgtttattaagaatttattggtttgcaaggaaaaataggacaaagttggtctgaagcttagatctttgtttgggaatggcgagagggagcagatcagtgggtagcagcagcagcaaatggaggtactgcaacccttcctattacttgaagcgcccaaagcgtcttgctctgctcttcatcgttttcgtttgtgtctctttcgttttctgggaccgtcaaactctcgtcagagagcaccaggttgaaatttctgagctgcagaaagaagtgactgatttgaaaaatttggtggatgatttaaataacaaacaaggtggtacctctgggaagactgacttggggagaaaagctaccaagtccagtaaagacgtcctagatgatcccattgatatcgagaggagggaaaaagtaaaagaagcaatgcttcatgcttggggatcttatgagaagtatgcatggggacaagatgaacttcagccacaatcaaagaatggtgtcaatagctttggaggtcttggagcaactttaatagattctcttgatacactatatattatgggtctcaacgaacagtttcagaaagcacgagaatgggttgcaaactctttggattttaacaaggattatgaagcaagtgtttttgagacaaccataagagtagtaggtggccttcttagtgcatatgatctttcaggggacaaagtattcctcgacaaagcaatagaaattgcagacagattactgcctgcatggaatacacctacaggaattccttacaacatcattaatttatcacatggacgagcacacaaccctagttggactgggggtgagagtatcttggcagattctggcactgaacaactggaattcattgttctatcccaaaggactggagacctcaagtatcagcagaaggtggaaaatgtaatagcccagctaaataaaacatttcctgatgatggattacttcccatctacattaatcctcatagtggggcagcaggctactctcccatcacattcggtgccatgggtgatagtttttacgagtacttgctcaaagtttggatacaagggaataagacttcatccataaaacattatagagatatgtgggagaaatcaatgaaaggcctgtcaagtttgattaggagatcaacaccatcttcttttacttatatatgtgagaagaatggaggatctctcacagacaaaatggatgaactagcatgctttgctccagggatgattgctttgggatcatttggttacagtgctgctgatgattcacagaagtttctgtcacttgcagaagagcttgcttggacatgttataacttctaccaatcaactccaacaaaattggctggagagaactatttctttcattctgggcaggacatgagtgtgggtacatcatggaacatactgaggccagagacagttgagtccctcttttacctttggcgtctaactggcaacaaaacataccaagaatggggttggaatatatttcaagcttttgagaagaactcccgcatagagtcaggctatgttggactgaaggatgttaatagtggagtcaaagacaacatgatgcaaagcttctttcttgcggagaccctgaagtatttttatcttctcttctcaccttcttcagtcatctcattagacgaatgggtattcaacacagaagcccaccctctgaggattgtgaccagacacgaagagggacttgttaagaatttaaatgagaagcaaaaacctttttctagaataggtggcagaaaggaaggaaggtcaggttagatatccattcttctctaccattgctgatcgaaccccttttaccaaaattaaagaagagcagtttgttccactatggagcttgtaagatgtcaggatttcctcattggggaggggtaaggggttcgttcattcagccacagatggtatctaatataggaaatagttcttcactgaagttcttaaaatgggtttattcaaggtgatctgaccttttattgatgaatgacccttttgaaattcacggcttataggttgttgtcctttatttttttctggaaccaaatattcagagcattatatataactgaggcatatatctgcgcattgaatagaagatacttcctgcctattaacatttttctttatattgcttttatttattacggaattttatggagcgcgttagtgttgtaaaaaaaaaaaaaaaaaaaaaaaaaaaaaaaaaaaaaaaaaa

SEQ ID NO: 7457 - protein, 578 aa, Glycine max
MARGSRSVGSSSSKWRYCNPSYYLKRPKRLALLFIVFVCVSFVFWDRQTLVREHQVEISELQKEVTDLKNLVDDLNNKQGGTSGKTDLGRKATKSSKDVLDDPIDIERREKVKEAMLHAWGSYEKYAWGQDELQPQSKNGVNSFGGLGATLIDSLDTLYIMGLNEQFQKAREWVANSLDFNKDYEASVFETTIRVVGGLLSAYDLSGDKVFLDKAIEIADRLLPAWNTPTGIPYNIINLSHGRAHNPSWTGGESILADSGTEQLEFIVLSQRTGDLKYQQKVENVIAQLNKTFPDDGLLPIYINPHSGAAGYSPITFGAMGDSFYEYLLKVWIQGNKTSSIKHYRDMWEKSMKGLSSLIRRSTPSSFTYICEKNGGSLTDKMDELACFAPGMIALGSFGYSAADDSQKFLSLAEELAWTCYNFYQSTPTKLAGENYFFHSGQDMSVGTSWNILRPETVESLFYLWRLTGNKTYQEWGWNIFQAFEKNSRIESGYVGLKDVNSGVKDNMMQSFFLAETLKYFYLLFSPSSVISLDEWVFNTEAHPLRIVTRHEEGLVKNLNEKQKPFSRIGGRKEGRSG

SEQ ID NO: 7458 - DNA, 1566 bp, Schizosaccharomyces pombe
  CDS (1)..(1566)
atggttaaacgaaggactgtcaaatactttcttcgtcgaattttggcactctttgtattatgcgttccaatatattatttatacacgactgtccaacgacctcctggttataccaaacttaaaggctccacgagaagaaaagcgctgattaagaaaacattcatagaaagctggacagactatgaaacttatggctggggtaaagatgaatactatcctattattaaacgtggacggaattaccttaggaagggcatgggctggatgattattgattcccttgatacaatgatgattatgggccttgatgaacaagttttacgtgctcgtgaatgggttaataattctcttacttggaaccaagatgacgaagaagttagtgtttttgaaactactattcgtatattgggaggactcctttcttcttatcacttgtctcaagacaaactatacctagaccgcgcagtggacctagctgatcgtttgctagctgcttataatacctccacgggcttacctagatcaaatgtaaacctaggaactcgtaaatctagaaaaagaactagagagtatttcgtaagcactgctgaatccggaactgttcagatggagctacgttatttatcctatcttactggcgatcctaaatattggataacggctgacaagacaatggaggtgttgctaggagatgctacttggtctcatactggcttggttcctattacggtaaatttgattacaggcgcctacgttggtcgaaatattcgactgggttctcacggtgattcctactatgagtatttactgaaacaagatcttcaattattttcaagtggtacagtatataggaaagcgttcgatttgagtgttgatggaattattgaatatctccttaattatactactcctaatcactttgcctacatagcggaacttcccggtggattagaacacgctcaacttccaaaaatggatcacttagtatgttttttacctggcacacttatgtggggagcaaccaacggtacttcattagaagcagcacgtacttccaaaaattggggtacacgtcaagaacgtgatgtaaagctggctcaagaacttatgcgaacttgttatgaaatgtacaacatgacagctactggtttagcacctgaaattgtgttttttgatgttgaccagactaaaaatgaaatttatagcaagcgtcgtgaccaacataatttgatgaggccagagacggtagagagtctgtttattctttacagaataacgagagatgaaatatatagagaatggggatggaacatatttgtttcatttttgagatattctcgattgcctggccgagatgcatttacatgtttggatagtgtagagtcgaagaaggttaaagaccaaagggacaaaaccgaatcattttggtttgcggagacgctcaagtatctgtaccttctatttgaagacgattttagtattttgcctttaacaaactacaccttcaatacggaagctcatccatttccaaatattgaaaacaatatggacctgtacacggtgtaa

SEQ ID NO: 7459 - protein, 521 aa, Schizosaccharomyces pombe
MVKRRTVKYFLRRILALFVLCVPIYYLYTTVQRPPGYTKLKGSTRRKALIKKTFIESWTDYETYGWGKDEYYPIIKRGRNYLRKGMGWMIIDSLDTMMIMGLDEQVLRAREWVNNSLTWNQDDEEVSVFETTIRILGGLLSSYHLSQDKLYLDRAVDLADRLLAAYNTSTGLPRSNVNLGTRKSRKRTREYFVSTAESGTVQMELRYLSYLTGDPKYWITADKTMEVLLGDATWSHTGLVPITVNLITGAYVGRNIRLGSHGDSYYEYLLKQDLQLFSSGTVYRKAFDLSVDGIIEYLLNYTTPNHFAYIAELPGGLEHAQLPKMDHLVCFLPGTLMWGATNGTSLEAARTSKNWGTRQERDVKLAQELMRTCYEMYNMTATGLAPEIVFFDVDQTKNEIYSKRRDQHNLMRPETVESLFILYRITRDEIYREWGWNIFVSFLRYSRLPGRDAFTCLDSVESKKVKDQRDKTESFWFAETLKYLYLLFEDDFSILPLTNYTFNTEAHPFPNIENNMDLYTV

SEQ ID NO: 7460 - DNA, 1698 bp, Zea mays
  CDS (1)..(1698)
atggctcggcggtcgtcttcctcgtcgtcggggacctggcggtacctgaacccggcgtactacctcaagcggcccaagcgcctggcgctcctcttcttcgtcttcgtcgcggccaccttcgccttctgggaccgccagtcgctcgtcagcgagtacgagtctgagatttcccgattagaagatgatataaatcggttgcatgaccagctaagaaaggctggagttaatctggatgaaaatccagtagtaagcaataagaattccagaaaagatcttgtagtagaaattgatcctgtcaataatgaaagacgggaaaaagttaaagaggcaatgctccatgcttggaattcttatgttaagtatgcctggggaatggacgagcttcagccacaatcgaagaatggtatcaacagctttggtggtcttggagcaacccttgttgactcacttgataccctatacataatgggcctgaaagatgaatttcagaaagctagagactgggtggcggagtcattagactttgacaaggattatgatgcgagtgtttttgaaacgaccataagggttgttggaggtctgcttagttcatacgatctatctggtgataaagtatttcttgataaggctaaagatattacagatcgactcttacctgcttgggatacaacatctggcatcccttataatagaataaacctagctcatggacgagcccataatcctggatggactaacggtgatagtatccttgcagattctggtacggagcaacttgaattcatagctctgtcacagaggactggagatcccaaataccagcagaaggcggagaacgtcattaaacagcttcaaaagatatatccaagtgatggtttactgcctatttacataaatcctcattctgggacagcatcatactcaactatcacatttggtgctatgggagacagcttctacgaatatttgctcaaggtctggatccaggggaataaaactgagcatgtaaaacactacagacaaatgtgggagacatcaatggaaggtctattaagtttaaccaagaaaactacaccatctaattactactacatttgtgaaaagaatggtggctcgttgtctgacaagatggatgaacttgcttgctttgctcctggtatgctggccttaggagcctctggttacgggccagaaaaatcagagcaaattatgaatcttgcaaaagagcttgctaggacctgctataatttctaccaaaccactcccacgaagttggctggagaaaattattttttccatactggacaggacatgggtgtggtcacgtcgtggaacatcttgagaccggagactgttgaatcactgatgtacctgtggcgcttgacggggaataaaacataccaagattgggggtgggacatattccaggcatttgagaagaactcccgcatagaatctggatatgtgggactgagagatgtgaacactggtgaaaaagacaacatgatgcagagtttcttcctggcagagacgctgaagtacctgtacctacttttctcccctccatcagtcatatccttcgacgagtgggttttcaatactgaagctcacccattgagaattgttccagtaagtgataacaaaggcattggaacaccggtccgacaattcgggagaaaacagggaaagcctgagtaa

SEQ ID NO: 7461 - protein, 565 aa, Zea mays
MARRSSSSSSGTWRYLNPAYYLKRPKRLALLFFVFVAATFAFWDRQSLVSEYESEISRLEDDINRLHDQLRKAGVNLDENPVVSNKNSRKDLVVEIDPVNNERREKVKEAMLHAWNSYVKYAWGMDELQPQSKNGINSFGGLGATLVDSLDTLYIMGLKDEFQKARDWVAESLDFDKDYDASVFETTIRVVGGLLSSYDLSGDKVFLDKAKDITDRLLPAWDTTSGIPYNRINLAHGRAHNPGWTNGDSILADSGTEQLEFIALSQRTGDPKYQQKAENVIKQLQKIYPSDGLLPIYINPHSGTASYSTITFGAMGDSFYEYLLKVWIQGNKTEHVKHYRQMWETSMEGLLSLTKKTTPSNYYYICEKNGGSLSDKMDELACFAPGMLALGASGYGPEKSEQIMNLAKELARTCYNFYQTTPTKLAGENYFFHTGQDMGVVTSWNILRPETVESLMYLWRLTGNKTYQDWGWDIFQAFEKNSRIESGYVGLRDVNTGEKDNMMQSFFLAETLKYLYLLFSPPSVISFDEWVFNTEAHPLRIVPVSDNKGIGTPVRQFGRKQGKPE

SEQ ID NO: 7462 - DNA, 2016 bp, Hordeum vulgare
  CDS (1)..(2016)
atgcggctgcggagccaaggccggggttcccccctcctctgcctctccgccgccctcctcgcggtcgccctgctccccggcgccgccgtcgcagacggcgtcacgcctaccgaggcgctccggctacgcgacgaggtgaaagatatgttttatcatgcatttgatgggtacatgcaacatgcttttccacttgatgaactgcgaccgttgagttgtcaaggggaagactcccttggtggttatgcacttactcttatcgactctttggatactctggctttactaggtgataaggagagatttgctgctggtgtggagtgggttggtaagaacgtccgctttgatatcaacaaaactgtctcagttttcgagaccaatatacgtatccttggcggtctgttatcagctcacttgattgccagtgactatgccactggtatgaagattgagtcttatgatgatcagttacttcatttggccgctgacttagcccagaggttattacctgcatttgacactcctacaggtattccatttggatctgttaatttactgtatggagtcgatgatgatgaaagcaagataacatcgacggctggtggtggcactttgacattggagttcggtgtcttgagtcggttgactaataacactgtttttgagcaagttaccaaaaattcagtgcgtgggatatgggcacgcaggtcaaaactcaaccttgttggagcccatataaatgtcttcactggtgaatggacacaaaaggatgcaggaatcggcacaagcatcgactcattctacgaatatcttctgaaggcatatttattgttcggagatgaagaatacttgtatgtatttgaagaggcttacaaggctgccatgcactacctccaccatgatccttggtatattgaggtaaatatgaattctggtgctactgtttggccactattcaatagtctgcaggcattctggccaggacttcaggttttagctggagatgtcgatcctgccattcgaacacatgctgccttctttagcgtctggaaaaaatatgggttcactccagaagggtttaatctcgctacatctactgttcagaatggacaacggagctacccgctgcggcctgagttgattgaaagcacatattggctattcaaggctaccagagattttaggtaccttgatgttggaagggacatactagcaagccttcaatatgctgctaaatgtccttgtggctactgccacatatcagatgtggaaacccacaagcaggatgaccacatggagagttttttccttgcagaaacggtaaaatatctctggcttctttttgatttagctgtaggccctgataacattgttgaaaatgggccttataaatacatattcagcacagaaggccatttgttacctgctactcccgaaatatccttggtagatgagcattgcctttattttgaagcattctgtaataacagtacagaccgtggctacatcagcgctgatggttccagtaaacatccaagtgttaactgcacccattttgatgaaagacagactgtttccagtcaaaattcattgtccaatgttttgtctacaacaagaggttacatcaagggagtttgtccaggattgagtcatgcacagaaacttggcatatcgtaccatgacaacacggtagagcagaattccagaagtcatgagaaccccgatgaatcttacacggaccaatccagtgtccagattcaatcaagttctgtgatattgatctctcatccagccacaagcccacccgatgagcctttggaaaccgggtcaagaactcaataccttgaaaatattgtggtaactggcgactctgagccggtagaagttagtggctcgtcccaagggaacaccgaaaaccttgctgaggacaccaccttaggcatctctgaacagatagaagttactgctgctgaagaggttgggtctcaggacattcatattgaagatggtaccagctga

SEQ ID NO: 7463 - protein, 671 aa, Hordeum vulgare
MRLRSQGRGSPLLCLSAALLAVALLPGAAVADGVTPTEALRLRDEVKDMFYHAFDGYMQHAFPLDELRPLSCQGEDSLGGYALTLIDSLDTLALLGDKERFAAGVEWVGKNVRFDINKTVSVFETNIRILGGLLSAHLIASDYATGMKIESYDDQLLHLAADLAQRLLPAFDTPTGIPFGSVNLLYGVDDDESKITSTAGGGTLTLEFGVLSRLTNNTVFEQVTKNSVRGIWARRSKLNLVGAHINVFTGEWTQKDAGIGTSIDSFYEYLLKAYLLFGDEEYLYVFEEAYKAAMHYLHHDPWYIEVNMNSGATVWPLFNSLQAFWPGLQVLAGDVDPAIRTHAAFFSVWKKYGFTPEGFNLATSTVQNGQRSYPLRPELIESTYWLFKATRDFRYLDVGRDILASLQYAAKCPCGYCHISDVETHKQDDHMESFFLAETVKYLWLLFDLAVGPDNIVENGPYKYIFSTEGHLLPATPEISLVDEHCLYFEAFCNNSTDRGYISADGSSKHPSVNCTHFDERQTVSSQNSLSNVLSTTRGYIKGVCPGLSHAQKLGISYHDNTVEQNSRSHENPDESYTDQSSVQIQSSSVILISHPATSPPDEPLETGSRTQYLENIVVTGDSEPVEVSGSSQGNTENLAEDTTLGISEQIEVTAAEEVGSQDIHIEDGTS

SEQ ID NO: 7464 - DNA, 1956 bp, Zea mays
  CDS (1)..(1956)
atgcagccgatccggcggcggcaccgaggctttgcactcctctgtctctccgccgccctcctcgctgccgccactctgctccccggcgccgccgtcgccgaaggtgtcacgccctccgaggcgcgccggctccgcgacgaggtgaaagatatgttctatcatgcgtttgatggatacatgaagtatgctttcccactcgatgagctgcggcccttaagttgccaaggtgaagactcccttggtggttatgcgctcactcttatcgattctttggataccttggctttactgggtgataaggagaaatttggtgctgctgtggagtgggttggtaagaatgtccactttgatattaataaaaccgtctctgtttttgaaaccaacatacgtatccttgggggtctgctatcagctcacctgattgccagtgattatgccactggtatgagaatccaatcttatgatgaccagttacttcatttagctgctgacttagctcagaggttgttgcccgcatttgacactcctacaggtattccatttggatctgttaatttattgtacggagtcgatgaaaatgaaagcaagataacatcaacggctggtggtggtactttgacactggaatttggcatattgagtcgcttgactaataatactgtttttgagcgagttacaaaaaaatcagtgcgtggaatatggtcacgcagatcaaaactcaatcttgttggtgcccatataaatgtctttactggtgaatggacacagaaggatgcaggaattggcacaagcattgattcattctatgaatatcttctaaaggcatatttattgtttggagatgaagaatacctgtacatttttcaggaggcttacaaagctgccatgcactatctccatcatgatccttggtacgtggaggttaatatgaactctggtgctactgtttggccactcttcaatagtctgcaggcattctggccagggcttcaggttttagctggagatgttgatcctgctattcgcacacatgctgccttcttcagcgtctggaaaaagtatggttttacccctgaaggttttaatcttgctacatccactgtacagaatggacaaaggagctacccgctacgaccagagttgattgaaagcacatattggttgttcaaggctaccagagattacagataccttgatgttggaagggacatattagcaagccttcaatatggtgccagatgcccttgtggttactgccacatatcagatgtggaaacccacaagcaggatgatcacatggagagttttttccttgcagaaacggtcaagtatctctggcttctttttgatttagctgctggccctgacaatattgttgaaaatggaccatataagtacatatttagtacagagggccatttgttacctgttactcctgagatagccttggaagatgaacattgttcatattttggagcattctgtaatggcggtgccgaccatggatatggtgctagtgctagttctactaagcatcgaaatggaaactatacccaattagatgatattcaaaccccttccagtcactattcaatgtccaatgtgttgtttacgccaggttacatcaagggagtttgtccaggattgactcatgcgcagaaatttgggatatcatactctgatgaagaggataactttatagagcagacttctgagagtcttgatcatcatggtgaatctgccatagaatctagcgtccaagaccaatcaagttctattatattgatctctcacccagtcgcaagccaacaggatgaggcttttgagagcgagtctggaagtcaagatcatgcaaatattgttgtaacttctgattctgattctgattccacaagccgtgataatactgttggctctcccggaatgaactcggaagaacttatggacgacatatag

SEQ ID NO: 7465 - protein, 651 aa, Zea mays
MQPIRRRHRGFALLCLSAALLAAATLLPGAAVAEGVTPSEARRLRDEVKDMFYHAFDGYMKYAFPLDELRPLSCQGEDSLGGYALTLIDSLDTLALLGDKEKFGAAVEWVGKNVHFDINKTVSVFETNIRILGGLLSAHLIASDYATGMRIQSYDDQLLHLAADLAQRLLPAFDTPTGIPFGSVNLLYGVDENESKITSTAGGGTLTLEFGILSRLTNNTVFERVTKKSVRGIWSRRSKLNLVGAHINVFTGEWTQKDAGIGTSIDSFYEYLLKAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYGARCPCGYCHISDVETHKQDDHMESFFLAETVKYLWLLFDLAAGPDNIVENGPYKYIFSTEGHLLPVTPEIALEDEHCSYFGAFCNGGADHGYGASASSTKHRNGNYTQLDDIQTPSSHYSMSNVLFTPGYIKGVCPGLTHAQKFGISYSDEEDNFIEQTSESLDHHGESAIESSVQDQSSSIILISHPVASQQDEAFESESGSQDHANIVVTSDSDSDSTSRDNTVGSPGMNSEELMDDI

SEQ ID NO: 7466 - DNA, 1815 bp, Zea mays
  CDS (1)..(1815)
atgcgatcccctgggcggcgcctaccagcgccggcgcggctcgtcgcggctgccctcctcctcgcagctctcaccgggggagccgtcggcgccgatgggtacgggcgggcgaggagggtgtacatgaagaacaaggtcctggagatgttttaccatgcctatgacaactacatgacttatgcattccctcatgatgaattgaagcctcttactaaaagtttcacggactcgcttagtgagcttggcaatttaaatcttgaacacttgccacaggattatagtggatccgcgttgacactggttgagtcattatcaagtcttgttgtcttaggtaacctcacagagtttgagagaggagttctctggctttcagaaaatctgacatttgatgttgatgctcggattaatctttttgagtgtaacataagacttcttggggggcttatttctgctcatattcttgcaaaagactacagcagccagtttaagcatgggctgtatcaagatcaattactacgtcttgctgaaagtttaggcaatcgttttctaccggcatttgagacacctactggattgccgtattcatggattaatcttaagtatggggggatggaaaatgaaacaactgagacaagcccatcagggtgtggctcccttatacttgaaatgggtgtgttgtcacgtttgactggcgattcgagatatgaagctgcagctcttcgtgctctccgcaagttatggaccaggagaagttcactgaatctagtatgcaccacacttgatggttttactggcaagtggattcagtattcatccggaattggtgctggtgttgattcattttatgagtatctgattaaagcgtatgttcttttcggaagtgatgagtactgggatatgtttcattcatcttatcttgcggtgcagaagtacttccgacatggtccatggtatcatgaggctgatatgaggactggagaagcaacgcactggcagctaactagccttcaggctttctggccaggtcttcagacacttcttggagacgtaactgctgcaaatctatcacaccgtgagttttacaatatatggcaaagatttggtgtgctacctgaaagatatcttttggactatggaatgttgcatcctacagagaagtactatcccttgcgtcctgagtttgctgagtcaacattttatctttatcaagctactaaagatccttggtacctagaagtgggtgaaaccattgtgaggtcacttaattactatactaaagtggatggaggttttgctagcatcagagatgtttcaacaatgaaacttgaagatcaccagcacagcttctttctttcagaaacgtgcaaatatctttttcttctgtatgatgattcattcttgaggaatcaaaattacatatttacaacagagggtcatccccttccaataagaagcacgtggcatgagaaatttcctgcagcatatgttcccagcaattggacatctgttaaggatgagatccaaccaattcgcgcgagcgcattatcgtctcaagtttgtcccgagacgattttcggaagaagtgttggtaccccatgggagagtgcgtgccatgttccagatgcgcacgctagccacagatgcaggactgacgatgactgtggaatagaagcaataacatgcaagaagaggacctgcagtatggctggctactgcggcttatttttttataatggaaacaagagttccggctttagcatgataatgcgtacagccaatacaagtcgattattacaattaagaactgctgcatga

SEQ ID NO: 7467 - protein, 604 aa, Zea mays
MRSPGRRLPAPARLVAAALLLAALTGGAVGADGYGRARRVYMKNKVLEMFYHAYDNYMTYAFPHDELKPLTKSFTDSLSELGNLNLEHLPQDYSGSALTLVESLSSLVVLGNLTEFERGVLWLSENLTFDVDARINLFECNIRLLGGLISAHILAKDYSSQFKHGLYQDQLLRLAESLGNRFLPAFETPTGLPYSWINLKYGGMENETTETSPSGCGSLILEMGVLSRLTGDSRYEAAALRALRKLWTRRSSLNLVCTTLDGFTGKWIQYSSGIGAGVDSFYEYLIKAYVLFGSDEYWDMFHSSYLAVQKYFRHGPWYHEADMRTGEATHWQLTSLQAFWPGLQTLLGDVTAANLSHREFYNIWQRFGVLPERYLLDYGMLHPTEKYYPLRPEFAESTFYLYQATKDPWYLEVGETIVRSLNYYTKVDGGFASIRDVSTMKLEDHQHSFFLSETCKYLFLLYDDSFLRNQNYIFTTEGHPLPIRSTWHEKFPAAYVPSNWTSVKDEIQPIRASALSSQVCPETIFGRSVGTPWESACHVPDAHASHRCRTDDDCGIEAITCKKRTCSMAGYCGLFFYNGNKSSGFSMIMRTANTSRLLQLRTAA

SEQ ID NO: 7468 - DNA, 25 bp, Artificial sequence
  primer
atgaagaactctgtcggtatttcaa

SEQ ID NO: 7469 - DNA, 23 bp, Artificial sequence
  primer
ctacaacgaccaacctgtggtca

SEQ ID NO: 7470 - protein, 919 aa, Artificial sequence
  consensus sequence
  Variant (2)..(4): Xaa in position 2 to 4 is any amino acid
  Variant (6)..(8): Xaa in position 6 to 8 is any amino acid
  Variant (10)..(11): Xaa in position 10 to 11 is any amino acid
  Variant (13)..(15): Xaa in position 13 to 15 is any amino acid
  Variant (17)..(19): Xaa in position 17 to 19 is any amino acid
  Variant (21)..(23): Xaa in position 21 to 23 is any amino acid
  Variant (25)..(34): Xaa in position 25 to 34 is any amino acid
  Variant (35)..(49): Xaa in position 35 to 49 is any or no amino acid
  Variant (51)..(56): Xaa in position 51 to 56 is any amino acid
  Variant (58)..(58): Xaa in position 58 is any amino acid
  Variant (62)..(64): Xaa in position 62 to 64 is any amino acid
  Variant (66)..(92): Xaa in position 66 to 92 is any amino acid
  Variant (93)..(119): Xaa in position 93 to 119 is any or no amino acid
  Variant (123)..(123): Xaa in position 123 is any amino acid
  Variant (126)..(126): Xaa in position 126 is any amino acid
  Variant (134)..(135): Xaa in position 134 to 135 is any amino acid
  Variant (137)..(140): Xaa in position 137 to 140 is any amino acid
  Variant (141)..(165): Xaa in position 141 to 165 is any or no amino acid
  Variant (167)..(168): Xaa in position 167 to 168 is any amino acid
  Variant (170)..(171): Xaa in position 170 to 171 is any amino acid
  Variant (173)..(175): Xaa in position 173 to 175 is any amino acid
  Variant (177)..(178): Xaa in position 177 to 178 is any amino acid
  Variant (180)..(186): Xaa in position 180 to 186 is any amino acid
  Variant (187)..(187): Xaa in position 187 is any or no amino acid
  Variant (189)..(207): Xaa in position 189 to 207 is any amino acid
  Variant (208)..(237): Xaa in position 208 to 237 is any or no amino acid
  Variant (239)..(244): Xaa in position 239 to 244 is any amino acid
  Variant (247)..(249): Xaa in position 247 to 249 is any amino acid
  Variant (251)..(253): Xaa in position 251 to 253 is any amino acid
  Variant (256)..(278): Xaa in position 256 to 278 is any amino acid
  Variant (279)..(283): Xaa in position 279 to 283 is any or no amino acid
  Variant (285)..(294): Xaa in position 285 to 294 is any amino acid
  Variant (295)..(433): Xaa in position 295 to 433 is any or no amino acid
  Variant (435)..(437): Xaa in position 435 to 437 is any amino acid
  Variant (440)..(440): Xaa in position 440 is any amino acid
  Variant (443)..(450): Xaa in position 443 to 450 is any amino acid
  Variant (453)..(453): Xaa in position 453 is any amino acid
  Variant (455)..(459): Xaa in position 455 to 459 is any amino acid
  Variant (460)..(469): Xaa in position 460 to 469 is any or no amino acid
  Variant (471)..(508): Xaa in position 471 to 508 is any amino acid
  Variant (509)..(527): Xaa in position 509 to 527 is any or no amino acid
  Variant (529)..(530): Xaa in position 529 to 530 is any amino acid
  Variant (532)..(533): Xaa in position 532 to 533 is any amino acid
  Variant (535)..(537): Xaa in position 535 to 537 is any amino acid
  Variant (539)..(552): Xaa in position 539 to 552 is any amino acid
  Variant (553)..(585): Xaa in position 553 to 585 is any or no amino acid
  Variant (587)..(590): Xaa in position 587 to 590 is any amino acid
  Variant (591)..(592): Xaa in position 591 to 592 is any or no amino acid
  Variant (594)..(595): Xaa in position 594 to 595 is any amino acid
  Variant (598)..(615): Xaa in position 598 to 615 is any amino acid
  Variant (616)..(770): Xaa in position 616 to 770 is any or no amino acid
  Variant (774)..(775): Xaa in position 774 to 775 is any amino acid
  Variant (778)..(784): Xaa in position 778 to 784 is any amino acid
  Variant (786)..(815): Xaa in position 786 to 815 is any amino acid
  Variant (816)..(844): Xaa in position 816 to 844 is any or no amino acid
  Variant (847)..(848): Xaa in position 847 to 848 is any amino acid
  Variant (849)..(875): Xaa in position 849 to 875 is any or no amino acid
  Variant (877)..(877): Xaa in position 877 is any amino acid
  Variant (880)..(880): Xaa in position 880 is any amino acid
  Variant (881)..(882): Xaa in position 881 to 882 is any or no amino acid
  Variant (885)..(885): Xaa in position 885 is any amino acid
  Variant (888)..(889): Xaa in position 888 to 889 is any amino acid
  Variant (891)..(891): Xaa in position 891 is any amino acid
  Variant (893)..(900): Xaa in position 893 to 900 is any amino acid
  Variant (901)..(914): Xaa in position 901 to 914 is any or no amino acid
  Variant (917)..(917): Xaa in position 917 is any amino acid
VXXXFXXXWXXYXXXAXXXDXXXPXXXXXXXXXXXXXXXXXXXXXXXXXGXXXXXXDXLDTXXXMXXXXXXXXXXXXXXXXXXXXXXXXXXXXXXXXXXXXXXXXXXXXXXXXXXXXXXFETXIRXLGGLLSAXXLXXXXXXXXXXXXXXXXXXXXXXXXXXXXXLXXAXXLXXXLXXAXXXXXXXXPXXXXXXXXXXXXXXXXXXXXXXXXXXXXXXXXXXXXXXXXXXXXXXXXXAXXXXXXLEXXXLXXXTGXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXDSXYEXXXXXXXXYLXKXXXXXXXXXXXXXXXYXXXXXXXXXXXXXXXXXXXXXXXXXXXXXXXXXXXXXXXXXXXXXXXXXXXXXXXXXLXXFXXGXXXLXXXXXXXXXXXXXXXXXXXXXXXXXXXXXXXXXXXXXXXXXXXXXXXYXXXXXXGXXPEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRPEXXESXXXXXXXTXXXXXXXXXXXXXXXXXXXXXXXXXXXXXXXXXXXXXXXXXXXXXXXXXXXXXXXXXXXDVXXXXXXXXXXXXXXXXXXXXXXXXXXXXXMXSFXXXETXKYXXLXFXXXXXXXXXXXXXXXXXXXXXXTEXHP

SEQ ID NO: 7471 - protein, 17 aa, Artificial sequence
  protein pattern
  Variant (4)..(4): Xaa in position 4 is Cys, Asn or Thr
  Variant (7)..(7): Xaa in position 7 is any amino acid
  Variant (8)..(8): Xaa in position 8 is Leu, Met or Val
  Variant (12)..(16): Xaa in position 12 to 16 is any or no amino acid
FETXIRXXGGLXXXXXL

SEQ ID NO: 7472 - protein, 19 aa, Artificial sequence
  protein pattern
  Variant (2)..(2): Xaa in position 2 is Ala, Glu or Gln
  Variant (3)..(3): Xaa in position 3 is Ser or Thr
  Variant (5)..(6): Xaa in position 5 to 6 is any amino acid
  Variant (7)..(7): Xaa in position 7 is Ala, Gly or Ser
  Variant (9)..(9): Xaa in position 9 is Ala or Thr
  Variant (10)..(10): Xaa in position 10 is Phe, Ile, Leu or Val
  Variant (12)..(14): Xaa in position 12 to 14 is any amino acid
  Variant (15)..(18): Xaa in position 15 to 18 is any or no amino acid
MXXFXXXEXXKXXXXXXXL

SEQ ID NO: 7473 - protein, 19 aa, Artificial sequence
  protein pattern
  Variant (2)..(2): Xaa in position 2 is any or no amino acid
  Variant (6)..(6): Xaa in position 6 is any amino acid
  Variant (7)..(7): Xaa in position 7 is Ile or Val
  Variant (10)..(13): Xaa in position 10 to 13 is any amino acid
  Variant (14)..(14): Xaa in position 14 is Phe, Trp or Tyr
  Variant (15)..(16): Xaa in position 15 to 16 is any amino acid
  Variant (17)..(17): Xaa in position 17 is Ser or Thr
  Variant (18)..(18): Xaa in position 18 is any amino acid
  Variant (19)..(19): Xaa in position 19 is Asp or Asn
LXRPEXXESXXXXXXXXXX

SEQ ID NO: 7474 - protein, 13 aa, Artificial sequence
  protein pattern
  Variant (2)..(2): Xaa in position 2 is Ala, Gly, Ser or Thr
  Variant (3)..(4): Xaa in position 3 to 4 is any amino acid
  Variant (7)..(7): Xaa in position 7 is any amino acid
  Variant (12)..(12): Xaa in position 12 is Ile, Leu or Pro
GXXXDSXYEYLXK

SEQ ID NO: 7475 - DNA, 786 bp, Saccharomyces cerevisiae
  CDS (1)..(786)
atggctagaggaccaaagaagcatctaaaaagattagcagctccacaccactggttattggacaagttgtccggttgttacgccccaagaccatctgctggtccacacaaattgcgtgaatccttgccattgattgtctttctaagaaacagattaaagtatgctttgaacggccgtgaagtcaaggctatcttgatgcaacgtcacgttaaagtggacggtaaggttagaaccgacactacctacccagctggtttcatggatgtcatcactctagatgccaccaatgaaaacttcagattggtctacgatgtcaagggtagattcgctgtccaccgtatcaccgatgaagaagcttcttacaagttgggtaaggtcaagaaggttcaattaggtaagaagggtgttccatacgttgttacccacgatggtagaactatcagatacccagacccaaacatcaaggtcaatgacactgttaagatcgacttggcctctggtaagattactgatttcatcaagttcgatgccggtaagttggtttacgttactggtggtcgtaacttgggtcgtatcggtactatcgttcacaaggaaagacacgatggtggtttcgatttagttcacatcaaggactccttggacaacactttcgtcactagattgaacaatgtcttcgtcatcggtgaacaaggtaagccttacatttctttgccaaagggtaagggtatcaagttgtctattgctgaagaacgtgacagaagaagagctcaacaaggtttataa

SEQ ID NO: 7476 - protein, 261 aa, Saccharomyces cerevisiae
MARGPKKHLKRLAAPHHWLLDKLSGCYAPRPSAGPHKLRESLPLIVFLRNRLKYALNGREVKAILMQRHVKVDGKVRTDTTYPAGFMDVITLDATNENFRLVYDVKGRFAVHRITDEEASYKLGKVKKVQLGKKGVPYVVTHDGRTIRYPDPNIKVNDTVKIDLASGKITDFIKFDAGKLVYVTGGRNLGRIGTIVHKERHDGGFDLVHIKDSLDNTFVTRLNNVFVIGEQGKPYISLPKGKGIKLSIAEERDRRRAQQGL

SEQ ID NO: 7477 - DNA, 735 bp, Arabidopsis thaliana
  CDS (1)..(735)
atgcttgacaaacttggtggtgccttcgctcccaaaccatcttctggacctcacaagtcgagggagtgtcttcctcttgtcctgatcatcaggaacaggttgaagtatgctttgacttaccgtgaagttatctctatcttgatgcaaaggcatatccaagttgatggcaaagtcaggactgacaagacttaccctgctggtttcatggatgttgtatccatccccaagaccaatgagaacttccgtcttctctacgacaccaagggacgtttccgtctccactccatcaaggatgaggaagcaaagttcaagctttgcaaggttagatctatccagtttggtcagaagggaattccatacctgaacacttatgatggtcgcaccatccgttaccctgacccgctcatcaagccaaatgacaccatcaagctggaccttgaggagaacaagattgttgagttcatcaagtttgacgtgggtaacgttgtgatggtgactggaggcagaaacagagggcgtgtgggtgtgattaagaaccgtgaaaagcataagggaagctttgagacaatccacattcaagactcaacagggcatgagtttgccacaaggttggggaatgtgtacacaatcggcaaaggaacaaagccatgggtgtctcttccaaagggcaaaggtattaagctgaccatcattgaggaagccaggaagagacttgcttcccagcaagctgcttga

SEQ ID NO: 7478 - protein, 244 aa, Arabidopsis thaliana
MLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVYTIGKGTKPWVSLPKGKGIKLTIIEEARKRLASQQAA

SEQ ID NO: 7479 - DNA, 798 bp, Oryza sativa (japonica cultivar-group)
  CDS (1)..(798)
atggcgaggggattgaagaagcatctcaagaggctcaatgcgcccaagcactggatgctcgacaagctcggcggagcttttgcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatggatgtgatttccattccaaagactggtgagaactacaggcttctctatgacaccaagggtcgcttccgccttcagtccgtcaaggatgaggatgccaagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggagggaggaacactggtcgtgttggagtaattaagaacagggagaagcacaagggcagttttgagaccatccatgtggaggacgcattgggccatgccttcgccacccgtctgggcaatgtgttcaccatcggcaagggcaacaagccatgggtgtctctccctaagggcaagggtatcaagctcagcatcatcgaggaacagaggaagcgagatgctgctgctcaggctgctgcaaatgcttaa

SEQ ID NO: 7480 - protein, 265 aa, Oryza sativa (japonica cultivar-group)
MARGLKKHLKRLNAPKHWMLDKLGGAFAPKPSSGPHKSRECLPLILIIRNRLKYALTYREVISILMQRHVLVDGKVRTDKTYPAGFMDVISIPKTGENYRLLYDTKGRFRLQSVKDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHAFATRLGNVFTIGKGNKPWVSLPKGKGIKLSIIEEQRKRDAAAQAAANA

SEQ ID NO: 7481 - DNA, 792 bp, Oryza sativa (japonica cultivar-group)
  CDS (1)..(792)
atggcgaggggtttgaagaagcatctgaagaggctcaatgcccccagccattggatgcttgacaagcttggtggagcatttgcacccaagccttcttctggtccccacaaagctcgggagtgcttgcctttgatccttatcctcaggaacaggttgaagtatgctctgacctaccgtgaggttatttccatcttgatgcagcggcatgttatggttgatggaaaggtcaggactgacaagacttatccggctggattcatggacgttgtgtcaattgcaaagactggggagaatttccgccttctgtatgacaccaagggtcgcttccgtctccacagcatcaaggatgaggacgctaagttcaagctctgcaaggtccggtctgtacagtttggacagaagggtattcctttcctgaacaccaacgacgggcgcacgatccgctacccagacccactcatcaaggccaacgacaccatcaagattgacttggagaccaacaagatcgtggacttcatcaagtttgatgttggaaacatcgtgatggtgaccggtgggaggaacacggggcgcgtcggggtgatcaagagcagggagaagcacaagggcagctttgagaccatccatgtcgaggatgccctcggccaccagttcgcgactcgcatgggcaacgtcttcaccatcggcaaggagaggaagccgtgggtatctctccccaagggcaagggcatcaagctcagcatcattgaggaggcgaggaagcgcaatgccgaggctgccgctgaggcttga

SEQ ID NO: 7482 - protein, 263 aa, Oryza sativa (japonica cultivar-group)
MARGLKKHLKRLNAPSHWMLDKLGGAFAPKPSSGPHKARECLPLILILRNRLKYALTYREVISILMQRHVMVDGKVRTDKTYPAGFMDVVSIAKTGENFRLLYDTKGRFRLHSIKDEDAKFKLCKVRSVQFGQKGIPFLNTNDGRTIRYPDPLIKANDTIKIDLETNKIVDFIKFDVGNIVMVTGGRNTGRVGVIKSREKHKGSFETIHVEDALGHQFATRMGNVFTIGKERKPWVSLPKGKGIKLSIIEEARKRNAEAAAEA

SEQ ID NO: 7483 - DNA, 714 bp, Thermoplasma acidophilum DSM 1728
  CDS (1)..(714): transl_table=11
atgataatgataaacaaaactaagagactgatggtatcaagacaggtcaagatcccgagaaaaacctacttctggggtccaacaccaaatccaggcatgcatccaaaagatcaatcagtcacgctgctttcgatcataagggactaccttaaactttccgacaaggagcgggaggcggccaggatattggcaaacggattggtcaaggtggacggcaagactgtgagagagaagaagttcgcagtaggattcatggatgttatagagataaatggtgaatcctatagagtagtatacaatgaccagggtgcgctggtgctgatgaaggagaccaaggaaagggcctcgatgaaactgctcaaggtaagatcaaaagtaatagcccctggaaacagaattcagcttggaacccacgacggcagaaccttcataacggatgacaagagcaaaaaggtcggagacgtctgggccgtttccgtaccggatatgaagataagcgagataataaagatgcagcccggcaacaaggcgtacatcactgcaggttcccacgttaaccagacagggacgataagcaaaatagaggccaaggaaggttcatcggctaacctggttcatttccaggagggtttctccaccataaaggatcacgtgttcatgattggaagctcgaagttctcctttgtacttagtcctgaggaggtgatcccatga

SEQ ID NO: 7484 - protein, 237 aa, Thermoplasma acidophilum DSM 1728
MIMINKTKRLMVSRQVKIPRKTYFWGPTPNPGMHPKDQSVTLLSIIRDYLKLSDKEREAARILANGLVKVDGKTVREKKFAVGFMDVIEINGESYRVVYNDQGALVLMKETKERASMKLLKVRSKVIAPGNRIQLGTHDGRTFITDDKSKKVGDVWAVSVPDMKISEIIKMQPGNKAYITAGSHVNQTGTISKIEAKEGSSANLVHFQEGFSTIKDHVFMIGSSKFSFVLSPEEVIP

SEQ ID NO: 7485 - DNA, 807 bp, Encephalitozoon cuniculi GB-M1
  CDS (1)..(807)
atgccaaccggacatcgcgaccacctaaagcgaaagacggcgccgaagtcgtggatgctggacaagcagggagggacgtttgcactaatgcctgccagtgggccccacaagaagacggagtgcattcctcttgggtatctgatttcaaggtttcttaggtatgcaagcaatttcaaggagcttagtattatcctggccgagaagaacatcaaggtgaatgggcgggtcagaacaaactcccactttcctgtcgggctgtttgatgttgtatcgattgagaagacgggagagcacttccgggttctatacaacgtgcacaagaagttccacctccacaggataagctctgaggaggcaagctaccgtttgaccaaggttacaaagaagtatgagaaccaggggattccgtacattgtttccagctgcgggctaagcatccggttctgtgacccggccattgacctgggatacacgatcaagatctcgaacgagacatcgaaggtcattgagtacattgttcctgggcccgacaaggttatatttgtgtcgaggggaaaggctagaggacgcgttggggtcataaacacaatcagtacgcaaggaaaggagactgtgtatggaatgacggattttgcaggaaacaccttttcctgtacaagcaaaagctgcatattgattggagagtcctccgaaaacatctggatcacccttccaaaggaaaggggaatacgtcaatccgagcttgagaagatcaacgcccagttaggggagatgattgatacagaagtagctgaggtcagcgaataa

SEQ ID NO: 7486 - protein, 268 aa, Encephalitozoon cuniculi GB-M1
MPTGHRDHLKRKTAPKSWMLDKQGGTFALMPASGPHKKTECIPLGYLISRFLRYASNFKELSIILAEKNIKVNGRVRTNSHFPVGLFDVVSIEKTGEHFRVLYNVHKKFHLHRISSEEASYRLTKVTKKYENQGIPYIVSSCGLSIRFCDPAIDLGYTIKISNETSKVIEYIVPGPDKVIFVSRGKARGRVGVINTISTQGKETVYGMTDFAGNTFSCTSKSCILIGESSENIWITLPKERGIRQSELEKINAQLGEMIDTEVAEVSE

SEQ ID NO: 7487 - DNA, 789 bp, Magnaporthe grisea 70-15
  CDS (1)..(789)
atgggcagaggacctaagaagcaccagaagcgccttgccgcgccttcgcactggctgttggacaagctcagcggcacctacgcccccaagccctcgcccggtcctcacaagcagcgcgagtgcctgccgctcatcgtcttcatccgcaaccgcctcaagtacgccctcaatggccgcgagaccaaggccatcctgatgcagcgcctggtcaaggttgacggcaaggtccgcaccgactcgacttaccccgccggcttcatggacgttgtttcgatcgagaagactggcgagaacttccgtctcgtctacgacaccaagggacgcttcaccgtccaccgcatccaggccgaggaggccgagtacaagctcggcaaggtcaagcgtgttcagctcggccgcggcgggatcccattcttggttacgcatgatgccagaaccatccgctaccccgaccctctgatcaaggtcaacgacactgtcaagatcaaccttgacactggcaagatcaccgacttcatcaagttcgacactggcgccctcgccatggttaccgctggtaacaacatgggtcgtgttggtgttatcacccaccgtgagcgccacgatggtggcttcaacattgtgcacttgaaggatgccattgacaacactttcaccactcgtgagagcaacgttttcgtcatcggcactgagaagccctggatctccctgcccaagggcaagggtgtcaagctcaccatcgctgaggagcgtgaccgcaggcgtgcccagaccatcgccggccactaa

SEQ ID NO: 7488 - protein, 262 aa, Magnaporthe grisea 70-15
MGRGPKKHQKRLAAPSHWLLDKLSGTYAPKPSPGPHKQRECLPLIVFIRNRLKYALNGRETKAILMQRLVKVDGKVRTDSTYPAGFMDVVSIEKTGENFRLVYDTKGRFTVHRIQAEEAEYKLGKVKRVQLGRGGIPFLVTHDARTIRYPDPLIKVNDTVKINLDTGKITDFIKFDTGALAMVTAGNNMGRVGVITHRERHDGGFNIVHLKDAIDNTFTTRESNVFVIGTEKPWISLPKGKGVKLTIAEERDRRRAQTIAGH

SEQ ID NO: 7489 - DNA, 732 bp, Gibberella zeae PH-1
  CDS (1)..(732)
ctgcttgacaagctgtccggcacctacgctcccaagccttctgccggtcctcacaagctccgcgactgcatgcccctgatcgtcttcatccgaaaccgactcaagtatgctctcaactaccgcgaggtcaaggccatcctgatgcagcgacttgtcaaggtcgacggcaaggtccgcaccgattccaccttcccctccggcttcatggacgtcatcaccattgagaagactggcgagaacttccgtctcgtctacgataccaagggtcgattcaccgtccaccgaatccagaacgaggaggccgagtacaagctgggcaaggtcaagcgtgtccagcttggtcgcggtggaatcccattcttggtcacgcacgatgcacgaaccatccgataccccgaccctctgatcaaggtcaacgacactgtcaagattgacctcgccactggcaagatcaccgacttcatcaagttcgacaccggcgccgtcgtcatggtcactggtggtcgcaacatgggtcgtgttggtgtcatcacccaccgtgagcgtcacgatggtggtttcaacatcgtccacgtcaaggatgccattgacaacagcttcgccacccgtgagagcaacgttttcatcattggccaggacaagccctggatctctctgcccaagggcaagggtgtcaagctcaccatcgctgaggagcgtgaccgccgacgcgcttacgccatctctcactaa

SEQ ID NO: 7490 - protein, 243 aa, Gibberella zeae PH-1
MLDKLSGTYAPKPSAGPHKLRDCMPLIVFIRNRLKYALNYREVKAILMQRLVKVDGKVRTDSTFPSGFMDVITIEKTGENFRLVYDTKGRFTVHRIQNEEAEYKLGKVKRVQLGRGGIPFLVTHDARTIRYPDPLIKVNDTVKIDLATGKITDFIKFDTGAVVMVTGGRNMGRVGVITHRERHDGGFNIVHVKDAIDNSFATRESNVFIIGQDKPWISLPKGKGVKLTIAEERDRRRAYAISH

SEQ ID NO: 7491 - DNA, 786 bp, Candida glabrata CBS 138
  CDS (1)..(786)
atggctagaggaccaaagaagcatctaaagagattagcagctccacaccactggttgttggacaagttgtccggctgttacgccccaagaccatccgctggtccacacaagttgcgtgaatccctaccattgatcgttttcttgagaaacagattaaagtacgctttgaacggtcgtgaagttaaggctatcatgatgcaacgtcatgttaaggttgacggtaaggtcagaactgacgctacctacccagctggtttcatggatgttatcaccttggaagctaccaacgaaaacttcagattggtctacgacgtcaagggtagattcgctgtccaccgtatcactgacgaagaagcttcctacaagttgggtaaggtcaagaaggtccaattgggtaagaagggtgttccatacgttgtcactgacgatggtagaactatcagatacccagacccaaacatcaaggtcaatgacaccgtcaaggtcgacttggcttccggtaagatcactgactacatcaagttcgacattggtaagttggtctacatcaccggtggtcgtaacttgggtcgtatcggtaccatcgttcacaaggaaagacacgatggtggtttcgacttggttcacgtcaaggactccttggacaacactttcgtcaccagattgaacaacgttttcgttatcggtgaacaaggtaagccatacatctccttgccaaagggtaagggtatcaagttgaccattgctgaagaacgtgacagaagaagagctcaacaaggtttataa

SEQ ID NO: 7492 - protein, 261 aa, Candida glabrata CBS 138
MARGPKKHLKRLAAPHHWLLDKLSGCYAPRPSAGPHKLRESLPLIVFLRNRLKYALNGREVKAIMMQRHVKVDGKVRTDATYPAGFMDVITLEATNENFRLVYDVKGRFAVHRITDEEASYKLGKVKKVQLGKKGVPYVVTDDGRTIRYPDPNIKVNDTVKVDLASGKITDYIKFDIGKLVYITGGRNLGRIGTIVHKERHDGGFDLVHVKDSLDNTFVTRLNNVFVIGEQGKPYISLPKGKGIKLTIAEERDRRRAQQGL

SEQ ID NO: 7493 - DNA, 786 bp, Kluyveromyces lactis NRRL Y-1140
  CDS (1)..(786)
atggctagaggaccaaagaagcatctaaagagattagcagctccacatcattggatgttggacaagttgtccggttgttacgcaccaagaccatctgctggtccacacaagttgcgtgaatccttgccattgatcgttttcttgagaaacagattaaagtatgctttgaacggtcgtgaagtcaaggccatcttgatgcaacgtcatgtcaaggttgacggtaaggtcagaaccgacactactttcccagctggtttcatggatgttatcaccttggaagctaccaacgaaaacttcagattggtctacgatgttaagggtagattcgctgtccaccgtatcactgatgaagaagcttcctacaagttggctaaggtcaagaaggttcaactaggtaagaagggtattccatacgtcgttacccacgacggtagaaccatcagatacccagacccaaacatcaaggttaacgacaccgttaaggttgatttggctactggtactatcaccgatttcatcaaattcgacactggtaagttggtttatgttaccggtggtcgtaacttgggtagagttggtaccatcgtccacagagaaagacacgaaggtggtttcgatttggttcacatcaaggattctttggaaaacactttcgtcaccagattgaacaacgttttcgtcatcggtgaaccaggtagaccatggatctccttgccaaagggtaagggtatcaagttgaccatctctgaagaacgtgaccgtagaagagctcaacatggtttgtaa

SEQ ID NO: 7494 - protein, 261 aa, Kluyveromyces lactis NRRL Y-1140
MARGPKKHLKRLAAPHHWMLDKLSGCYAPRPSAGPHKLRESLPLIVFLRNRLKYALNGREVKAILMQRHVKVDGKVRTDTTFPAGFMDVITLEATNENFRLVYDVKGRFAVHRITDEEASYKLAKVKKVQLGKKGIPYVVTHDGRTIRYPDPNIKVNDTVKVDLATGTITDFIKFDTGKLVYVTGGRNLGRVGTIVHRERHEGGFDLVHIKDSLENTFVTRLNNVFVIGEPGRPWISLPKGKGIKLTISEERDRRRAQHGL

SEQ ID NO: 7495 - DNA, 792 bp, Debaryomyces hansenii CBS767
  CDS (1)..(792)
atgggtagaggtccaaagaagcacttgaagagattagcagcaccatcccactggatgttggacaaattgtccggtacttacgcaccaagaccatctgctggtcctcacaaattgagagaatctttaccattggttatcttcttaagaaacagacttaagtatgccttaaacggtagagaagtcaaggccatcttgatgcaagaacacgtcaaggttgatggtaaagttagaaccgatgctactttcccagctggtttcatggatgtcatcactttagaagctaccaacgaacacttcagattaatctatgatgtcaagggtagattcactgtccacagaatcactgctgaagaagcttcttacaagttagctaaggtcaagaaggtccaattaggtaagagaggtattccatacgttgtcacccacgacggtagaactatcagatacccagatccattgatcagagccaacgattccgttaaggttgacttagctaccggtaagatcactgactttatcagctttgacactggtagattagtcatggttactggtggtcgtaacatgggtagagttggtgttatcacccacagagaaaagcacgagggtggtttcgatttagtccacatcaaggattctttggaaaacactttcgttaccagattaactaacgtcttcatcgtcggtactgaagctggtaagccacacatttctttaccaaagggtaagggtattaagttatccatctctgaagaacgtgacagaagaagaaaccaacaacttatcaactaa

SEQ ID NO: 7496 - protein, 263 aa, Debaryomyces hansenii CBS767
MGRGPKKHLKRLAAPSHWMLDKLSGTYAPRPSAGPHKLRESLPLVIFLRNRLKYALNGREVKAILMQEHVKVDGKVRTDATFPAGFMDVITLEATNEHFRLIYDVKGRFTVHRITAEEASYKLAKVKKVQLGKRGIPYVVTHDGRTIRYPDPLIRANDSVKVDLATGKITDFISFDTGRLVMVTGGRNMGRVGVITHREKHEGGFDLVHIKDSLENTFVTRLTNVFIVGTEAGKPHISLPKGKGIKLSISEERDRRRNQQLIN

SEQ ID NO: 7497 - DNA, 792 bp, Debaryomyces hansenii CBS767
  CDS (1)..(792)
atggcaagaggcccaaagaagcacttaaagagattagcagccccatcccactggatgttggacaagttgtccggtacctatgcaccaagaccatccgctggtcctcacaagttgagagaatctttaccattagttattttcttaagaaacagacttaagtacgctttaaacggtagagaagtcaaggctatcttgatgcaagagcatgtcaaggttgatggaaaggtcagaactgacgctactttcccagctggtttcatggatgtcatcactttagaagccaccaacgaacacttcagattgatctatgacgtcaagggtagattcactgtccacagaatcaccgctgaagaagcttcttacaagttagccaaggtcaagaaggtccaattaggtaagagaggtattccatacgttgttacacacgatggtagaactatcagatacccagatcctttgatcagagctaacgattctgttaaggttgacttagctaccggtaaagtcactgactttatcagcttcgacactggtagattagttatggttactggtggtcgtaacatgggtagagttggtgttatcacccacagagaaaagcacgaaggtggtttcgatttagtccacattaaggattccttagaaaacactttcgttaccagattaaccaacgtcttcatcgtcggtactgaagctggtaagccacatatttctttgccaaagggtaagggtattaagttatccatctctgaagaacgtgacagaagaagaaaccaacaacttatcaactaa

SEQ ID NO: 7498 - protein, 263 aa, Debaryomyces hansenii CBS767
MARGPKKHLKRLAAPSHWMLDKLSGTYAPRPSAGPHKLRESLPLVIFLRNRLKYALNGREVKAILMQEHVKVDGKVRTDATFPAGFMDVITLEATNEHFRLIYDVKGRFTVHRITAEEASYKLAKVKKVQLGKRGIPYVVTHDGRTIRYPDPLIRANDSVKVDLATGKVTDFISFDTGRLVMVTGGRNMGRVGVITHREKHEGGFDLVHIKDSLENTFVTRLTNVFIVGTEAGKPHISLPKGKGIKLSISEERDRRRNQQLIN

SEQ ID NO: 7499 - DNA, 789 bp, Candida albicans SC5314
  CDS (1)..(789): transl_table=12
atgggtagaggtccaaagaaacacttgaaaagattagcagctccatctcactggatgttggacaaattgtccggtacttatgctccaagaccatctgctggtccacacaaattgagagaatcattaccattggttgtctttttaagaaacagattgaagtatgctttgaacggtagagaagtcaaagccatcatgatgcaacaacacgttcaagttgacggtaaagtcagaactgataccacctacccagctggtttcatggatgtcatcaccttggaagctaccaacgaacatttcagattagtctacgatgttaaaggtaaattcgctgttcacagaatttctgctgaagaagctgcctacaaattgggtaaagtcaagaaagtccaattaggtaagaaaggtgttccatacgttgttacccacgacggtagaactatcagatacccagatccattgatcagagctaacgataccgttaagatcgatttggctaccggtaagattgatgatttcatcaaattcgacactggtagattagttatggttactggtggtagaaatttgggtagagttggtgttattgtccacagagaaaaacacgaaggaggtttcgatttggtccacatcaaagatgctttggaaaacactttcgttaccagattgtctaacgtttttgttattggtactgaagccggtaaaccatgggtctcattaccaaagggtaaaggtatcaaattgtctatttctgaagaaagagacagaagaagagctcaacaaggtttgtaa

SEQ ID NO: 7500 - protein, 262 aa, Candida albicans SC5314
MGRGPKKHLKRLAAPSHWMLDKLSGTYAPRPSAGPHKLRESLPLVVFLRNRLKYALNGREVKAIMMQQHVQVDGKVRTDTTYPAGFMDVITLEATNEHFRLVYDVKGKFAVHRISAEEAAYKLGKVKKVQLGKKGVPYVVTHDGRTIRYPDPLIRANDTVKIDLATGKIDDFIKFDTGRLVMVTGGRNLGRVGVIVHREKHEGGFDLVHIKDALENTFVTRLSNVFVIGTEAGKPWVSLPKGKGIKLSISEERDRRRAQQGL

SEQ ID NO: 7501 - DNA, 735 bp, Candida albicans SC5314
  CDS (1)..(735): transl_table=12
atgttggacaaattgtccggtacctatgctccaagaccatctgctggtccacacaaattgagagaatcattaccattggttgtctttttaagaaacagattgaagtatgctttgaacggtagagaagtcaaagccatcatgatgcaacaacacgttcaagttgacggtaaagtcagaactgacactacttacccagctggtttcatggatgtcatcactttggaagctaccaacgaacatttcagattagtctacgatgttaaaggtaaattcgccgttcacagaatttctgctgaagaagctgcctacaaattgggtaaagtcaagaaagtccaattaggtaagaaaggtgttccatacgttgttacccacgacggtagaactatcagatacccagatccattgatcagagctaacgataccgttaaaatcgatttggctaccggtaagatcgatgatttcatcaaattcgacactggtagattagttatggttactggtggtagaaatttgggtagagttggtgttattgtccacagagaaaaacacgaaggaggtttcgatttggttcacatcaaagatgctttggaaaacacttttgttaccagattgtctaacgttttcgttattggtaccgaagccggtaaaccatgggtttcattaccaaagggtaaaggtattaaattgtctatttctgaagaaagagacagaagaagagctcaacaagggttataa

SEQ ID NO: 7502 - protein, 244 aa, Candida albicans SC5314
MLDKLSGTYAPRPSAGPHKLRESLPLVVFLRNRLKYALNGREVKAIMMQQHVQVDGKVRTDTTYPAGFMDVITLEATNEHFRLVYDVKGKFAVHRISAEEAAYKLGKVKKVQLGKKGVPYVVTHDGRTIRYPDPLIRANDTVKIDLATGKIDDFIKFDTGRLVMVTGGRNLGRVGVIVHREKHEGGFDLVHIKDALENTFVTRLSNVFVIGTEAGKPWVSLPKGKGIKLSISEERDRRRAQQGL

SEQ ID NO: 7503 - DNA, 792 bp, Cryptococcus neoformans var. neoformans B-3501A
  CDS (1)..(792)
atgggtcgaggtcctaagaagcacctgaagcgattggcagctccctcctcatggatgttggacaagttgggcggcacctacgccccccgtccttctcctggtccccacaagctcagggagtctcttccccttactgtcttcctccgaaaccgtctgaagtacgctctcactggccgtgaggtcactgctattgttaagcagcgactcatcaaggtcgacggcaaagtcaggactgatgagaccttccccgctggtttcatggatgttatctccatcgagcgatctggcgagcacttccgtctcctctacgacgtcaagggtcgattcaccattcaccgaatcacccccgaggaggccactttcaagctccttaaggttcgaaagcatcagcttggtgccaagggcgttccccacatcgttacccacgatggccgaaccatccgataccccgaccctgccatcaaggtcaacgacactgtcaagttcgacttcgttcagaacaaaatcgttgaccacatcaagtttgagcccggaaacgtcgtcatggttactggcggtcgtaacatgggtcgatctggtgtgatcgttcacaaggagaggcacttgggtggtttcgacattgttcacgtcaaggacgtgttggacaggacctttgctactaggctttccaacattttcgtcattggtgagggttccaaggcccaggtgtctttgcccaagggcaagggtgtcaagctctctatcgccgaggagcgtgaccaaaggaggcgccagcgggctcaggaggcttaa

SEQ ID NO: 7504 - protein, 263 aa, Cryptococcus neoformans var. neoformans B-3501A
MGRGPKKHLKRLAAPSSWMLDKLGGTYAPRPSPGPHKLRESLPLTVFLRNRLKYALTGREVTAIVKQRLIKVDGKVRTDETFPAGFMDVISIERSGEHFRLLYDVKGRFTIHRITPEEATFKLLKVRKHQLGAKGVPHIVTHDGRTIRYPDPAIKVNDTVKFDFVQNKIVDHIKFEPGNVVMVTGGRNMGRSGVIVHKERHLGGFDIVHVKDVLDRTFATRLSNIFVIGEGSKAQVSLPKGKGVKLSIAEERDQRRRQRAQEA

SEQ ID NO: 7505 - DNA, 708 bp, Methanosarcina barkeri str. Fusaro
  CDS (1)..(708): transl_table=11
gtgacacaccagaaaagattatcaatcccaagaagctggaaggctgggaaaaaaggttataagtgggtctccaccactcgcccggggcctcacagtcaggcacgcagtcttccgctcggaatcataattcgcgatattctcaagcttgtagataatagcagggaaggtaagaggattctctcggaaggcaaagttcttgtagatggaatccccaggaaagacctcaggttcccggtagggctttttgatgtaattacacttcctctcgtaaatgaaacatacagaatgttccaggacgaaaagggacgtctggcccttcacaagctgaacgcaacaaacgttaacaaattgtgcaggattaacaacaagactaccctcaaaggaggaaaggtgcagcttaacctgaatgacgggaccaacattctgggttctaacgagtacagcacaaaggactctctgattctctcattgcctgacaagcagatagtaaagcacctgcagttcaaggtcggcaatctggcaatggtagtaggcggccagcattctggagaaatcggaaagattactgaaatcagggaagttaagagttccaggcacaatacagtcgcgatttcaggggaaaccgatttcgaaacaattgaagattacgttattgtaattggtgaggacaagcctgaaatccgactcggtggtgaggtaattgagtaa

SEQ ID NO: 7506 - protein, 235 aa, Methanosarcina barkeri str. Fusaro
MTHQKRLSIPRSWKAGKKGYKWVSTTRPGPHSQARSLPLGIIIRDILKLVDNSREGKRILSEGKVLVDGIPRKDLRFPVGLFDVITLPLVNETYRMFQDEKGRLALHKLNATNVNKLCRINNKTTLKGGKVQLNLNDGTNILGSNEYSTKDSLILSLPDKQIVKHLQFKVGNLAMVVGGQHSGEIGKITEIREVKSSRHNTVAISGETDFETIEDYVIVIGEDKPEIRLGGEVIE

SEQ ID NO: 7507 - DNA, 1105 bp, Panax ginseng
  CDS (88)..(882)
gcacgagggtttaatcaaaagctgaagcaaggagtttgcggcacagagagagagggagggagacgcagcttatcgaacaaagcaaccatggctagaggtttgaagaagcatttgaagaggctcaatgcccctaagcattggatgctcgataaacttggtggtgcatttgctcccaagccttcatctggaccccataaatccagggaatgcctgcctttgattcttattttgcgaaacaggctgaagtatgctctaacttaccgtgaagtccaatccatcttgatgcaacgacatgttcttgttgatgggaaggttaggacggataagacctatccagctggtttcatggatgttgtatcaattcccaagactaatgagaatttccgtctcctctatgacacaaagggtagattccgcctacactcggtcagggatgaggaggcaaagtttaagttgtgcaaagttaggtcagttcagttcggtcagaaaggcattccgtacatcaatacctatgatgggcgtactatccgttatccagacccgctcattaaggccaatgacaccatcaaacttgacttggaggcaaacaagatagctgatttcattaagttcgatgttggaaatgttgtcatggtgactggggggaggaatactgggcgagttggagttatcaagaacagggagaaacataaggggagcttcgagactgttcacattcaggattcccttggtcacgagtttgctactcgtctaggcaatgtttttaccatcggaaaaggtacaaagccatgggtgtctcttcccaagggcaagggtatcaaattaaccatcattgaggaggccaggaagaggaatgttgcccagtctgctacaactgcataaacaaaaaatttatgcatgtgttgctgttaaaagttttatcttctggtcttgcttgcaggttggtgctgtggtctagctaacttaggatttatgcttaaaattatgtgttgttttcatttcagacaattttgaaagatattttgttgttgcaaatttgattaaaactcttctgctggctgattttggcaacaaatagacaacttaatcaagtctacaatctttt

SEQ ID NO: 7508 - protein, 264 aa, Panax ginseng
MARGLKKHLKRLNAPKHWMLDKLGGAFAPKPSSGPHKSRECLPLILILRNRLKYALTYREVQSILMQRHVLVDGKVRTDKTYPAGFMDVVSIPKTNENFRLLYDTKGRFRLHSVRDEEAKFKLCKVRSVQFGQKGIPYINTYDGRTIRYPDPLIKANDTIKLDLEANKIADFIKFDVGNVVMVTGGRNTGRVGVIKNREKHKGSFETVHIQDSLGHEFATRLGNVFTIGKGTKPWVSLPKGKGIKLTIIEEARKRNVAQSATTA

SEQ ID NO: 7509 - DNA, 1053 bp, Bromus inermis
  CDS (96)..(893)
gcggcggcggcgcgcagcacaggagaaggagaaggagcaggcggcggcggtgcgcgaagagaagaagcacggcgacctagcccgagcttgcaaccatggcgaggggtttgaagaagcatctcaagaggctcaatgccccgtctcactggatgctggacaagcttggtggagcttttgcccccaagccatcatctggtcctcacaaggccagggagtgcctgcctctgatcctcatcctgaggaacagactgaaatatgctctcacctaccgtgaagtgcaatctatcctgatgcagcgtcacatcatggttgatggaaaggtccgaactgacaagacctaccctgctggtttcatggatatcatttccattcccaagactggtgagaactacaggcttctgtatgacaccaagggccgcttccgcctgcactctgtcagggatgaggatgccaagtacaagctctgcaaggtcaggtctgtccagtttggccagaagggtatcccatacctcaacaccaatgatggtcgcaccatccgctaccctgacccactcatcaaggccaatgacaccatcaagctcgacctggagaccaacaagattgttgacttcatcaagtttgatgttggcaatgttgtcatggttactggtgggcgtaacactggccgtgttggtgtgatcaagaacagggagaagcataagggaaccttcgagaccatccacgttgaggatgctcagggtcaccagttcgccacccgtctaggcaatgtgttcaccatcggcaagggcaccaagccgtgggtgaccctccccaagggcaaaggtatcaagctgaccatcattgaggagcagaggaagagggatgccgctgcccaggcagctgccaaggcctgattctgaggcgttgattcgttttgctatagccagttatctgaaggatatagaactatgtttctggaaccatcgtttttaaattttgcctgatgtttgttgaattgtgaacccatggttgctgctagatgtaatgtggatgtttaaaaaaaaaaaaaaaaaa

SEQ ID NO: 7510 - protein, 265 aa, Bromus inermis
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKYKLCKVRSVQFGQKGIPYLNTNDGRTIRYPDPLIKANDTIKLDLETNKIVDFIKFDVGNVVMVTGGRNTGRVGVIKNREKHKGTFETIHVEDAQGHQFATRLGNVFTIGKGTKPWVTLPKGKGIKLTIIEEQRKRDAAAQAAAKA

SEQ ID NO: 7511 - DNA, 1037 bp, Zea mays
  CDS (72)..(869)
ggagcggaaggcgaaggagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgcccatcaaggccaacgacaccatcaagatcgatctggagaccaacaaaattgtggacttcatcaagtttgatgttggcaacgttgtcatggtgactggcggaaggaacactggccgtgtgggtgttatcaagaacagggagaagcacaagggcagccttgagaccattcacgtggaggactccctgggccaccagttcgccacccgtatgggcaacgtgttcaccatcggcaagggtaataagccgtgggtgagcctgcccaagggcaagggaatcaagctgagcatcatagaagagcaaaggaagcgggatgccgctgcccaggctgctgccaacgcataaatcctctgaatgtgctgtgttgagagttttttctagttgctctgcaaggatatagaacaatgttctaagactaccatgtttttaagtctgcctgatgcttataattcatgaacgatttttgcagctagctgtaatgtgactatttatcttaaaaaaaaaaaaaaaaaa

SEQ ID NO: 7512 - protein, 265 aa, Zea mays
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPPIKANDTIKIDLETNKIVDFIKFDVGNVVMVTGGRNTGRVGVIKNREKHKGSLETIHVEDSLGHQFATRMGNVFTIGKGNKPWVSLPKGKGIKLSIIEEQRKRDAAAQAAANA

SEQ ID NO: 7513 - DNA, 1054 bp, Glycine max
  CDS (98)..(892)
tggttaggcttgatctcaagccatctttttgtttcttcagtttggtataaccttagccgaggtcacgaggagcactagctagtttcacaatttccaaatggctaggggattgaagaagcatctcaagaggctcaatgctcctaagcattggatgcttgacaaactgggtggtgcatttgcgcccaaaccctcatctggaccacacaaatctagggagtgccttcccctcatactcatcctacgaaaccggctaaagtatgctctgacttaccgtgaagtcatcgctattctgatgcagagacatgttcttgttgatggaaaagtcaggactgacaagacttaccctgctggtttcatggatgttgtttcaatcccaaaaaccaatgagaacttccgcctgctctatgacactaaaggccgattccgtctccattctgtcagggatgatgaggcaaagttcaagctctgcaaggttaggtcagtgcagtttggccagaaaggtatcccatacctgaacacctatgatggtcgcaccatccgttacccagaccctctcatcagggccaacgacaccattaagctggatctggaggaaaacaagattgttgattttatcaaatttgatgttgggaatgtagttatggtaacaggtgggagaaacagggggcgtgttggagtgatcaagaacagggagaagcataagggtagctttgagacaattcacgtgcaggattccactggacatgaatttgctactcgcatgggcaatgtgttcactattggcaagggcacaaagccatggatatcactgcccaagggtaagggtattaagctatcaatcattgaagaagctaggaaaaggattgccgcccagcaagcaactgctgcttaaaccccttttggatgaatagacttgagtgcttggtagttttattcaatgtttttgttttctaatttcttttggctaagagattttaatcgttgaattttgactcttgcactatacaactttattgtggctgttatattcataaaaaaaaaaacaaaaaaaaaa

SEQ ID NO: 7514 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDSTGHEFATRMGNVFTIGKGTKPWISLPKGKGIKLSIIEEARKRIAAQQATAA

SEQ ID NO: 7515 - DNA, 813 bp, Arabidopsis thaliana
  CDS (1)..(786)
atggcaagaggtttgaagaagcatttgaagaggctcaatgctcctaagcattggatgcttgataaacttggtggtgcctttgcccccaagccgtcttctgggccacacaagtctagggagtgtttacccttggtccttatcatcaggaacaggttgaagtatgctctgacatacagagaagtgatttcgatcttgatgcaaaggcatattcaggttgatgggaaagtgaggactgacaagacttaccctgctggtttcatggatgttgtgtctatccccaaaacaaatgagaacttccgtcttttgtatgacaccaagggacgtttccgtctccactccatcaaggatgaggaggctaagttcaagctttgcaaagtgagatcgatccaatttggtcagaagggtattccctacttgaacacatatgatggtcgcaccatccgttatcctgacccgctcatcaagcctaacgacaccatcaagctcgaccttgaggagaacaagattgtggagttcattaagtttgatgtgggcaacgtagttatggtcactggaggaagaaacagagggcgtgttggtgtgattaagaaccgtgagaaacacaagggtagctttgaaaccatccacattcaagactcaacaggacatgagtttgcaacaaggttgggaaatgtgtacacaatcggtaagggaacaaagccatgggtgtcccttccaaagggtaaaggtattaagttgaccatcattgaggaagccaggaagagactttctgctcaacaagcttgatagttaatactatgctctgttttccag

SEQ ID NO: 7516 - protein, 261 aa, Arabidopsis thaliana
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVYTIGKGTKPWVSLPKGKGIKLTIIEEARKRLSAQQA

SEQ ID NO: 7517 - DNA, 789 bp, Arabidopsis thaliana
  CDS (1)..(789)
atggcaagaggattgaagaagcatctaaagaggctcaatgctcctaagcattggatgcttgacaaacttggtggtgccttcgctcccaaaccatcttctggacctcacaagtcgagggagtgtcttcctcttgtcctgatcatcaggaacaggttgaagtatgctttgacttaccgtgaagttatctctatcttgatgcaaaggcatatccaagttgatggcaaagtcaggactgacaagacttaccctgctggtttcatggatgttgtatccatccccaagaccaatgagaacttccgtcttctctacgacaccaagggacgtttccgtctccactccatcaaggatgaggaagcaaagttcaagctttgcaaggttagatctatccagtttggtcagaagggaattccatacctgaacacttatgatggtcgcaccatccgttaccctgacccgctcatcaagccaaatgacaccatcaagctggaccttgaggagaacaagattgttgagttcatcaagtttgacgtgggtaacgttgtgatggtgactggaggcagaaacagagggcgtgtgggtgtgattaagaaccgtgaaaagcataagggaagctttgagacaatccacattcaagactcaacagggcatgagtttgccacaaggttggggaatgtgtacacaatcggcaaaggaacaaagccatgggtgtctcttccaaagggcaaaggtattaagctgaccatcattgaggaagccaggaagagacttgcttcccagcaagctgcttga

SEQ ID NO: 7518 - protein, 262 aa, Arabidopsis thaliana
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVYTIGKGTKPWVSLPKGKGIKLTIIEEARKRLASQQAA

SEQ ID NO: 7519 - DNA, 1005 bp, Arabidopsis thaliana
  CDS (85)..(873)
actttttctctcaagtggttcggagctgtttctaagaaaacaacaggtagttcggatcggagctacgcttgcaaaactcaaaacatggcgaggggtttgaagaagcatctgaagaggcttaatgcgcctaagcattggatgcttgacaaacttggtggtgcatttgccccaaagccgtcttctggaccacataagtcaagggagtgccttcccctcgtccttatcatcaggaacaggttgaagtatgctcttacctaccgtgaagtgatttcaatcttgatgcaaaggcatatccaagttgatgggaaagtcaggacggacaagacctaccctgctggtttcatggatgttgtgtctatccccaagaccaatgagaacttccgtcttctctatgataccaagggacgtttccgtctccactccatcaaggatgaggaagcaaagttcaaactttgcaaggttcgatctatccagtttggacagaaaggcattccttacctgaacacttacgatggtcgcaccatccgttaccctgacccgctcatcaagcctaatgacaccatcaagctcgaccttgaggccaacaagattgtcgagttcatcaagtttgatgttggcaatgttgtgatggttacaggaggtagaaacagagggcgtgttggtgtgattaaaaaccgtgagaagcataagggaagctttgagacaatccacatccaagattcaacaggacatgagtttgcaacaaggttgggtaatgtgtacaccattggcaaaggaacaaagccatgggtgtctcttcccaagggcaaaggtatcaagctgactatcatcgaggaggccaggaagaggcttgctagtcaacaggctgcttaattttgtgattttcagttctttgttatgcttctttagacgtttcatatttcctagactcacttcgtttcttttggtactctgctcagttttgaaacttctcttatattatttatttcaagagttaaaaacatc

SEQ ID NO: 7520 - protein, 262 aa, Arabidopsis thaliana
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIKDEEAKFKLCKVRSIQFGQKGIPYLNTYDGRTIRYPDPLIKPNDTIKLDLEANKIVEFIKFDVGNVVMVTGGRNRGRVGVIKNREKHKGSFETIHIQDSTGHEFATRLGNVYTIGKGTKPWVSLPKGKGIKLTIIEEARKRLASQQAA

SEQ ID NO: 7521 - DNA, 789 bp, Schizosaccharomyces pombe
  CDS (1)..(789)
atggttcgaggtcctaaaaagcatttgaagcgtgttgctgcccctcaccactggcttttggacaagctctccggaacttacgctccaaagccttctccaggtcctcataaggcccgtgagtgccttcctttgattgttttcttgcgtaaccgtcttaaatatgctttgaacggacgtgaggttaaggctatccttatgcaacgtctcattaaggtagatggaaaggttcgtaccgactctactttccctaccggctttatggatgtgatctccgttgaaaagactggtgagcacttccgccttgtctatgacattaagggccgtttcactgtccaccgtattactgctgaagaggctaaatacaagctttgcaaggtcaagcgtgttcaattaggtgctaagggtgttccttttctcgtcacccatgatggacgtactattcgttatcccgatccattgatcaaggtcaacgacaccataaaacttaacttggaaaccaacaagatcgagtcgttcattaaatttgatacttccgctcaagttatggttaccggtggtcgtaacatgggacgtgttggtaccattgtccatcgtgagcaccatcttggttcctttgaaatcattcatgttaaggatgctttggaccgtgagtttgctactcgtctttccaacgtttttgtcattggcgagactggcaagagttggatttctttgcccaagggtaagggtgtcaagctcagcattaccgaagagcgtgaccgcagacgtgctctcaagggacttgcctaa

SEQ ID NO: 7522 - protein, 262 aa, Schizosaccharomyces pombe
MVRGPKKHLKRVAAPHHWLLDKLSGTYAPKPSPGPHKARECLPLIVFLRNRLKYALNGREVKAILMQRLIKVDGKVRTDSTFPTGFMDVISVEKTGEHFRLVYDIKGRFTVHRITAEEAKYKLCKVKRVQLGAKGVPFLVTHDGRTIRYPDPLIKVNDTIKLNLETNKIESFIKFDTSAQVMVTGGRNMGRVGTIVHREHHLGSFEIIHVKDALDREFATRLSNVFVIGETGKSWISLPKGKGVKLSITEERDRRRALKGLA

SEQ ID NO: 7523 - DNA, 762 bp, Aeropyrum pernix
  CDS (1)..(762): transl_table=11
atggctaggatgggagggcagcggaggcttaaagcccttgcagcaccccggttctggcctatactccgtaaggagtacaagtgggctgtcaagccgaggcccggccctcatccagcagagaagagcctccccctgctgttaatagtgaggaacgtcctcggctatgcccagaccgcgagggaggctaggaagcttatctccgagggccacttcagggtcgacggtgttgtaaggaaggattacaagttccccgtcggcttcatggacgttatagaggttgtggacaccggcgaaaagttcaggatgctaccgtaccccgtcaagttcttcaagctgcaccctataccggaggaggagggagatctgaagcccgttaggattgagaacaagacaacagtgaagggagggcatgtgcagcttaacctacacgacggcaggaacattctagttagggttaaggacccgaggaatcccgtggaggatgtgtataggacaatggacactctcctaataacggtccccggccaggagataaagggccacataaaattcggggagggagccatagcgattattgtcgggggccggaacgtcggacgcgtgggcgttgtgaagagcgtgcagaagggctggggtaggaagaggacgttggtcacactcgaggatgccagcggcaacctcttccagacttccctggactacgtcttcgttataggcctcgacaggcccgtaatatcgctaccggagggtgcgtggaagtga

SEQ ID NO: 7524 - protein, 253 aa, Aeropyrum pernix
MARMGGQRRLKALAAPRFWPILRKEYKWAVKPRPGPHPAEKSLPLLLIVRNVLGYAQTAREARKLISEGHFRVDGVVRKDYKFPVGFMDVIEVVDTGEKFRMLPYPVKFFKLHPIPEEEGDLKPVRIENKTTVKGGHVQLNLHDGRNILVRVKDPRNPVEDVYRTMDTLLITVPGQEIKGHIKFGEGAIAIIVGGRNVGRVGVVKSVQKGWGRKRTLVTLEDASGNLFQTSLDYVFVIGLDRPVISLPEGAWK

SEQ ID NO: 7525 - DNA, 735 bp, Methanococcus jannaschii
  CDS (1)..(735): transl_table=11
atggcaaaaaaaggtccaaaaagacatttaaaaagattggcagctccagttagatgggagttaccaagaaagattcacaaattcacagttagaccattaccaggagcacacccaatgagtgagtcattaccattactgttaatcgttagagacattttaaagtatgccgataacgcaagagaagcaaagaaaatcattaaaatgggtaaagttttagttgatggaagagttaggaaggaagaaaagcttccagttggattaatggatgttgtctcattaccagatgcaaatgaaaattacagagttttatttgatagaaagggaagaattaaattaaaaccaacagaaaatccagatgtaaaattatgtaaaattaaaaacaagactgttattaaaggaggacacatacagctcaatttacacgatggaagaaatatcgttataaaagtttcagaccctacaaaggcagaagaagatgtctataaaacaggagacacattattaatctcaatccctgaacaagaaattaaagctcatataccatttgaagttggtaaattagcatacattacaggaggaaaacacgtcggtgatttcgctaaaatcgttgagattgagagaagaggaatatatcctgatatcgttacattagaaaacatggatggagagaagttcaaaacagttaaagactatgtcttcgttgttggagacgaagagccaataattaaattataa

SEQ ID NO: 7526 - protein, 244 aa, Methanococcus jannaschii
MAKKGPKRHLKRLAAPVRWELPRKIHKFTVRPLPGAHPMSESLPLLLIVRDILKYADNAREAKKIIKMGKVLVDGRVRKEEKLPVGLMDVVSLPDANENYRVLFDRKGRIKLKPTENPDVKLCKIKNKTVIKGGHIQLNLHDGRNIVIKVSDPTKAEEDVYKTGDTLLISIPEQEIKAHIPFEVGKLAYITGGKHVGDFAKIVEIERRGIYPDIVTLENMDGEKFKTVKDYVFVVGDEEPIIKL

SEQ ID NO: 7527 - DNA, 735 bp, Methanococcus maripaludis
  CDS (1)..(735): transl_table=11
atggcaattaaaggacctagaaaacatcttaaaagattggctgctccagcaaattggcaacttcctagaaaagtgaaaacatttacggtaagaccatcacctggaccacattcaatggataaatccttgccattattgttagttgtaagagatgtattaaaatatgctgacaatgcaagagaagctaaaaaaattatccaaacaggaaaaattttaatcgatggattaaaaagaaaagagtacaaacaccctgctggattaatggatgttttatcaatccctgaaatggatgaaacttaccttgtattatttgacgaaagcggaagaatcagcttgaaaaaaactgataaaaccgatgtaaaattgtgcaaaatcgtaaacaaaactgtcgttaaaggcggaaacattcaattaaaccttcacgatggtagaaaccagattgtaaaagtttcagatgctgcaaaagctgaagaagatgtttacaaaaccggagacagcgttttaatttcaattccagaacagtcaattgctggacatgttgcatttggcgaaggaaaattagcatacatcactggcggtaaacacgttggagaatttgctaaaatcgttgaagttgaaaacagagcattgtactcagatattgtaactttagaaaacaaagatggcgagaaatttaaaaccgttaagccttacgtattcatcgtaggtcaagacgagccagtaatttcgatgtaa

SEQ ID NO: 7528 - protein, 244 aa, Methanococcus maripaludis
MAIKGPRKHLKRLAAPANWQLPRKVKTFTVRPSPGPHSMDKSLPLLLVVRDVLKYADNAREAKKIIQTGKILIDGLKRKEYKHPAGLMDVLSIPEMDETYLVLFDESGRISLKKTDKTDVKLCKIVNKTVVKGGNIQLNLHDGRNQIVKVSDAAKAEEDVYKTGDSVLISIPEQSIAGHVAFGEGKLAYITGGKHVGEFAKIVEVENRALYSDIVTLENKDGEKFKTVKPYVFIVGQDEPVISM

SEQ ID NO: 7529 - DNA, 729 bp, Methanobacterium thermoautotrophicum
  CDS (1)..(729): transl_table=11
atggcaataatggcatcaagaaaacatcttaaacgattcaaatcaccggttcactggccaattcatcccaaggaatacaaatggacagttaaaccatctccaggtccccacgctattgagaactcactgcctctcatgatcattgtgagggacatcctgaaggttgcagacaatgcaagggaagccaggaagataataaacagtggagaggtcctggtggatggaagaccaaggaagaactacaagttcccggtcggattcatggacgttgtcagcatacccaggacaggagacgtctacagggtgctccctgatgaaaggggaaggctggttctccaccccatagatgaggaaaacgcaggcttcaaactctgcaagatagtgaacaagacaaccattaagggaggcaggacccagctcaacctccatgacggccgtaactacctctcagatgatgaattcagggtgggagacgttgtaaagctctcaatacccgaacaggaaatccttgagaggataccatttgagaaggacagcctcggccttgtgacaggcggacggcacaccggtgaaataggcaagatcaagaagataaacataacaaggtcttcaatgccaaacacagccgtcatcgagaccggtgcaggcaagacattcctgacactcaaggactacgttttcgtcataggaaaggacgagtcagtgatctcacttccaggagggaaatag

SEQ ID NO: 7530 - protein, 242 aa, Methanobacterium thermoautotrophicum
MAIMASRKHLKRFKSPVHWPIHPKEYKWTVKPSPGPHAIENSLPLMIIVRDILKVADNAREARKIINSGEVLVDGRPRKNYKFPVGFMDVVSIPRTGDVYRVLPDERGRLVLHPIDEENAGFKLCKIVNKTTIKGGRTQLNLHDGRNYLSDDEFRVGDVVKLSIPEQEILERIPFEKDSLGLVTGGRHTGEIGKIKKINITRSSMPNTAVIETGAGKTFLTLKDYVFVIGKDESVISLPGGK

SEQ ID NO: 7531 - DNA, 735 bp, Methanococcus vannielii
  CDS (1)..(735): transl_table=11
atggcaattaaaggacctagaaaacatcttaaaagattggctgctccagcaaattggcaacttcctagaaaagaaagaacatttactgtgagaccatcacctggaccacattcaatggacaaatccttgccgttattattaattgtaagagatactttaaaatgtgctgataatgcaagagaagctaaaaaaattatccaaatgggcaaaattttaattgacggcgtcaagagaaaagaatacaaacaccctgtaggattaatggatgttttatcaattcctgaacttaacgaaaattaccttgtattatttgacgaaaatggaagaatcagtttgaaaaagactgaaaaaaccggcgtaaaattgtgcaaaatcgtgaataaaactgttattaaaggtggccatatccagttgaaccttcacgatggtagaaaccaaattgtaaaagttgcaaatgctttaaaagcagaagaagacatttacaaaactggagatagcgttttagtttcattacctgaacaagcagttgtaggacatgttgaatttaacgaagggaagttagcatacatcactggcggtaaacacgtaggagaatttgctaaagtcgttgaagttgaaaaaagaacattgtactctgacatcgtaaccttagaaaataaggacggagaaaaattcaaaacaattaaaccttatgtgttcattgtaggtcaggatgaacccgtaatctcaatgtaa

SEQ ID NO: 7532 - protein, 244 aa, Methanococcus vannielii
MAIKGPRKHLKRLAAPANWQLPRKERTFTVRPSPGPHSMDKSLPLLLIVRDTLKCADNAREAKKIIQMGKILIDGVKRKEYKHPVGLMDVLSIPELNENYLVLFDENGRISLKKTEKTGVKLCKIVNKTVIKGGHIQLNLHDGRNQIVKVANALKAEEDIYKTGDSVLVSLPEQAVVGHVEFNEGKLAYITGGKHVGEFAKVVEVEKRTLYSDIVTLENKDGEKFKTIKPYVFIVGQDEPVISM

SEQ ID NO: 7533 - DNA, 705 bp, Picrophilus torridus
  CDS (1)..(705): transl_table=11
atgataacgaagacaaaaataatgatggctcccaggaagcttaaaatagcaaggaagagcaggttctgggcagttaacagcctaccaggctcacataaaaaggacagctcaatcccattattaatagcgttaagggactatcttaagcttggtgacaaggagcgtgaaataacaaggatactgacaaattcacttgtaatggtggatggtaaggtcgttaaggagagaaggcgtggtattggctttatggatacattaacagtatcaggcaacgattatttagtatcatatgacaggaagggcaagctcgttatactgccaaagcctggtgaaacgaagggcctaaagctgctccgcgtgaagggcaagacctatgtaaagggcggaaggatacaaatatcgttccacgatggctcgacaatggtaaccgatagaaaggatattaaaaacggcgattccgttcttgtaaaaataccaaaaaaggagatagttgacgttcttaaatttgcaccaggaaaccgtgttttcataactggcggctcacacgttggtgagatagcaacgataaaatcaatagagataaaaagctcttccggtgaaaacatggttcatatgaacgagggcttttcaacagtaagctcctatgtgtttgtaatgggcagtcccaagtacacattctcaatgccggaggcgatagcagaatga

SEQ ID NO: 7534 - protein, 234 aa, Picrophilus torridus
MITKTKIMMAPRKLKIARKSRFWAVNSLPGSHKKDSSIPLLIALRDYLKLGDKEREITRILTNSLVMVDGKVVKERRRGIGFMDTLTVSGNDYLVSYDRKGKLVILPKPGETKGLKLLRVKGKTYVKGGRIQISFHDGSTMVTDRKDIKNGDSVLVKIPKKEIVDVLKFAPGNRVFITGGSHVGEIATIKSIEIKSSSGENMVHMNEGFSTVSSYVFVMGSPKYTFSMPEAIAE

SEQ ID NO: 7535 - DNA, 732 bp, Pyrococcus abyssi
  CDS (1)..(732): transl_table=11
atggcgagaaaaggtccaaagaggcatcttaagaggcttgctgctcccacatcatggtacattgagaggaaggcttacaagtgggccgtaaggccaaggccaggcccacacaacatgaggacttcgattccactactgtatatagttagggactacctaggctacgctaaaacggctagagaagctaggaagatactcaacgagggcaagttcctcgtggatggaagggtcaggaaggattacaagttcccggtcggaatcatggatgtagtttcgatcccagagaccggagagcactacagggtgctaccaaacagaattggaaagctaattcttcatccgataagcgaggaagaggccaacatcaagccactcagaataaggaacaagaggatggtcaagggagcaaagatacagctcaatttccacgatggaacgaaccatttgataccgcttagcgagaaggataactacttcacatcatacacggtcctcatgaaggtccccgagagggagatacttgaggtcctaccgttcgagaagggagcctatgtcttcgttacccaaggtaagaacgtggctagaaagggaaggatagtcgaaattaagaagttcccaatgggctggccagacgtagttactatagaagatgaagagggagagctcttcgacactttgaaagagtacgccttcgtagttggcagggacaagccgaggatatcattaccgtga

SEQ ID NO: 7536 - protein, 243 aa, Pyrococcus abyssi
MARKGPKRHLKRLAAPTSWYIERKAYKWAVRPRPGPHNMRTSIPLLYIVRDYLGYAKTAREARKILNEGKFLVDGRVRKDYKFPVGIMDVVSIPETGEHYRVLPNRIGKLILHPISEEEANIKPLRIRNKRMVKGAKIQLNFHDGTNHLIPLSEKDNYFTSYTVLMKVPEREILEVLPFEKGAYVFVTQGKNVARKGRIVEIKKFPMGWPDVVTIEDEEGELFDTLKEYAFVVGRDKPRISLP

SEQ ID NO: 7537 - DNA, 717 bp, Pyrobaculum aerophilum
  CDS (1)..(717): transl_table=11
atggtacacctaagaagaacgctagcgcctgcttggtggccaatccctagaaagaaaggcggcgtatgggttgttaggccgtcacctgggccgcacagcctagcttattcactgcccttggccctgattattagggatgtattaaaatacgcaaagacaatgcacgaggctaggtacataatatcaagaggttatgtaaaagtagatggagttgtaagaagggattacaaattcccggtggggcttatggacgttatagaaatcgtgccgacaggggaggtgtacagagtcgtgccagacgcagataagtactataatctattgcctatctccacagaggaagccgccctcaaattgcttagagttgaaggtaagactatggtcaagggcgggaggatacaactacacttccacgacggtaggaatttaatcacaacgcttgaggcggggaaacagataaaaacatttgactcagtgctttacgatttacgtaataaggctataaaggctcatatcccgctgaaattaggagtaaacgcggtggttatccacggcagtaacgttggcttctccggcacgctctatgaaattgtctggacgttaaagcgcaagcagtcagtagtcgcccttaagaaaggcgatgaggttaggaggacaatattaaattacgtaatggccgtgggtagcgaagggccagtgataaaaatctccccttaa

SEQ ID NO: 7538 - protein, 238 aa, Pyrobaculum aerophilum
MVHLRRTLAPAWWPIPRKKGGVWVVRPSPGPHSLAYSLPLALIIRDVLKYAKTMHEARYIISRGYVKVDGVVRRDYKFPVGLMDVIEIVPTGEVYRVVPDADKYYNLLPISTEEAALKLLRVEGKTMVKGGRIQLHFHDGRNLITTLEAGKQIKTFDSVLYDLRNKAIKAHIPLKLGVNAVVIHGSNVGFSGTLYEIVWTLKRKQSVVALKKGDEVRRTILNYVMAVGSEGPVIKISP

SEQ ID NO: 7539 - DNA, 732 bp, Pyrococcus furiosus
  CDS (1)..(732): transl_table=11
atggcgagaaagggtcctaagaggcaccttaagagacttgctgctccaacttcatggtatattgagaggaaggcctacaaatgggctgttaggcccagacctggacctcacaacatgagaacatcaatacctctcctatacatagtaagagactacttggggtacgcaaagactgctagagaagcaagaaaaatactaaacgagggcaagttcctagttgatggaagggttagaaaggactacaagttccctgtcggtataatggatgttgtctcaattccagaaacaggagagcactacagagtcttgccaaatagaataggcaagctaatccttcacccaatatctgaagatgaggcattcataaagcctctgagaattagaaacaagagaatgataaagggagctagggttcagcttaacttccacgatgggactaaccacatagtctcaatagccgaaaaggacaactacttcacctcatacacagtgttgatgaaggttcccgagagggaaatccttgaagtgctaccattcgagaagggtgcttacgtcttcgtaacccaaggtaagaacgttgctaggaaaggtagaatagtggaaataaagagattcccaatgggttggccagatgtagtcacaattgaagatgaagaaggagagctcttcgacacgttaaaagagtatgcatttgtagttggcacagataagccaaagatttctcttccgtga

SEQ ID NO: 7540 - protein, 243 aa, Pyrococcus furiosus
MARKGPKRHLKRLAAPTSWYIERKAYKWAVRPRPGPHNMRTSIPLLYIVRDYLGYAKTAREARKILNEGKFLVDGRVRKDYKFPVGIMDVVSIPETGEHYRVLPNRIGKLILHPISEDEAFIKPLRIRNKRMIKGARVQLNFHDGTNHIVSIAEKDNYFTSYTVLMKVPEREILEVLPFEKGAYVFVTQGKNVARKGRIVEIKRFPMGWPDVVTIEDEEGELFDTLKEYAFVVGTDKPKISLP

SEQ ID NO: 7541 - DNA, 732 bp, Pyrococcus horikoshii
  CDS (1)..(732): transl_table=11
atggcgagaaaaggtcccaagaggcatcttaagaggcttgccgctccttcatcttggtatattgagaggaaagcttacaagtgggccgtaaggccgagaccaggaccacacaacatgagaacgtcaattcccctgctatatatagttagggattaccttggctatgctaagaccgctagagaagctagaaagatccttaatgagggtaagttccttgtggatggtaaggtaagaaaggattacaagttcccagttggaattatggatgtagtttcaattcccgaaacgggagagcattatagagttctaccaaacaggattggaaagctagtccttcacccaataagtgaagaagaagcgaacatcaaacctctaaggattaggaataagagaatggtgaaaggggccaaggtgcagttaaactttcatgatggaactaatcacttgataccacttactgagaaagataactacttcacatcctatactgttctcatgaaagttccagagagggagataatggaggttctaccatttgaaaagggtgcttacgttttcgtaacccagggtaagaacgttgccaggaagggaaggatagtcgagatcaagaagttcccaatgggatggccagatgttgtgaccattgaagacgaagagggtgagctgttcgatacgctaaaagagtacgctttcgtcgttggcaaggataagccaaagatatcgcttccatga

SEQ ID NO: 7542 - protein, 243 aa, Pyrococcus horikoshii
MARKGPKRHLKRLAAPSSWYIERKAYKWAVRPRPGPHNMRTSIPLLYIVRDYLGYAKTAREARKILNEGKFLVDGKVRKDYKFPVGIMDVVSIPETGEHYRVLPNRIGKLVLHPISEEEANIKPLRIRNKRMVKGAKVQLNFHDGTNHLIPLTEKDNYFTSYTVLMKVPEREIMEVLPFEKGAYVFVTQGKNVARKGRIVEIKKFPMGWPDVVTIEDEEGELFDTLKEYAFVVGKDKPKISLP

SEQ ID NO: 7543 - DNA, 732 bp, Pyrococcus kodakaraensis
  CDS (1)..(732): transl_table=11
atggcgaggaagggtccgaagaggcaccttaagaggcttgccgctccgacttcctggtacattcacaggaaggcttacaagtgggccgtcaggcccagtccgggtccgcacagcatgaagacttccataccgctgatctacatagtcagggactacctcggctacgccaagaccgccagggaagccaggaagatcctcaacgagggcaagatcctcgttgatggtagggtcaggaaggactacaagttccccgttggaatcatggacgtcgtctcaatcccagagacgggtgagcactacagggttctcccgaacaggataggcaagcttatactccacccgataagcgaggaagaggccaagctcaagcccttcaggatcaacaacaagaggatggtcaagggcgctaaggttcagctaaacctccacgacggaagcaaccacctcgtcagccttgccgagaaggacgcctacaagacctcctacacggtcataatgcaggttccggagaggcagatagtcaaggtgctcccgttcgaggtcggtgcctacgtcttcgttacccagggtaagaacgttgccagaaagggtaagatcgtcgaggtcaggcagttcccgatgggctggcccgacgtcgttacaatcgaggacgagaacggcgagctcttcgacaccctgaaggagtacgccttcgtcattggtaaggacaagcctgagatttcccttccgtga

SEQ ID NO: 7544 - protein, 243 aa, Pyrococcus kodakaraensis
MARKGPKRHLKRLAAPTSWYIHRKAYKWAVRPSPGPHSMKTSIPLIYIVRDYLGYAKTAREARKILNEGKILVDGRVRKDYKFPVGIMDVVSIPETGEHYRVLPNRIGKLILHPISEEEAKLKPFRINNKRMVKGAKVQLNLHDGSNHLVSLAEKDAYKTSYTVIMQVPERQIVKVLPFEVGAYVFVTQGKNVARKGKIVEVRQFPMGWPDVVTIEDENGELFDTLKEYAFVIGKDKPEISLP

SEQ ID NO: 7545 - DNA, 1307 bp, Thermoplasma acidophilum
  CDS (40)..(747): transl_table=11
ttgcagcagtagcggaggagaaaacagaggtggatgataatgataaacaaaactaagagactgatggtatcaagacaggtcaagatcccgagaaaaacctacttctggggtccaacaccaaatccaggcatgcatccaaaagatcaatcagtcacgctgctttcgatcataagggactaccttaaactttccgacaaggagcgggaggcggccaggatattggcaaacggattggtcaaggtggacggcaagactgtgagagagaagaagttcgcagtaggattcatggatgttatagagataaatggtgaatcctatagagtagtatacaatgaccagggtgcgctggtgctgatgaaggagaccaaggaaagggcctcgatgaaactgctcaaggtaagatcaaaagtaatagcccctggaaacagaattcagcttggaacccacgacggcagaaccttcataacggatgacaagagcaaaaaggtcggagacgtctgggccgtttccgtaccggatatgaagataagcgagataataaagatgcagcccggcaacaaggcgtacatcactgcaggttcccacgttaaccagacagggacgataagcaaaatagaggccaaggaaggttcatcggctaacctggttcatttccaggagggtttctccaccataaaggatcacgtgttcatgattggaagctcgaagttctcctttgtacttagtcctgaggaggtgatcccatgaatccaatggaagaggtcattatagacaaggttgtcgtgaacataggagtgggacaggctggagacagattaacaaaggctgcaaaggttctcgagatgctcacaggccataaggcaactaacacgctcgccaagaagagcatccgcgacttcaacataaggaagcgtctgcccataggagtgaaggtcactctcaggaagaaagatgctatggaatttctgcagaaggctttctacgtaaaggactacaagataacagactattcattcgacaagcacggaaacgcgtactttggtatatccgactacacggatttcaagggtatgaagtatgatcctgacatagggatattcggaatggatgttgctatcgttttcaggaggcgaggcggatacagaatagagaggagaaggataggatcaaagaccataccgaacagtataagggtaagaaaggaagaggcgcaggatttcctgcagaagaattttaaagttacagttgtgaggtgatatattgtcgcaggtgaaactcaaaccgaagaagaaatacgggcaccttaa

SEQ ID NO: 7546 - protein, 235 aa, Thermoplasma acidophilum
MINKTKRLMVSRQVKIPRKTYFWGPTPNPGMHPKDQSVTLLSIIRDYLKLSDKEREAARILANGLVKVDGKTVREKKFAVGFMDVIEINGESYRVVYNDQGALVLMKETKERASMKLLKVRSKVIAPGNRIQLGTHDGRTFITDDKSKKVGDVWAVSVPDMKISEIIKMQPGNKAYITAGSHVNQTGTISKIEAKEGSSANLVHFQEGFSTIKDHVFMIGSSKFSFVLSPEEVIP

SEQ ID NO: 7547 - DNA, 708 bp, Thermoplasma volcanium
  CDS (1)..(708): transl_table=11
atgatcaataaaacgaagagattgatggttccacgcactgtaaagataccgaggaaaacttacttctggggtccaacgcctcttccaggtaggcataaggcagatcattcggtcactctcttaaccataataagggattacttgagattatcggataaagagagagaggccactagaatactcgccaatggtcttgtaaaggtggacggtaaagtagtgaaggaacgtaagtttggagtaggattcatggatgttatagagataagcggtgaatcataccgtgtggtttataacaaccaaggcgctcttgtgctggtaagcgaaagcaaagatcgcgcaaacatgaaaccgcttcaggtgaagaataaagtaatagcacctggaaacaagatacagctgggattccacgatggacgtgtaatggtaacggaggacagatcaatttccgttggagatgtcgtaattgcatccttacctgatatgaagataaccgagataataaagatgcagccaggtaacaaggctttcataacgggcggttctcacgttggagaaactggaactataagcaaaatagaaataaaggaatcgtcttccgctaacttagtccactttgatgagggcttcacaacagtaaaggatcacgttttcgtgataggcagtcctaggtttacgtttacaatgccttcaggtgaggtgtatccatga

SEQ ID NO: 7548 - protein, 235 aa, Thermoplasma volcanium
MINKTKRLMVPRTVKIPRKTYFWGPTPLPGRHKADHSVTLLTIIRDYLRLSDKEREATRILANGLVKVDGKVVKERKFGVGFMDVIEISGESYRVVYNNQGALVLVSESKDRANMKPLQVKNKVIAPGNKIQLGFHDGRVMVTEDRSISVGDVVIASLPDMKITEIIKMQPGNKAFITGGSHVGETGTISKIEIKESSSANLVHFDEGFTTVKDHVFVIGSPRFTFTMPSGEVYP

SEQ ID NO: 7549 - DNA, 1090 bp, Gossypium hirsutum
  CDS (56)..(844)
gccggctctcgcaacaaaaccagtctttgagttaacacagccgcatttcaccaggatggctagagggttgaagaaacatttgaagaggctcaatgcccctaggcattggatgcttgacaagcttggtggtgcttttgcacccaagccatcatctggtcctcacaagtctagggaatgcttgccattgatcctcattctgcgaaacagattgaaatatgctctgacctatagagaagtcattgctattctcatgcagaggcatgttatggtagatgggaaggttagaactgataagacctaccctgctggtttcatggatgttgtttcgattcctaaaacaaacgaggacttccgtcttctttacgacactaaaggacgtttctgtctccatgctatcactggcgatgaaaccaagtttaagctttgcaaggttcgatccgtccaatttggccagaagggcattccatacctgaacacatacgacgggcgtactattcgctacccagaccccttgatcaaggcaaatgacaccattaagctggaccttgagagcaacaagattgtcgatttcatcaagtttgacgttgggaatgttgtcatggtcaccggaggaaggaacagaggtcgtgttggagtaattaaaaacagggagaagcataagggtagctttgagaccattcatgttcaagatgctgctgggcacgaatttgcaactcgtcttggtaatgtcttcacaattggaaaaggaacgaagccatgggtgtcgcttcccaagcgcaaaggtatcaagttatccatcatcgaggaagctcggaagaggcttgcagcccaaaatgcagcttgaactttaacatgagatatccagatacgtcttgttttcacctaaagagtaaaatttggagaactaatttcttcttgcagtttaaagtgtttgtgttgtgggtgatgtcatagacttttattttatagaatattttgatgttttcttgattatcaaccctgcttttttcaaactaatctttgtatgctttttgcttaaactaatattttatttatgtttaaaaaaaaaaaaaaaaaaaaaaaaaaaaaa

SEQ ID NO: 7550 - protein, 262 aa, Gossypium hirsutum
MARGLKKHLKRLNAPRHWMLDKLGGAFAPKPSSGPHKSRECLPLILILRNRLKYALTYREVIAILMQRHVMVDGKVRTDKTYPAGFMDVVSIPKTNEDFRLLYDTKGRFCLHAITGDETKFKLCKVRSVQFGQKGIPYLNTYDGRTIRYPDPLIKANDTIKLDLESNKIVDFIKFDVGNVVMVTGGRNRGRVGVIKNREKHKGSFETIHVQDAAGHEFATRLGNVFTIGKGTKPWVSLPKRKGIKLSIIEEARKRLAAQNAA

SEQ ID NO: 7551 - DNA, 1013 bp, Zea mays
  CDS (74)..(871)
gcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccttatctgaacacgtatgacggccgcaccatccgctaccctgaccccctcatcaaggccaacgacaccatcaagatcgatctggagaccaacaagattgtggacttcatcaagtttgatgttggcaacgtcgtcatggtgactggcggaaggaacactggccgcgtgggtgttatcaagaacagggagaagcacaagggcagctttgagaccattcacgtggaggactccctgggccaccagttcgccacccgtatgggcaacgtgttcaccatcggcaagggtaataagccgtgggtgagcctgcccaagggcaagggaatcaagctgagcatcatagaagagcaaaggaagcgggatgccgctgcccaggctgctgccaacgcataaatcctctgaatgtgctgtgttgagagttttttctagttgctctgcaaggatatagaacaatgttctaagactaccatgtttttaagtctgcctgatgcttataattcatgaacgatttttgcaaaaaaaaaaaaaaaaaaaa

SEQ ID NO: 7552 - protein, 265 aa, Zea mays
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDSLGHQFATRMGNVFTIGKGNKPWVSLPKGKGIKLSIIEEQRKRDAAAQAAANA

SEQ ID NO: 7553 - DNA, 1086 bp, Prunus armeniaca
  CDS (47)..(832)
ctcctcctcattcccacctagggtttcggcatctgcctctgctaaaatggctagaggattgaagaagcatctgaagaggctcaatgccccaaagcattggatgctcgacaagcttgggggtgcttttgctcccaagccatcatctgggcctcacaaatctagggagtgccttccactgatcctcatcctgaggaacaggttgaagtatgctctcacataccgtgaggtcgtttccattctcatgcagcgtcatattttggttgatggcaagattcatttttgtataagacttagtgatgttgtttccatcccaaaaacaaatgagaacttccgtctgctttatgacaccaagggtcggttccggctccactcaattagagatgaggagtctaagttcaagctatgcaaggttcggtcagtgcagtttgggcagaagggcatcccctatattaacacttatgacgggagaaccattcgctaccctgaccccctcatcaaggccaatgacactatcaagctggacttggagacaaacaagatcaccgacttcattaagtttgatgttggaaatgttgtcatggtgactggtggaagaaacagaggtcgtgttggagtcattaagaacagggagaagcataagggaagctttgagaccatccacgttcaggatgccactggtcacgagtttgctactcggcttggtaatgtgttcaccattggcaagggtacaaaaccttgggtgtctcttcccaaggggaaaggtatcaagctaaccatccttgaagaggcaaagaagcgacaagcagcagcccaaacagctgctactgcttaaacaatatggtggcaactatagattgttgttcctacagttttagatggtacttagttgaatcagttaagcagtttgactcttttcagcttatgctcagaggattctattttctttcattttgcggccctgctttgtggattatttaagttgcaatactggcttgaatgttattatgttttgtgctggaatgagatgtatcggaccaattttaattgacttgctgcttatgttattcggaaaaaaaaaaaaaaaaa

SEQ ID NO: 7554 - protein, 261 aa, Prunus armeniaca
MARGLKKHLKRLNAPKHWMLDKLGGAFAPKPSSGPHKSRECLPLILILRNRLKYALTYREVVSILMQRHILVDGKIHFCIRLSDVVSIPKTNENFRLLYDTKGRFRLHSIRDEESKFKLCKVRSVQFGQKGIPYINTYDGRTIRYPDPLIKANDTIKLDLETNKITDFIKFDVGNVVMVTGGRNRGRVGVIKNREKHKGSFETIHVQDATGHEFATRLGNVFTIGKGTKPWVSLPKGKGIKLTILEEAKKRQAAAQTAATA

SEQ ID NO: 7555 - DNA, 966 bp, Solanum tuberosum
  CDS (50)..(844)
ctcttcatcgaagctgcaaaaaatacagagaaattcttagaccaacaaaatggctagaggtttgaagaagcatctgaagaggctcaatgccccaaagcattggatgcttgataaacttggtggagcatttgcccccaagccatcctctgggccacacaaatcaagggagtgcttgccattggtcattatcatgcgaaacaggttgaagtatgctctcacataccgagaggtgatctcaattctgatgcaacgacaagttatggttgatgggaaagttaggacagataagacatatcctgctggtttcatggatgtcgtttcaattccgaagactaatgagaacttccgtctcctttatgacactaagggccgattccgtcttcactcgctcagggacgaggaatccaagtttaagctttgcaaggtccgctctgtgcagtttggtcagaaggggatcccatacctgaacacttacgatggaagaacaatccgctatcctgatcctctcatcaaggccaacgataccataaagctggacttggaatccaataagattgttgatttcatcaagtttgacgttgggaatgttgtgatggtgactggaggtagaaacaggggacgagttggtgttattaagaacagggagaagcataagggtagctttgagaccctccacattcaggattcacagggtcatgaatttgctacacgtttgggaaatgtgttcactcttggtaagggtactaagccgtgggtttcactccccaaaggtaaaggaattaagttgaccatcatcgaggatgcaaggaagaggctggctgctcaatctgccacccctgcttaaactgtccaggttgcttcatccactgttcaagtcaatttcacgctttacagcatgataaagttaagttttgtagtttgaactctttatgttatgctttgtttagtaatacatattttattctg

SEQ ID NO: 7556 - protein, 264 aa, Solanum tuberosum
MARGLKKHLKRLNAPKHWMLDKLGGAFAPKPSSGPHKSRECLPLVIIMRNRLKYALTYREVISILMQRQVMVDGKVRTDKTYPAGFMDVVSIPKTNENFRLLYDTKGRFRLHSLRDEESKFKLCKVRSVQFGQKGIPYLNTYDGRTIRYPDPLIKANDTIKLDLESNKIVDFIKFDVGNVVMVTGGRNRGRVGVIKNREKHKGSFETLHIQDSQGHEFATRLGNVFTLGKGTKPWVSLPKGKGIKLTIIEDARKRLAAQSATPA

SEQ ID NO: 7557 - DNA, 783 bp, Yarrowia lipolytica
  CDS (1)..(783)
atggcccgaggacccaagaagcatctcaagcgactcgcagctccctcccactggatgctggacaagctgtccggcacctacgctccccgatcgtctgccggtccccacaagctgcgagagtctctgcctctcgtcatcttcctgcgaaaccgtctcaagtacgccctgaacggccgagaggttaacgccattctcatgcagcgactggtcaaggtcgacggcaaggtccgaaccgactccactttccccgctggcttcatggatgtcatccagctcgagaagaccggcgagaacttccgacttgtctacgacgtcaagggccgatttgccgtccaccgaatcaccgatgaggaggctgcttacaagctcggcaaggtcaagcgagtccaggttggcaagaagggtatcccctacctcgtcacccacgacggccgaaccatccggtaccccgaccctctcatcaaggtcaacgacaccgtcaagatcgacctggccaccggcaagatcacctctttcgtcaagtttgagaacggtaacattgtcatgaccaccggaggtcgaaacatgggccgagtcggcaccatcacccaccgagagcgacatgagggtggcttcgatatcgtccacatcaaggacgctcttgacaaccagtttgttacccgactcactaacgttttcgttatcggtgagggcaacaagtctctcatctctctgcccaagggcaagggtatcaagctctccattgctgaggagcgagatgcccgacgagccaagcaggagtaa

SEQ ID NO: 7558 - protein, 260 aa, Yarrowia lipolytica
MARGPKKHLKRLAAPSHWMLDKLSGTYAPRSSAGPHKLRESLPLVIFLRNRLKYALNGREVNAILMQRLVKVDGKVRTDSTFPAGFMDVIQLEKTGENFRLVYDVKGRFAVHRITDEEAAYKLGKVKRVQVGKKGIPYLVTHDGRTIRYPDPLIKVNDTVKIDLATGKITSFVKFENGNIVMTTGGRNMGRVGTITHRERHEGGFDIVHIKDALDNQFVTRLTNVFVIGEGNKSLISLPKGKGIKLSIAEERDARRAKQE

SEQ ID NO: 7559 - DNA, 780 bp, Oryza sativa
  CDS (1)..(780)
atggcgaggggattgaagaagcatctcaagaggctcaatgcgcccaagctcggcggagcttttgcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatggatgtgatttccattccaaagactggtgagaactacaggcttctctatgacaccaagggtcgcttccgccttcagtccgtcaaggatgaggatgccaagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggagggaggaacactggtcgtgttggagtaattaagaacagggagaagcacaagggcagttttgagaccatccatgtggaggacgcattgggccatgccttcgccacccgtctgggcaatgtgttcaccatcggcaagggcaacaagccatgggtgtctctccctaagggcaagggtatcaagctcagcatcatcgaggaacagaggaagcgagatgctgctgctcaggctgctgcaaatgcttaa

SEQ ID NO: 7560 - protein, 259 aa, Oryza sativa
MARGLKKHLKRLNAPKLGGAFAPKPSSGPHKSRECLPLILIIRNRLKYALTYREVISILMQRHVLVDGKVRTDKTYPAGFMDVISIPKTGENYRLLYDTKGRFRLQSVKDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHAFATRLGNVFTIGKGNKPWVSLPKGKGIKLSIIEEQRKRDAAAQAAANA

SEQ ID NO: 7561 - DNA, 780 bp, Brassica napus
  CDS (1)..(780)
atgacgagaggtttaaagaagcatttgaagaggctcaatgcccctaaaatttggggtcttgacaaacttggtggtgcctttgcccccaagccatcttccggaccacataagtcgagggagtgtcttcccctcgtccttatcatcaggaacaagttgaagtacgctcttacctaccgtgaagtgatctccatcttgatgcaaaggcatatccaggtcgatgggaaagtcaggactgacaagacctaccctgctggtttcatggatgttgtctctatccctaagaccaacgagaacttccgtcttctctatgataccaagggacgtttccgtcttcactccatcaaggatgaggaagcaaagtttaagctttgcaaggttcgaactatctccttcggacagaagggaatcccttaccttaacacgtacgatggtcgcaccatccgttaccctgacccgctcatcaagcctaacgacaccattaagctcgaccttgaggagaacaaggttgtcgagttcatcaagttcgatgtcggcaatgttgtgatggttactggtggaagaaacagagggcgtgttggtgtgattaagaaccgtgagaagcataagggaagctttgagacgatccacatccaggacgcgacagggcatgagtttgcaacaaggttggggaatgtcttcactctagggaaaggaacaaagccgtgggtgtctcttcctaagggtaagggtatcaagcttaccatcattgaggaagctaggaagaggcttgcggctcaatag

SEQ ID NO: 7562 - protein, 259 aa, Brassica napus
MTRGLKKHLKRLNAPKIWGLDKLGGAFAPKPSSGPHKSRECLPLVLIIRNKLKYALTYREVISILMQRHIQVDGKVRTDKTYPAGFMDVVSIPKTNENFRLLYDTKGRFRLHSIKDEEAKFKLCKVRTISFGQKGIPYLNTYDGRTIRYPDPLIKPNDTIKLDLEENKVVEFIKFDVGNVVMVTGGRNRGRVGVIKNREKHKGSFETIHIQDATGHEFATRLGNVFTLGKGTKPWVSLPKGKGIKLTIIEEARKRLAAQ

SEQ ID NO: 7563 - DNA, 789 bp, Brassica napus
  CDS (1)..(789)
atggcgagaggtttaaagaagcatttgaagaggctcaatgcccctaagcattggatgcttgacaaacttggtggtgctttcgcccccaagccatcttctggaccacacaagtcgagggagtgccttcctcttgttcttatcatcaggaacaggttgaagtatgctcttacctaccgtgaagtcatctccatcttgatgcaaaggcatatccaggttgatggcaaagtcaggactgataagacctaccctgctggtttcatggatgttatctctatccccaagactaacgagaacttccgtcttctctatgataccaagggtcgtttccgtcttcactccatcagagatgaggaagccaagtttaagctttgcaaggttcgaactatccaggtcggacagaagggcattccttacctcaacacatacgatggtcgcaccatccgttaccctgacccgttcatcaagcctaacgacaccatcaagctcgatcttgaggagaacaagattgttgagttcatcaagtttgatgtcggcaatgttgtcatggttaccggaggaagaaacagggggcgtgttggtgtgattaagaaccgtgagaagcataagggaagctttgagactatccacatccaagactcgacaggacatgagtttgcaacaaggttgggtaatgtgttcacccttggcaaaggaacaaagccctgggtgtctcttcccaagggtaaaggtattaagcttaccatcattgaggaggccaagaagaggcttgctggtcaacaggctgcttga

SEQ ID NO: 7564 - protein, 262 aa, Brassica napus
MARGLKKHLKRLNAPKHWMLDKLGGAFAPKPSSGPHKSRECLPLVLIIRNRLKYALTYREVISILMQRHIQVDGKVRTDKTYPAGFMDVISIPKTNENFRLLYDTKGRFRLHSIRDEEAKFKLCKVRTIQVGQKGIPYLNTYDGRTIRYPDPFIKPNDTIKLDLEENKIVEFIKFDVGNVVMVTGGRNRGRVGVIKNREKHKGSFETIHIQDSTGHEFATRLGNVFTLGKGTKPWVSLPKGKGIKLTIIEEAKKRLAGQQAA

SEQ ID NO: 7565 - DNA, 789 bp, Brassica napus
  CDS (1)..(789)
atggcaagaggattgaagaagcatctgaagaggctcaatgcccccaagcattgggatcttgacaaacttggtggtgccttcgctcccaagccctcttctggaccccacaagtctagagaatgccttcctctcgtcctgatcatcaggaacaagttgaagtacgctttgacataccgtgaagtcatctccatcttgatgcaaaggcatatccaagtcgatggtaaagtcaggactgacaagacttaccctgccggcttcatggatgttgtctccatccccaagacgaatgagaacttccgtcttctctatgacaccaagggacgtttccgtctccactccatcagggatgaggaagctaagttcaagctttgcaaggttaggacgatccagctagggcaaaagggaatccctttcctcaacacatacgacggtcgcaccatccgttaccccgacccactcatcaaaccgaacgacaccatcaagctcgacctcgaggagaacaaggtcgtggacttcatcaagttcgacgtcggcaacgttgtgatggtgactggagggagaaacagagggcgtgtgggtgtgattaagaaccgtgagaagcataagggaagctttgagacgatccacattcaagattcaaccggacatgagtttgccacgaggttgggcaatgtgtttaccttggggaaagggacgaagccgtgggtgtctcttccgaaggggaaaggtattaagcttaccatcattgaggaagctaggaagaggctctctgctcaacaagctgcttaa

SEQ ID NO: 7566 - protein, 262 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQLGQKGIPFLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 7567 - DNA, 789 bp, Linum usitatissimum
  CDS (1)..(789)
atggcgaggggtttgaagaagcacttgaagaggctcaatgctcccaagcattggatgctcgacaagctcggcggcgctttcgctcctaagccttcatctgggccgcacaagtctagggagtgccttcctttggttcttattctgcgaaacaggttgaagtacgctttgacctaccgtgaggttcagtccatcttgatgcagcgtcatgtgatggttgataacaaggtcaggactgataagaccttcccagctgggtttatggatgtggtctccatccccaagaccaatgagaatttccgtctgctgtatgataccaagggaaggttcagactgcactccatccgtgatgaggaggcaaagttcaagctgtgcaaggtcaggaacatccaattcggttccaagggtatcccatacctaaatacctatgatggccgcaccatccgctaccccgacccgctcatcaaggctaacgacaccatcaagctggacctcgattccactaagattgttgacttcatcaagtttgacgttggcaacgttgtcatggtcaccggaggcaggaacagaggccgagtcgggatcctgaagaacagagagaagcataagggaagcatcgagacagtccacatccaggactctactggtcacgagtttgccactcttctgtccaatgttttcaccatcggcaagggttccaagccctgggtgtctctccccaagggcaagggtatcaagcttaccatcattgaggaggccaagaagaggattgctgctcaggctgctgcttag

SEQ ID NO: 7568 - protein, 262 aa, Linum usitatissimum
MARGLKKHLKRLNAPKHWMLDKLGGAFAPKPSSGPHKSRECLPLVLILRNRLKYALTYREVQSILMQRHVMVDNKVRTDKTFPAGFMDVVSIPKTNENFRLLYDTKGRFRLHSIRDEEAKFKLCKVRNIQFGSKGIPYLNTYDGRTIRYPDPLIKANDTIKLDLDSTKIVDFIKFDVGNVVMVTGGRNRGRVGILKNREKHKGSIETVHIQDSTGHEFATLLSNVFTIGKGSKPWVSLPKGKGIKLTIIEEAKKRIAAQAAA

SEQ ID NO: 7569 - DNA, 798 bp, Hordeum vulgare
  CDS (1)..(798)
atggctaggggtttgaagaagcatctgaagaggctcaatgccccgtctcattggatgcttgacaagcttggtggagcttttgcccccaagccatcatctggtcctcacaaggccagggaatgcctgcctctgatcctcatcctgaggaacagactgaaatatgctctcacgtaccgtgaagtgcaatctatccttatgcagcgtcatattatggttgatggaaaggtccgcactgacaagacctaccctgctggtttcatggacattatttctattcccaagactggtgagaactacaggcttctgtatgacaccaagggccgcttccgccttcactctgtcagggatgaggatgctaagttcaagctctgcaaggtcaggtctgtccagttcggccagaagggcatcccatacctgaacacctatgatggccgcaccatccgctacccagacccactcatcaaggccaacgacaccatcaagctcgacctggagaccaacaagattgttgacttcatcaagtttgacgtcggcaacgtcgtcatggtgactggtgggcgcaacactgggcgtgttggtgtgatcaagaacagggagaagcataagggaacctttgagaccatccacgttgaggatgcccagggtcaccagtttgccacccgtctgggcaacgtgttcaccattggcaagggcaccaagccttgggtgagcctccccaagggcaagggtatcaagctcaccatcattgaggagcagaggaagagggatgccgcagctcaggctgctgccaaggcctga

SEQ ID NO: 7570 - protein, 265 aa, Hordeum vulgare
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 7571 - DNA, 789 bp, Brassica napus
  CDS (1)..(789)
atggcaagaggattgaagaagcatctgaagaggctcaatgcccccaagcattgggatcttgacaaacttggtggtgccttcgctcccaagccctcttccggacctcacaagtctagagaatgccttcctctcgtcctgatcatcaggaacaagttgaagtacgctttgacataccgtgaagtcatctccatcctcatgcaaaggcatatccaagtcgatggtaaagtcaggactgacaagacttaccctgctggcttcatggatgttgtctccatccccaagacgaatgagaacttccgtcttctctacgacaccaagggacgtttccgtctccactccgtcagggatgaggaagctaagttcaagctttgcaaggttaggacgatccagctagggcaaaagggaatcccctacctcaacacttacgacggtcgcacaatccgttaccccgacccactcatcaaacccaacgacaccatcaagctcgacctcgaggagaacaaggttgtggacttcatcaagttcgacgtcggcaacgttgtgatggtgactggagggagaaacagagggcgtgttggtgtgattaagaaccgtgagaagcataagggaagctttgagacgatccacattcaagattcaaccggacatgagtttgccacgaggttgggcaatgtgtttaccttggggaaagggacgaagccgtgggtgtctctaccgaaggggaaaggtattaagcttaccatcattgaggaagctaggaagaggctctctgctcaacaagctgcttaa

SEQ ID NO: 7572 - protein, 262 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSVRDEEAKFKLCKVRTIQLGQKGIPYLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 7573 - DNA, 789 bp, Brassica napus
  CDS (1)..(789)
atggcgaggggattgaagaagcatttgaagaggctcaatgcccccaagcactgggatcttgacaaacttggtggtgccttcgctcccaagccgtcttctggacctcacaagtcgagggagtgtcttcctctcgtcttgatcataaggaacaagttgaagtacgctttgacgtaccgtgaagtcatctccatccttatgcaaaggcatatccaagttgatggtaaagtcaggactgacaagacataccctgctggtttcatggatgttgtatcgattcccaagacgaatgagaacttccgtcttctgtatgacaccaagggacgtttccgcctccactccatcagggacgaggaagcaaagttcaagctttgcaaggttaggactatccaggtggggcagaagggaatcccttacctcaacacttacgacggtcgcaccatccgttaccctgacccgctcatcaagccaaacgacaccatcaagctcgaccttgaggagaacaagatcgtagactccatcaagtttgatgtcggtaacgttgtgatggtgacgggagggagaaacagagggcgtgtgggtgtgatcaagaaccgtgagaagcataagggaagctttgagacgatccacatccaagactcgacgggacacgagtttgccactaggttgggcaatgtgttcaccctcggcaaaggtacaaagccatgggtgtctcttccaaagggcaaaggtattaagctgaccatcattgaggaagccaggaagaggctttctgcccagcaagctgcttaa

SEQ ID NO: 7574 - protein, 262 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVDSIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 7575 - DNA, 789 bp, Brassica napus
  CDS (1)..(789)
atggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaagtcatctccatcttgatgcaaaggcacatccaggttgatggcaaagtcaggactgacaagacctaccctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgttggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaaggtattaagctcaccatcatcgaggaagccaggaagaggctctctggccaacaagctgcttaa

SEQ ID NO: 7576 - protein, 262 aa, Brassica napus
MARGLKKHLKRLNAPKHWMLDKLGGAFAPKPSSGPHKSRECLPLVLIIRNRLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKIVDSIKFDVGNVVMVTGGRNRGRVGVIKNREKHKGSFETIHIQDSTGHEFATRLGNVFTLGKGTKPWVSLPKGKGIKLTIIEEARKRLSGQQAA

SEQ ID NO: 7577 - DNA, 789 bp, Brassica napus
  CDS (1)..(789)
atggcaaggggattgaagaagcatttgaagaggctcaatgctcccaagcattgggatcttgacaaacttggtggtgccttcgctcccaagccctcttctggacctcacaagtctagagagtgccttcctctcgtcctgatcatcaggaacaagttgaagtacgctttgacataccgtgaggtcatctccatccttatgcaaaggcatatccaagtcgatggaaaagtcaggactgacaagacttaccctgctggcttcatggatgttgtttccatccccaagacgaatgagaacttccgtcttctgtatgacaccaaaggacgtttccgtctccactccctcagagatgaggaagcaaagttcaagctatgcaaggttaggaccatccagtttggacaaaagggaatcccttacctcaacacatacgacggtcgcaccatccgttaccccgacccgctcatcaaacccaacgacaccatcaagctagacctcgaggagaacaagattgtggagttcatcaagtttgacgtcggtaacgttgtgatggtgactggtggcaggaacagagggcgtgttggtgtgattaagaaccgtgagaagcataagggaagctttgagacgattcatattcaagactctacgggacatgagtttgccacgaggttgggcaatgtgtttactctggggaaaagaacaaagccgtgggtgtctcttccaaagggtaaaggtattaagctgactatcattgaggaagcctggaagaggctttctgcccaacaagctgcttaa

SEQ ID NO: 7578 - protein, 262 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSLRDEEAKFKLCKVRTIQFGQKGIPYLNTYDGRTIRYPDPLIKPNDTIKLDLEENKIVEFIKFDVGNVVMVTGGRNRGRVGVIKNREKHKGSFETIHIQDSTGHEFATRLGNVFTLGKRTKPWVSLPKGKGIKLTIIEEAWKRLSAQQAA

SEQ ID NO: 7579 - DNA, 789 bp, Brassica napus
  CDS (1)..(789)
atgacgagaggtttaaagaagcatttgaagaggctcaatgcccctaaaatttggggtcttgacaaacttggcggtgcctttgcccccaagccatcttccggaccacataagtcgagggagtgtcttcccctcgttcttatcatcaggaacaagttgaagtacgctcttacctaccgtgaagtgatctccatcttgatgcaaaggcatatccaggtcgatgggaaagtcaggactgacaagacctaccctgctggtttcatggatgttgtctctatccctaagaccaacgagaacttccgtcttctctatgataccaagggacgtttccgtcttcactccatcaaggatgaggaagcaaagcttaagctttgcaaggttcgaactatctccttcggacagaagggaatcccttaccttaacacgtacgatggtcgcaccatccgttaccctgacccgctcatcaagcctaacgacaccattaagctcgaccttgaggagaacaaggttgtcgagttcatcaagttcgatgtcggcaatgttgtgatggttactggtggaagaaacagagggcgtgttggtgtgattaagaaccgtgagaagcataagggaagctttgagacgatccacatccaggacgcgacagggcatgagtttgcaacaaggttgggtaatgtgttcacccttggcaaaggaacaaagccgtgggtgtctcttcccaagggtaaaggtattaagcttaccatcattgaggaggccaagaagaggcttgctggtcaacaggctgcttga

SEQ ID NO: 7580 - protein, 262 aa, Brassica napus
MTRGLKKHLKRLNAPKIWGLDKLGGAFAPKPSSGPHKSRECLPLVLIIRNKLKYALTYREVISILMQRHIQVDGKVRTDKTYPAGFMDVVSIPKTNENFRLLYDTKGRFRLHSIKDEEAKLKLCKVRTISFGQKGIPYLNTYDGRTIRYPDPLIKPNDTIKLDLEENKVVEFIKFDVGNVVMVTGGRNRGRVGVIKNREKHKGSFETIHIQDATGHEFATRLGNVFTLGKGTKPWVSLPKGKGIKLTIIEEAKKRLAGQQAA

SEQ ID NO: 7581 - DNA, 789 bp, Brassica napus
  CDS (1)..(789)
atggcgaggggattgaagaagcatttgaagaggctcaatgcccccaagcactgggatcttgacaaacttggtggtgccttcgctcccaagccgtcttctggacctcacaagtcgagggagtgtcttcctctcgtcttgatcatcaggaacaagttgaagtacgctttgacgtaccgtgaagtcatctccatcctcatgcaaaggcatatccaagttgatggtaaagtcaggactgacaagacataccctgctggtttcatggatgttgtatcgatccccaagacgaatgagaacttccgtcttctgtatgacaccaagggacgtttccgcctccactccatcagggacgaggaagcaaagttcaagctttgcaaggttaggactatccaggtggggcagaagggaatcccttacctcaacacttacgacggtcgcaccatccgttaccccgacccactcatcaaacccaacgacaccatcaagctcgacctcgaggagaacaaggtcgtggacttcatcaagttcgacgtcggcaacgttgtgatggtgactggagggagaaacagagggcgtgtgggtgtgattaagaaccgtgagaagcataagggaagctttgagacgatccacattcaagattcaaccggacatgagtttgccacgaggttgggcaatgtgtttaccttggggaaaggaactaagccgtgggtgtctctaccgaaggggaaaggtattaagcttaccatcattgaggaagctaggaagaggctctctgctcaacaagctgcttaa

SEQ ID NO: 7582 - protein, 262 aa, Brassica napus
MARGLKKHLKRLNAPKHWDLDKLGGAFAPKPSSGPHKSRECLPLVLIIRNKLKYALTYREVISILMQRHIQVDGKVRTDKTYPAGFMDVVSIPKTNENFRLLYDTKGRFRLHSIRDEEAKFKLCKVRTIQVGQKGIPYLNTYDGRTIRYPDPLIKPNDTIKLDLEENKVVDFIKFDVGNVVMVTGGRNRGRVGVIKNREKHKGSFETIHIQDSTGHEFATRLGNVFTLGKGTKPWVSLPKGKGIKLTIIEEARKRLSAQQAA

SEQ ID NO: 7583 - DNA, 789 bp, Brassica napus
  CDS (1)..(789)
atggcgagaggtttaaagaagcatttgaagaggctcaatgcccctaagcattggatgcttgacaaactcggtggtgcttttgcccccaagccatcttctggaccacacaagtcgagggagtgccttccccttgttcttatcatcaggaacaggttgaagtatgctcttacctaccgtgaagtcatctccatcttgatgcaaaggcacatccaggttgatggcaaagtcaggactgacaagacctaccctgctggtttcatggatgttatctctatccccaagactaacgagaacttccgtcttctctatgacaccaagggtcgtttccgtcttcactccatcagggatgaggaagccaagtttaagctttgcaaggttcgaactatccaggtcggacagaagggcattccttacctcaacacatacgatggtcgcaccatccgttaccctgacccgctcatcaagcctaatgacaccatcaagctcgatcttgaggagaacaagattgtggagtccatcaagtttgatgtcggcaatgttgtgatggtgactggaggaagaaacagagggcgtgttggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaaggtattaagctcaccatcatcgaggaagccaggaagaggctcgctggccaacaagctgcttaa

SEQ ID NO: 7584 - protein, 262 aa, Brassica napus
MARGLKKHLKRLNAPKHWMLDKLGGAFAPKPSSGPHKSRECLPLVLIIRNRLKYALTYREVISILMQRHIQVDGKVRTDKTYPAGFMDVISIPKTNENFRLLYDTKGRFRLHSIRDEEAKFKLCKVRTIQVGQKGIPYLNTYDGRTIRYPDPLIKPNDTIKLDLEENKIVESIKFDVGNVVMVTGGRNRGRVGVIKNREKHKGSFETIHIQDSTGHEFATRLGNVFTLGKGTKPWVSLPKGKGIKLTIIEEARKRLAGQQAA

SEQ ID NO: 7585 - DNA, 795 bp, Glycine max
  CDS (1)..(795)
atggcgagagggttaaagaaacacctgaagaggctcaatgctccaaaacattggatgcttgacaagcttggtggtgcctttgcacccaagccatcatctggaccccacaagtcccgggagtgtcttcctctgatcctcatcctacgaaacaggctaaagtatgctctaacatatagagaagttattgccatcttgatgcagcgccatgttcttgttgatggcaaggttaggacagacaagacataccctgctggtttcatggatgttgtttctattcccaaaacaaatgaaaatttccgtctactgtatgacacaaaaggtcgattccgtctccactctgtaagggatgaagagtcaaagtttaagctctgcaaggttcgatctgttcaatttgggcaaaagggtatcccctatttaaacacatacgatgggcgcaccatccgctatcctgacccactaatcaaggccaatgacaccatcaagctggaccttgaaagcaacaagatcactgatttcatcaaatttgatgtggggaatgttgttatggtcactggtggaaggaacagaggccgtgtcggtgtcatcaagaacagagagaaacacaagggaagttttgagaccatccatgtccaggatgcaactggtcacgaatttgcaactcgtatgggtaatgtcttcatcattggcaaagggacaaaaccttgggtgtctcttcccaaaggcaagggtatcaagttgtctatcattgaggaggctagaaagaggcttgctgcacaaaatgaaacagttgcctaa

SEQ ID NO: 7586 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDEESKFKLCKVRSVQFGQKGIPYLNTYDGRTIRYPDPLIKANDTIKLDLESNKITDFIKFDVGNVVMVTGGRNRGRVGVIKNREKHKGSFETIHVQDATGHEFATRMGNVFIIGKGTKPWVSLPKGKGIKLSIIEEARKRLAAQNETVA

SEQ ID NO: 7587 - DNA, 795 bp, Glycine max
  CDS (1)..(795)
atggcgagaggattgaagaagcatttgaagaggcttaatgccccaaagcattggatgcttgacaaactgggtggtgcatttgctcctaagccctcatctggaccacacaaatccagggaatgcctgccactcatactcattttgcgaaaccggctgaagtatgctctgacataccgtgaagtcattgctattctgatgcagcgacatgtccttgttgatggcaaagtcaggacagacaagacatatcctgctggtttcatggatgttgtatcaatccctaaaacaaatgagaacttccgcctgctgtatgacaccaaaggccgattccgtcttcactcagtcatagatgacgaggctaagttcaagctttgcaaagttcgctcagtgcagtttgggcaaaaaggtatcccatacttgaacacctacgatggtcgcactatccgctacccagaccctctcatcagagctaatgacaccattaagttggatttggaggagaacaagattgtcgatttcatcaagtttgatgttgggaatgtagtcatggtgacaggtggaaggaataggggtcgtgttggagtgatcaagaacagagagaagcataagggaagctttgagactatccatgttcaggatgccactggccacgagtttgcaactcgtatgggcaatgtgttcaccattggcaagggaacaaaaccatggatatctcttcccaagggtaaaggtattaaactatcaatcattgaggaagctaggaaaaggattgccgcccaacaagcaactgctgcttaa

SEQ ID NO: 7588 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVIDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDATGHEFATRMGNVFTIGKGTKPWISLPKGKGIKLSIIEEARKRIAAQQATAA

SEQ ID NO: 7589 - DNA, 795 bp, Glycine max
  CDS (1)..(795)
atggctaggggactaaagaagcatttgaaaaggctcaatgctcctaagcattggatgcttgacaaactgggtggtgcatttgcgcctaaaccctcatctggaccacacaaatcgagggagtgcctccccctcattcttattctgcgaaaccggctgaagtatgctctgacataccgtgaagtcattgctattctgatgcagcgccatgttcttgttgatggcaaagtcaggactgacaagacttaccctgctggtttcatggatgttgtttcaatcccaaaaacaaatgagaacttccgcctgctctatgacactaaaggccgattccgtcttcattccatcagggatgatgaggcaaagttcaagctctgcaaggttaggtcagtacagtttggccagaaaggtatcccatacctgaacacctatgatggtcgcaccatccgttacccagaccctctcatcagggccaatgacactgttaagctggatctggaggaaaacaagattgtcgattttatcaaatttgatgttgggaatgtagttatggtaacaggtggaagaaacagggggcgtgttggagtgatcaagaacagggagaagcataagggtagcttcgagacaattcacgtgcaggatgccactgggcatgaatttgctactcgtatgggcaatgtgttcactattggcaaggggacaaagccatggatatccctgcccaagggtaagggtattaagctatcaatcattgaagaagctaggaaaaggattgccgcccagcaagcaactactgcttaa

SEQ ID NO: 7590 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSIRDDEAKFKLCKVRSVQFGQKGIPYLNTYDGRTIRYPDPLIRANDTVKLDLEENKIVDFIKFDVGNVVMVTGGRNRGRVGVIKNREKHKGSFETIHVQDATGHEFATRMGNVFTIGKGTKPWISLPKGKGIKLSIIEEARKRIAAQQATTA

SEQ ID NO: 7591 - DNA, 795 bp, Glycine max
  CDS (1)..(795)
atggcgagaggattaaagaagcatctgaagaggcttaatgccccaaagcattggatgcttgacaaactgggtggtgcatttgctcctaagccctcatctggaccacacaaatcgagggaatgcctgccactcatactcattttgcgaaaccggctgaagtatgctctaacataccgtgaagtcattgctattctgatgcagcgacatgtccttgttgatggcaaagtcaggactgacaaaacataccctgctggttttatggatgttgtatcaatccctaaaacaaatgagaacttccgcctgctgtatgacaccaaaggtcgattccgtctccactcagtcagggatgacgaggctaagttcaagctttgcaaagttcgctcagtgcagtttgggcaaaagggtatcccatacttaaatacctacgacggtcgcactatccgctacccagaccctctcatcagggctaatgacaccattaagctggatttggaggagaacaagattgttgatttcatcaaatttgatgttgggaatgtagtcatggtgacgggtggaaggaataggggtcgtgttggagtgatcaagaacagagagaagcataagggaagctttgagactatccatgttcaggatgctactgggcatgaatttgcaactcgaatgggcaatgtgttcaccattggcaagggaacaaaaccgtggatatctcttcccaagggtaaaggtattaagctatcaatcattgaggaagctaggaaaaggattgccgcccaacaagcaactgctgcttaa

SEQ ID NO: 7592 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDATGHEFATRMGNVFTIGKGTKPWISLPKGKGIKLSIIEEARKRIAAQQATAA

SEQ ID NO: 7593 - DNA, 786 bp, Zea mays
  CDS (1)..(786)
atgcctcgtggacccaagaagcacctcaagcgcttgcacgcgcccaagcactggatgctcgacaagatgtcgggtgtctgggcccctcgccccagcgctggccctcacaagctccgtgagtgcttgccccttgtcatcttgctcagaaaccgtttgaagtatgccttgaccaagaaggaggttacttccattctgatgcagcgtctcattcgcgttgactccaaggtccgcactgatcccggcttccctgctggtttcatggatgtcgtcaagattgagcgcaccaatgagcacttccgtttgctctatgataccaagggtcgtttcaccatccaccgtatcacccccgaggaggcttcctacaagcttgccaaggtcaagaaggttgccttgggccccaagggaatccccttcgtgaccacccacgacggtcgcaccatccgctaccctcaccccgatgtccgtgttcacgacatcgtcaagcttgacattgccactggctccttcaaggagttcgtcaagttcgaggttggtaacttggccatgaccactggcggtcgtaacttgggccgtgttggtgttatctataaccgcgagaagcacgacggatctcacgacgttatctacatgcgtgacgagaagggacacacctggaccaccctcatcgagaacgttttcatcctcggcaagggtaaccagtctctcgtttctctccccaaggatcgtggagtcaagctctccgtcctcgaggagcgtgagaagatcctccgcaagctccagcagtaa

SEQ ID NO: 7594 - protein, 261 aa, Zea mays
MPRGPKKHLKRLHAPKHWMLDKMSGVWAPRPSAGPHKLRECLPLVILLRNRLKYALTKKEVTSILMQRLIRVDSKVRTDPGFPAGFMDVVKIERTNEHFRLLYDTKGRFTIHRITPEEASYKLAKVKKVALGPKGIPFVTTHDGRTIRYPHPDVRVHDIVKLDIATGSFKEFVKFEVGNLAMTTGGRNLGRVGVIYNREKHDGSHDVIYMRDEKGHTWTTLIENVFILGKGNQSLVSLPKDRGVKLSVLEEREKILRKLQQ

SEQ ID NO: 7595 - DNA, 777 bp, Zea mays
  CDS (1)..(777)
atggtacgtggtccaaagaaacatttaaagagacttaatgctccaagtgcatggatgttagacaaacttgctggtgattgggcaccaaaaccaagtccaggtccacacaaaaacagagaatgtgtcccattaatcattttattgagaaacagattaaagtatgctcttaccagaagagaagtcaccctcatcgccgctcaaagacacgtttcagttgatagcgttgttagaactgataccagattcccaattggttttatggacgttgtctccatcccaaaaactggagaaaacttccgtcttttatacgacgtcaaaggaagattcaacatccaccgtatcagcgaagaggaagccaaattcaaattacttaaagttgtttccaccgcaattggtcgcggtaaagtcccataccttgtttctcacgatggaagaactattcgttatcctgatccagccattaaagaaaacgatgttgtcaaatattcattagaaagcaaaactattgttggacacgtcaaatttgatgttggtactctcgctatgatcactggaggtaacaacttgggtcgtgttggtgtcatcgaacgtcgtgaaaaacacgatggatcccatgacatcgttcacttgaaagacaccgctggtaacaaatttgctactagattacacaacgtttttgttatcggaaatggttcatccgctcttatctctattccaaaagcccaaggaatcagactctcaattgttcaagagcgtcaacgtgcacttggaaattaa

SEQ ID NO: 7596 - protein, 258 aa, Zea mays
MVRGPKKHLKRLNAPSAWMLDKLAGDWAPKPSPGPHKNRECVPLIILLRNRLKYALTRREVTLIAAQRHVSVDSVVRTDTRFPIGFMDVVSIPKTGENFRLLYDVKGRFNIHRISEEEAKFKLLKVVSTAIGRGKVPYLVSHDGRTIRYPDPAIKENDVVKYSLESKTIVGHVKFDVGTLAMITGGNNLGRVGVIERREKHDGSHDIVHLKDTAGNKFATRLHNVFVIGNGSSALISIPKAQGIRLSIVQERQRALGN

SEQ ID NO: 7597 - DNA, 24 bp, Artificial sequence
  primer
atggctagaggaccaaagaagcat

SEQ ID NO: 7598 - DNA, 26 bp, Artificial sequence
  primer
ttataaaccttgttgagctcttcttc

SEQ ID NO: 7599 - protein, 247 aa, Artificial sequence
  consensus sequence
  Variant (2)..(4): Xaa in position 2 to 4 is any amino acid
  Variant (10)..(10): Xaa in position 10 is any amino acid
  Variant (13)..(14): Xaa in position 13 to 14 is any amino acid
  Variant (16)..(21): Xaa in position 16 to 21 is any amino acid
  Variant (22)..(25): Xaa in position 22 to 25 is any or no amino acid
  Variant (27)..(28): Xaa in position 27 to 28 is any amino acid
  Variant (31)..(31): Xaa in position 31 is any amino acid
  Variant (35)..(39): Xaa in position 35 to 39 is any amino acid
  Variant (43)..(46): Xaa in position 43 to 46 is any amino acid
  Variant (48)..(49): Xaa in position 48 to 49 is any amino acid
  Variant (54)..(56): Xaa in position 54 to 56 is any amino acid
  Variant (59)..(61): Xaa in position 59 to 61 is any amino acid
  Variant (64)..(69): Xaa in position 64 to 69 is any amino acid
  Variant (76)..(76): Xaa in position 76 is any amino acid
  Variant (78)..(78): Xaa in position 78 is any amino acid
  Variant (79)..(80): Xaa in position 79 to 80 is any or no amino acid
  Variant (82)..(82): Xaa in position 82 is any amino acid
  Variant (88)..(91): Xaa in position 88 to 91 is any amino acid
  Variant (92)..(92): Xaa in position 92 is any or no amino acid
  Variant (94)..(94): Xaa in position 94 is any amino acid
  Variant (96)..(97): Xaa in position 96 to 97 is any amino acid
  Variant (99)..(100): Xaa in position 99 to 100 is any amino acid
  Variant (103)..(104): Xaa in position 103 to 104 is any amino acid
  Variant (106)..(109): Xaa in position 106 to 109 is any amino acid
  Variant (111)..(113): Xaa in position 111 to 113 is any amino acid
  Variant (114)..(114): Xaa in position 114 is any or no amino acid
  Variant (116)..(116): Xaa in position 116 is any amino acid
  Variant (118)..(119): Xaa in position 118 to 119 is any amino acid
  Variant (122)..(122): Xaa in position 122 is any amino acid
  Variant (125)..(131): Xaa in position 125 to 131 is any amino acid
  Variant (132)..(132): Xaa in position 132 is any or no amino acid
  Variant (134)..(140): Xaa in position 134 to 140 is any amino acid
  Variant (144)..(147): Xaa in position 144 to 147 is any amino acid
  Variant (148)..(156): Xaa in position 148 to 156 is any or no amino acid
  Variant (158)..(163): Xaa in position 158 to 163 is any amino acid
  Variant (165)..(174): Xaa in position 165 to 174 is any amino acid
  Variant (176)..(178): Xaa in position 176 to 178 is any amino acid
  Variant (180)..(180): Xaa in position 180 is any amino acid
  Variant (182)..(183): Xaa in position 182 to 183 is any amino acid
  Variant (185)..(188): Xaa in position 185 to 188 is any amino acid
  Variant (193)..(193): Xaa in position 193 is any amino acid
  Variant (195)..(195): Xaa in position 195 is any amino acid
  Variant (198)..(198): Xaa in position 198 is any amino acid
  Variant (200)..(200): Xaa in position 200 is any amino acid
  Variant (202)..(203): Xaa in position 202 to 203 is any amino acid
  Variant (204)..(204): Xaa in position 204 is any or no amino acid
  Variant (206)..(207): Xaa in position 206 to 207 is any amino acid
  Variant (208)..(208): Xaa in position 208 is any or no amino acid
  Variant (210)..(217): Xaa in position 210 to 217 is any amino acid
  Variant (218)..(218): Xaa in position 218 is any or no amino acid
  Variant (220)..(220): Xaa in position 220 is any amino acid
  Variant (221)..(224): Xaa in position 221 to 224 is any or no amino acid
  Variant (226)..(226): Xaa in position 226 is any amino acid
  Variant (228)..(231): Xaa in position 228 to 231 is any amino acid
  Variant (234)..(235): Xaa in position 234 to 235 is any amino acid
  Variant (237)..(238): Xaa in position 237 to 238 is any amino acid
  Variant (239)..(240): Xaa in position 239 to 240 is any or no amino acid
  Variant (243)..(244): Xaa in position 243 to 244 is any amino acid
GXXXHLKRLXAPXXWXXXXXXXXXXAXXPSXGPHXXXXXLPLXXXXRXXLKYAXXXREXXXILXXXXXXVDGKVRXDXXXPXGFMDVXXXXXTXEXXRXXYDXXGXXXXHXXXXEXAXXKLXKVXXXXXXXXGXXXXXXXDGRXXXXXXXXXXXXXDXXXXXXDXXXXXXXXXXIXXXIXFXXGXXXXVTGGXNXGRXGXIXXXEXXXGXXXXXXXXXDXXXXXFXTXXXXVFXXGXXXXKPXXSLP

SEQ ID NO: 7600 - protein, 59 aa, Artificial sequence
  protein pattern
  Variant (2)..(2): Xaa in position 2 is Ala, Pro or Ser
  Variant (6)..(9): Xaa in position 6 to 9 is any amino acid
  Variant (10)..(10): Xaa in position 10 is Cys or Ser
  Variant (11)..(11): Xaa in position 11 is Ile, Leu, Met or Val
  Variant (14)..(15): Xaa in position 14 to 15 is any amino acid
  Variant (16)..(16): Xaa in position 16 is Phe, Ile, Leu or Val
  Variant (17)..(17): Xaa in position 17 is Ile, Leu, Met or Val
  Variant (19)..(19): Xaa in position 19 is Asp or Asn
  Variant (20)..(20): Xaa in position 20 is any amino acid
  Variant (22)..(23): Xaa in position 22 to 23 is any amino acid
  Variant (25)..(25): Xaa in position 25 is any amino acid
  Variant (26)..(26): Xaa in position 26 is Asn or Thr
  Variant (27)..(27): Xaa in position 27 is any amino acid
  Variant (28)..(28): Xaa in position 28 is His, Lys or Arg
  Variant (30)..(30): Xaa in position 30 is any amino acid
  Variant (31)..(32): Xaa in position 31 to 32 is any or no amino acid
  Variant (34)..(41): Xaa in position 34 to 41 is any amino acid
  Variant (42)..(43): Xaa in position 42 to 43 is any or no amino acid
  Variant (45)..(45): Xaa in position 45 is Gly, Asn or Ser
  Variant (46)..(47): Xaa in position 46 to 47 is any amino acid
  Variant (49)..(49): Xaa in position 49 is any amino acid
  Variant (50)..(50): Xaa in position 50 is Asp, Glu or Asn
  Variant (51)..(52): Xaa in position 51 to 52 is any amino acid
  Variant (53)..(53): Xaa in position 53 is Phe, His or Tyr
  Variant (55)..(55): Xaa in position 55 is any amino acid
  Variant (57)..(57): Xaa in position 57 is Phe, Ile or Leu
SXGPHXXXXXXPLXXXXRXXLXXAXXXXEXXXIXXXXXXXXXXDXXXRXXXXXPXGXMD

SEQ ID NO: 7601 - protein, 15 aa, Artificial sequence
  protein pattern
  Variant (2)..(2): Xaa in position 2 is Leu, Met or Val
  Variant (3)..(3): Xaa in position 3 is Phe, Ile, Leu or Val
  Variant (4)..(4): Xaa in position 4 is any amino acid
  Variant (5)..(5): Xaa in position 5 is Asp or Asn
  Variant (6)..(7): Xaa in position 6 to 7 is any amino acid
  Variant (9)..(9): Xaa in position 9 is Lys or Arg
  Variant (10)..(10): Xaa in position 10 is Phe or Leu
  Variant (11)..(11): Xaa in position 11 is any amino acid
  Variant (12)..(12): Xaa in position 12 is Ile, Leu or Val
  Variant (14)..(14): Xaa in position 14 is any amino acid
  Variant (15)..(15): Xaa in position 15 is Ile, Leu or Val
RXXXXXXGXXXXHXX

SEQ ID NO: 7602 - DNA, 351 bp, Saccharomyces cerevisiae
  CDS (1)..(351)
atgatcgaaactgccatttatggtaagacagtggatgaccaatctcgatgtgtccactggcatcttccaaaggatgtaattgccatcaggtttaaatgttgtgataagtactatgcgtgctttgaatgccaccaagagttaagttctcacccgctagaaaaatatgatctccttgacgatgcaaataaacacttgattatttgcggagtttgccgtcatgaaatgacgtttgcagagtattacgactacaattcaaaccttatttgtcccaattgcagatccccctttaatccaggctgtaaattgcactaccatttgtatttccagaaccctccccccgctatgtgttga

SEQ ID NO: 7603 - protein, 116 aa, Saccharomyces cerevisiae
MIETAIYGKTVDDQSRCVHWHLPKDVIAIRFKCCDKYYACFECHQELSSHPLEKYDLLDDANKHLIICGVCRHEMTFAEYYDYNSNLICPNCRSPFNPGCKLHYHLYFQNPPPAMC

SEQ ID NO: 7604 - DNA, 312 bp, Streptococcus pyogenes M1 GAS
  CDS (1)..(312): transl_table=11
atgacggactgttttggaattgaccttgaccaagagtatcggtgcctacattatcataccccgcttgatattgttgggctcaaatgtgcttcttgtcagacttattatgcttgttaccattgccatgaccagttaacagatcatgcctttgtgccaacaggacatcaagaaacatctcctgttatttgtgggcattgtcgaaagctcttgagtcgagctgagtatggttgtggatgctgtccttattgtcaaagtccctttaatccagcctgtcataggcacaaggatatctattttttaaaggagtcgtaa

SEQ ID NO: 7605 - protein, 103 aa, Streptococcus pyogenes M1 GAS
MTDCFGIDLDQEYRCLHYHTPLDIVGLKCASCQTYYACYHCHDQLTDHAFVPTGHQETSPVICGHCRKLLSRAEYGCGCCPYCQSPFNPACHRHKDIYFLKES

SEQ ID NO: 7606 - DNA, 312 bp, Streptococcus pneumoniae TIGR4
  CDS (1)..(312): transl_table=11
atgatagaggcacagggtttcttagtggataagcaaacaagatgcattcattaccatagcaagctggatattattgctttacaatgctatgattgtaaaaagtattatgcttgttatcggtgtcatgattcattagaacatcacccttttgagccgtatcccttatctttgatacaggataagcctattttatgtggtgtttgtctaaaactactaacatataagcaatataaagaaagcttaagttgccccttttgtttttctcgctttaatccaggttgccaaaatcataaggaacgctattttaaatag

SEQ ID NO: 7607 - protein, 103 aa, Streptococcus pneumoniae TIGR4
MIEAQGFLVDKQTRCIHYHSKLDIIALQCYDCKKYYACYRCHDSLEHHPFEPYPLSLIQDKPILCGVCLKLLTYKQYKESLSCPFCFSRFNPGCQNHKERYFK

SEQ ID NO: 7608 - DNA, 342 bp, Schizosaccharomyces pombe 972h-
  CDS (1)..(342)
atgcaaactcctacggctcgttcttcaactaacgtatatgggaaactcgtcgataatgaaactcgttgttttcattatcattctaaagccgacgtcgtggcattaagatgtggacagtgtgaaaagttttatgcgtgttttcaatgtcatgatgaactcaatacacatccgtttttaccttggaggaaagcaaagtttcacattccttgtgtaatttgcggagcttgcaagaattcactgacagtagaggaataccgttctactgttcattgcaaatactgtaatcatccattcaatcctaaatgtaaaaatcatgccgggtactattttgaagacgcctga

SEQ ID NO: 7609 - protein, 113 aa, Schizosaccharomyces pombe 972h-
MQTPTARSSTNVYGKLVDNETRCFHYHSKADVVALRCGQCEKFYACFQCHDELNTHPFLPWRKAKFHIPCVICGACKNSLTVEEYRSTVHCKYCNHPFNPKCKNHAGYYFEDA

SEQ ID NO: 7610 - DNA, 315 bp, Staphylococcus aureus subsp. aureus MW2
  CDS (1)..(315): transl_table=11
atgcctaaagtttatggttcattaatcgatactgaaacacgctgtcgccattattttaccgaagaagatattattgctattaaatttaaatgttgtaataaatactatccatgctataagtgccataatgagtttgaaaagcacgccattaagcgttggtctgagccttcatttaacgaaaaagcaatcttatgcggtgtatgcaaacacgaattaacaatcaatgaatatatgatggtagagcgttgtccaaattgccaatctcggtttaacaatcgctgtaaatatcactatcatatttattttgaaatttaa

SEQ ID NO: 7611 - protein, 104 aa, Staphylococcus aureus subsp. aureus MW2
MPKVYGSLIDTETRCRHYFTEEDIIAIKFKCCNKYYPCYKCHNEFEKHAIKRWSEPSFNEKAILCGVCKHELTINEYMMVERCPNCQSRFNNRCKYHYHIYFEI

SEQ ID NO: 7612 - DNA, 309 bp, Streptococcus agalactiae 2603V/R
  CDS (1)..(309): transl_table=11
atgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggagtaa

SEQ ID NO: 7613 - protein, 102 aa, Streptococcus agalactiae 2603V/R
MQEYFGIGLDSSSRCYHYHTKLDIVALKCAVCQKYYACYKCHDALEEHCFAATKSDETFPVLCGSCRQMLTLKEYKTGFCPYCRMLFNPNCQRHDSIYFSKE

SEQ ID NO: 7614 - DNA, 318 bp, Oceanobacillus iheyensis HTE831
  CDS (1)..(318): transl_table=11
gtggtaaaagtctatggaaaggttgtcgatcatcaatctcggtgtgaacactatcattctaagaaagatattatcagtattaaatttaaatgttgcaacgcatactatccttgttacaagtgtcaccaagagtgtgaagaccatgaaatagaaagatggccaagagaagaatttgatgaaaaagctatcttgtgtggtgcgtgtcagaccgaattaacaataaatgaatacttgaaaatgaattcttgtaaaaattgtaatgcctcattcaacgaaaactgtcaataccattatcatctttattttaattataaataa

SEQ ID NO: 7615 - protein, 105 aa, Oceanobacillus iheyensis HTE831
MVKVYGKVVDHQSRCEHYHSKKDIISIKFKCCNAYYPCYKCHQECEDHEIERWPREEFDEKAILCGACQTELTINEYLKMNSCKNCNASFNENCQYHYHLYFNYK

SEQ ID NO: 7616 - DNA, 342 bp, Corynebacterium glutamicum ATCC 13032
  CDS (1)..(342): transl_table=11
atgctcccgccacggtttcgtcgactcctcttatctagggcgccgataatgcgtggccatctcattgacggtgacggccgctgcatccactatcacggacccttcgacgtcgtcggcaacaaatgcgccacatgcaacgagtggtgggcgtgtcatcgctgccacgaggagattgccaatcatcctttcgggaagatgcttatcgacgccccgagctcccttcaatgcggccactgcggggagcttatggcctacggggtgcaaaaatgcccgcgatgcgggcataacttcaatccagggtgttcactccacactccgctgtactacgaaatgccctcttga

SEQ ID NO: 7617 - protein, 113 aa, Corynebacterium glutamicum ATCC 13032
MLPPRFRRLLLSRAPIMRGHLIDGDGRCIHYHGPFDVVGNKCATCNEWWACHRCHEEIANHPFGKMLIDAPSSLQCGHCGELMAYGVQKCPRCGHNFNPGCSLHTPLYYEMPS

SEQ ID NO: 7618 - DNA, 318 bp, Corynebacterium efficiens YS-314
  CDS (1)..(318): transl_table=11
ttgtctcgcatgagcgagatccagggtgtgcttatcgacgcccgcggccgctgcgcccattacggtggtgcccgcgatgtggtcgccaaccggtgcgccacctgcggtggcttcttcgcctgccaccgctgccacgatgaactgaccgatcaccccttcgggcggatgagcaccgacgcccccgattcggtgctgtgtggtgcctgcggacacgtcatgggttaccacgtgtactcgcaggcatcggcgtgcccggcctgtgaccacctgttcaacccgggatgctccctacacgccccgctgtacttcgaggtgtag

SEQ ID NO: 7619 - protein, 105 aa, Corynebacterium efficiens YS-314
MSRMSEIQGVLIDARGRCAHYGGARDVVANRCATCGGFFACHRCHDELTDHPFGRMSTDAPDSVLCGACGHVMGYHVYSQASACPACDHLFNPGCSLHAPLYFEV

SEQ ID NO: 7620 - DNA, 315 bp, Lactobacillus plantarum WCFS1
  CDS (1)..(315): transl_table=11
atgactgagtgggtaccagtgatttacggcatcggtttagacgctgccggtcggtgccaacattatcaccttgaaactgatatcgcggcattgtggtgtcggcgatgtcaacactattacgcgtgttaccggtgccatgatacgttgtgccagcatacttttgtggccagcgctccgacggatttagccgtgatgtgtggtgcttgtcgttatcgaatgacggttgatcggtatcatgaggggcaatgcccgcactgtcaccggccatttaacccgcggtgtcggttgcatgaccaggtttactttgaaaagtaa

SEQ ID NO: 7621 - protein, 104 aa, Lactobacillus plantarum WCFS1
MTEWVPVIYGIGLDAAGRCQHYHLETDIAALWCRRCQHYYACYRCHDTLCQHTFVASAPTDLAVMCGACRYRMTVDRYHEGQCPHCHRPFNPRCRLHDQVYFEK

SEQ ID NO: 7622 - DNA, 306 bp, Lactococcus lactis subsp. lactis Il1403
  CDS (1)..(306): transl_table=11
ttgcgagaaaaaatctgggggaaagtgatagatgaggaaggcaggtgtactcattatcatcaagaaaatgatattgtcgccctaaaatgttcagactgtgaaaagtatttttcttgttatcattgtcacgatgaattagagaatcatttatttagggctactgataaagaagactttccagtactttgtggccattgtggaaaaaaattaaattttaatgattattcgcgaggagagtgtatcaagtgcagctccgcttttaatccaaattgtcatcgacattggcaagtttattttaatgaatag

SEQ ID NO: 7623 - protein, 101 aa, Lactococcus lactis subsp. lactis Il1403
MREKIWGKVIDEEGRCTHYHQENDIVALKCSDCEKYFSCYHCHDELENHLFRATDKEDFPVLCGHCGKKLNFNDYSRGECIKCSSAFNPNCHRHWQVYFNE

SEQ ID NO: 7624 - DNA, 354 bp, Debaryomyces hansenii CBS767
  CDS (1)..(354)
atgactatcttgaatgtaagcaatagcaagaaacctgttcacttgaaaggtcagttggtcgatactcaaaccagatgtagacactaccattcagcattggacattattgcaataaagttcaaatgctgtgatatttattttccctgttacaagtgccacctagagttggagagccatgatatcatacgatggaataagctagatcttaaggctgaaaaagttattctctgtggttcctgctccaatttactttactatcaagaatactcagccaatgataataagtgcttatattgcagcagtgatttcaatcctaactgcagtcttcactacggcttatactttgatatatga

SEQ ID NO: 7625 - protein, 117 aa, Debaryomyces hansenii CBS767
MTILNVSNSKKPVHLKGQLVDTQTRCRHYHSALDIIAIKFKCCDIYFPCYKCHLELESHDIIRWNKLDLKAEKVILCGSCSNLLYYQEYSANDNKCLYCSSDFNPNCSLHYGLYFDI

SEQ ID NO: 7626 - DNA, 339 bp, Candida albicans SC5314
  CDS (1)..(339): transl_table=12
atgacaaaatctgaatttcaaattcaaaaaatatctcccaacatatccctaataggacaattggtcgacaaccacacaagatgtactcattatcatactaaactagatatcattgctataaaattcaaatgttgtaacaattattatccatgctttaaatgccatcaagaatcaactaaccatgaaccagaccgattcgataaaaatgacaatacaaccaaggctgtactttgtggtaactgtgtgaatgaattaaccgttacagaatacctcaattgtggctatacatgtacttattgtggtggacaattcaaccctgggttgttccttacattatga

SEQ ID NO: 7627 - protein, 112 aa, Candida albicans SC5314
MTKSEFQIQKISPNISLIGQLVDNHTRCTHYHTKLDIIAIKFKCCNNYYPCFKCHQESTNHEPDRFDKNDNTTKAVLCGNCVNELTVTEYLNCGYTCTYCGGQFNPGLFLTL

SEQ ID NO: 7628 - DNA, 357 bp, Candida albicans SC5314
  CDS (1)..(357): transl_table=12
atgacaaaatctgaatctcaaattcaaaaaatatctcccaacatatccctaataggacaattggtcgacaaccacacaagatgtactcattatcatactaaactagatatcattgctataaaattcaaatgttgtaacaattattatccatgctttaaatgccatcaagaatcaactaaccatgaaccagaccgattcgataaaaatgacaatacaaccaaggctgtactttgtggtaactgtgtgaatgaattaaccgttacagaatacctcaattgtggctatacttgtacttattgtggtggacaattcaaccctggttgttctttacattatgaaatatatttcaacaattaa

SEQ ID NO: 7629 - protein, 118 aa, Candida albicans SC5314
MTKSESQIQKISPNISLIGQLVDNHTRCTHYHTKLDIIAIKFKCCNNYYPCFKCHQESTNHEPDRFDKNDNTTKAVLCGNCVNELTVTEYLNCGYTCTYCGGQFNPGCSLHYEIYFNN

SEQ ID NO: 7630 - DNA, 312 bp, Streptococcus pyogenes str. Manfredo
  CDS (1)..(312): transl_table=11
atgacggactgttttggaattgaccttgaccaagagtatcggtgcctacattatcataccccgcttgatattgttggtctcaaatgtgctttttgtcagacgtattatgcttgttaccattgccatgaccagttaacagatcatgcctttgtgccaacaggacatcaagaaacatctcctgttatttgtgggcattgtcgaaagctcttgagcctagctgagtatggttgtggatgctgtccttattgtcaaagtccctttaatccagcctgtcataggcacaaggatatctattttttaaaggagtcgtaa

SEQ ID NO: 7631 - protein, 103 aa, Streptococcus pyogenes str. Manfredo
MTDCFGIDLDQEYRCLHYHTPLDIVGLKCAFCQTYYACYHCHDQLTDHAFVPTGHQETSPVICGHCRKLLSLAEYGCGCCPYCQSPFNPACHRHKDIYFLKES

SEQ ID NO: 7632 - DNA, 354 bp, Leifsonia xyli subsp. xyli str. CTCB07
  CDS (1)..(354): transl_table=11
gtgagccggccgcgggtgctcggcccggtcgtggacgaggagacccgctgcgtccactaccgcaccccgctggacgtgatcgccatccggttcgcgtgctgcggcgagtactacccgtgccacctctgccacggcgagaccgccgggcaccctgcgcgaccctggccggccgccgagcgaggtgtacacgccatcctgtgcggggtctgcggggagacgctcaccatcgccggctacctcgagacggagagctgcccggtgtgcgcgacgccgttcaacccgggctgcaaagctcatgcaggactgtacttcgacgtccgaacggagtctgatggcgccaccgcacgctcataa

SEQ ID NO: 7633 - protein, 117 aa, Leifsonia xyli subsp. xyli str. CTCB07
MSRPRVLGPVVDEETRCVHYRTPLDVIAIRFACCGEYYPCHLCHGETAGHPARPWPAAERGVHAILCGVCGETLTIAGYLETESCPVCATPFNPGCKAHAGLYFDVRTESDGATARS

SEQ ID NO: 7634 - DNA, 315 bp, Bacillus clausii KSM-K16
  CDS (1)..(315): transl_table=11
ttgccaaccatacaggggtttccaattgacgatgagacacgctgtattcattaccagcaagaaatcgatgttgttgcgatccaatttgcttgctgtggccaattttatccgtgttataagtgtcatgctgagtcagtggggcatgagattaaaacgtggccaaagagtgagtttggcgcgaacgcgatatactgtggcaaatgccgaaaaacgatggcgattagtgactatcttgaaaaaggggaatgtacccattgtggcacacgctttaaccccggatgcgctagacactaccatatttattttgatgtgtga

SEQ ID NO: 7635 - protein, 104 aa, Bacillus clausii KSM-K16
MPTIQGFPIDDETRCIHYQQEIDVVAIQFACCGQFYPCYKCHAESVGHEIKTWPKSEFGANAIYCGKCRKTMAISDYLEKGECTHCGTRFNPGCARHYHIYFDV

SEQ ID NO: 7636 - DNA, 315 bp, Staphylococcus epidermidis RP62A
  CDS (1)..(315): transl_table=11
ttggcaaaggtttatggatcactcatagataatgaaacacgatgtacacattattattcatctttagatgttattgccattaaatttaaatgttgcaacaaatattatccgtgttataaatgtcataatgaacacgtatctcatacaattgaaagatgggctgaaaatgagtttgatgaaaaagctattatgtgtggtgtttgtaaacatgagatgcgtattcgtgactatatgatggtagaaatgtgtcctcgttgtaaagcgcattttaacagtcgttgtaaatttcattatcatttatattttgaagtataa

SEQ ID NO: 7637 - protein, 104 aa, Staphylococcus epidermidis RP62A
MAKVYGSLIDNETRCTHYYSSLDVIAIKFKCCNKYYPCYKCHNEHVSHTIERWAENEFDEKAIMCGVCKHEMRIRDYMMVEMCPRCKAHFNSRCKFHYHLYFEV

SEQ ID NO: 7638 - DNA, 294 bp, Corynebacterium glutamicum ATCC 13032
  CDS (1)..(294): transl_table=11
atgcgtggccatctcattgacggtgacggccgctgcatccactatcacggacccttcgacgtcgtcggcaacaaatgcgccacatgcaacgagtggtgggcgtgtcatcgctgccacgaggagattgccaatcatcctttcgggaagatgcttatcgacgccccgagctcccttcaatgcggccactgcggggagcttatggcctacggggtgcaaaaatgcccgcgatgcgggcataacttcaatccagggtgttcactccacactccgctgtactacgaaatgccctcttga

SEQ ID NO: 7639 - protein, 97 aa, Corynebacterium glutamicum ATCC 13032
MRGHLIDGDGRCIHYHGPFDVVGNKCATCNEWWACHRCHEEIANHPFGKMLIDAPSSLQCGHCGELMAYGVQKCPRCGHNFNPGCSLHTPLYYEMPS

SEQ ID NO: 7640 - DNA, 312 bp, Streptococcus agalactiae A909
  CDS (1)..(312): transl_table=11
atgatgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggagtaa

SEQ ID NO: 7641 - protein, 103 aa, Streptococcus agalactiae A909
MMQEYFGIGLDSSSRCYHYHTKLDIVALKCAVCQKYYACYKCHDALEEHCFAATKSDETFPVLCGSCRQMLTLKEYKTGFCPYCRMLFNPNCQRHDSIYFSKE

SEQ ID NO: 7642 - DNA, 306 bp, Leuconostoc mesenteroides subsp. mesenteroides ATCC 8293
  CDS (1)..(306): transl_table=11
gtgattaaaggaataaatttagatcaacaaggccgttgcaagcattggcatacggatgtcgatgtggtggctaatcgttgcgctaaatgtcgaaaatactatgcttgttacttatgtcatgatgcattaaatacgcatccattcgtgccagtttctctagatactgaagagacggccgtctactgtggcgtttgtttgcatcaaatgacacccgcacaatatctacatgctcactatcagtgtcccaagtgccatcatttgtttaacgcgcaatgtgcattgcacaaaaatacctatttctgctaa

SEQ ID NO: 7643 - protein, 101 aa, Leuconostoc mesenteroides subsp. mesenteroides ATCC 8293
MIKGINLDQQGRCKHWHTDVDVVANRCAKCRKYYACYLCHDALNTHPFVPVSLDTEETAVYCGVCLHQMTPAQYLHAHYQCPKCHHLFNAQCALHKNTYFC

SEQ ID NO: 7644 - DNA, 345 bp, Kluyveromyces lactis
  CDS (1)..(345)
atggaaaaagcacagatatatgggaaacttgtggataaagaaagtcggtgtgaacactggcacggtccactggacgttatagccctccggttcaaatgctgtaacggatactatgcatgttacgagtgtcaccaggaattggtaccgcacgtcacagaaaggtacaatataaacgacgaaactgtcccgttggtcatatgcggcgtatgcaaacttgaaatgtcgtttgctgcatacagtgattcgttgcaatgtccgaattgcagatcgcaattcaacccaggctgtaaattacattacgatatgtattttatgaaagatgatgaaccagaaaatctccgatag

SEQ ID NO: 7645 - protein, 114 aa, Kluyveromyces lactis
MEKAQIYGKLVDKESRCEHWHGPLDVIALRFKCCNGYYACYECHQELVPHVTERYNINDETVPLVICGVCKLEMSFAAYSDSLQCPNCRSQFNPGCKLHYDMYFMKDDEPENLR

SEQ ID NO: 7646 - DNA, 25 bp, Artificial sequence
  primer
atgatcgaaactgccatttatggta

SEQ ID NO: 7647 - DNA, 21 bp, Artificial sequence
  primer
tcaacacatagcggggggagg

SEQ ID NO: 7648 - protein, 101 aa, Artificial sequence
  consensus sequence
  Variant (2)..(4): Xaa in position 2 to 4 is any amino acid
  Variant (6)..(8): Xaa in position 6 to 8 is any amino acid
  Variant (11)..(11): Xaa in position 11 is any amino acid
  Variant (14)..(17): Xaa in position 14 to 17 is any amino acid
  Variant (19)..(26): Xaa in position 19 to 26 is any amino acid
  Variant (28)..(32): Xaa in position 28 to 32 is any amino acid
  Variant (34)..(35): Xaa in position 34 to 35 is any amino acid
  Variant (38)..(42): Xaa in position 38 to 42 is any amino acid
  Variant (44)..(56): Xaa in position 44 to 56 is any amino acid
  Variant (57)..(60): Xaa in position 57 to 60 is any or no amino acid
  Variant (63)..(63): Xaa in position 63 is any amino acid
  Variant (65)..(72): Xaa in position 65 to 72 is any amino acid
  Variant (74)..(74): Xaa in position 74 is any amino acid
  Variant (75)..(81): Xaa in position 75 to 81 is any or no amino acid
  Variant (83)..(84): Xaa in position 83 to 84 is any amino acid
  Variant (86)..(88): Xaa in position 86 to 88 is any amino acid
  Variant (92)..(92): Xaa in position 92 is any amino acid
  Variant (94)..(95): Xaa in position 94 to 95 is any amino acid
  Variant (97)..(97): Xaa in position 97 is any amino acid
  Variant (98)..(99): Xaa in position 98 to 99 is any or no amino acid
GXXXDXXXRCXHYXXXXDXXXXXXXXCXXXXXCXXCHXXXXXHXXXXXXXXXXXXXXXXXCGXCXXXXXXXXYXXXXXXXXCXXCXXXFNPXCXXHXXXYF

SEQ ID NO: 7649 - protein, 18 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any amino acid
  Variant (7)..(7): Xaa in position 7 is any or no amino acid
  Variant (9)..(9): Xaa in position 9 is Phe or Tyr
  Variant (10)..(10): Xaa in position 10 is any amino acid
  Variant (13)..(13): Xaa in position 13 is any amino acid
  Variant (14)..(14): Xaa in position 14 is Ala, Glu, Gln, Ser or Thr
  Variant (15)..(17): Xaa in position 15 to 17 is any amino acid
CXXXYXXCXXCHXXXXXH

SEQ ID NO: 7650 - protein, 20 aa, Artificial sequence
  protein pattern
  Variant (2)..(3): Xaa in position 2 to 3 is any amino acid
  Variant (5)..(7): Xaa in position 5 to 7 is any amino acid
  Variant (10)..(10): Xaa in position 10 is Glu, Asn, Pro or Ser
  Variant (11)..(11): Xaa in position 11 is any amino acid
  Variant (13)..(14): Xaa in position 13 to 14 is any amino acid
  Variant (16)..(18): Xaa in position 16 to 18 is any amino acid
CXXCXXXFNXXCXXHXXXYF

SEQ ID NO: 7651 - DNA, 1716 bp, Saccharomyces cerevisiae
  CDS (1)..(1716)
atgacggatgaaaaagtgaactcagatcagaatatgaacggtaagcagggagttaacttaatttcatccttgcctacaacacaagtgccggtttcaattttgaccaacaaggagagaagaaaaagtattcacgatgaatcaaatttcgaaagatctgatagtcatgaagatcaatcaaaatccaactctaataggaggaatatttacaaaaacgattatagcacaaatttgagggatttctcttttgccaatctgaagcaaaatagtgaaaggaacaaagatggccatgaaatacagatcaacaccagtatgccagctaatacaaatggccagcaaaaaaggttttcaccttcattaccttctgctgtttcatttacggtgcccgaggtggaaaggttgccgtatcatagatattcgatatccaataaacctggaaagcagcagcagcagcaggaacaactgcagcaaaatcaacaacaagaagagcagcaaaaggcacaactgcaggagcaaaatcaacgagcaaaacagcaagaagaggtgaagcaaattcaggagcaagtgcaaaaaaagcaaactgaaagacagcaactgatagacgaaaaggagaggatagcgaatgcaatatttaaggagaacactactaatgatggtactgatatcaggaaacattcggtatcgagtggtacgagcaatagcgaagatgaagtagattcaccttcgatggaaaaaaattctatcgttcatatgccaggtgattttatctacttcaatcccaagtcaaacgcttctaaacctatcactgcaaaggcggcgccattatcggctaataactccacacataaaaacaaggaagttatcactgcacccacagggcctcgtgtacccttcacagagttctttcagaaggaagacgacaagaaattccacattctcattggtgcgacgggctcagttgccacaataaaagtacctctaattattgataaacttttcaagatatatgggcctgagaaaatctctattcagttgattgtcacaaaacccgctgagcattttttgaaagggctcaaaatgtcaacacacgttaaaatttggagggaggaagacgcttgggtattcgacgctgtgaataagaatgatactagcttgagtctgaacttgatattgcaccatgaattaagaaaatgggctgatattttcctgattgcgcctttgtcagctaacacacttgctaaactggccaatggtatatgtaacaatttgctaacttctgtgatgagagattggtcaccactgaccccagtgttgattgcgcctgcaatgaatacattcatgtatatcaatcctatgacaaagaaacacctgacgagtttagtgcaagactatccgttcatccaagttttgaaaccggtggaaaaggtattaatatgcggagatattggtatgggtggtatgagagaatggacagatattgtagagatcgttaggaggagaatcaatgaaatacggaaagctagggacgaggaaactggtgataaagagcaagaacaagaagaacaagagggtgctgacaatgaggacgacgatgatgaggatgacgaagaggatgaggaggacgaggaggaggaagaagctctaaatgaaacagcatccgatgagagcaatgacgaggaagacgaagaggatgaggaagacgtgaaaaccgaagtttaa

SEQ ID NO: 7652 - protein, 571 aa, Saccharomyces cerevisiae
MTDEKVNSDQNMNGKQGVNLISSLPTTQVPVSILTNKERRKSIHDESNFERSDSHEDQSKSNSNRRNIYKNDYSTNLRDFSFANLKQNSERNKDGHEIQINTSMPANTNGQQKRFSPSLPSAVSFTVPEVERLPYHRYSISNKPGKQQQQQEQLQQNQQQEEQQKAQLQEQNQRAKQQEEVKQIQEQVQKKQTERQQLIDEKERIANAIFKENTTNDGTDIRKHSVSSGTSNSEDEVDSPSMEKNSIVHMPGDFIYFNPKSNASKPITAKAAPLSANNSTHKNKEVITAPTGPRVPFTEFFQKEDDKKFHILIGATGSVATIKVPLIIDKLFKIYGPEKISIQLIVTKPAEHFLKGLKMSTHVKIWREEDAWVFDAVNKNDTSLSLNLILHHELRKWADIFLIAPLSANTLAKLANGICNNLLTSVMRDWSPLTPVLIAPAMNTFMYINPMTKKHLTSLVQDYPFIQVLKPVEKVLICGDIGMGGMREWTDIVEIVRRRINEIRKARDEETGDKEQEQEEQEGADNEDDDDEDDEEDEEDEEEEEALNETASDESNDEEDEEDEEDVKTEV

SEQ ID NO: 7653 - DNA, 1635 bp, Candida glabrata CBS 138
  CDS (1)..(1635)
atggggtccgatgatgatagggatatgcgaaaggatgtgcagatggagcaagtgcctgtgtcgatactgaccaacaagttacatatatctggtactgggcctgtgcccgtgcgtgacctgcggtcttcagagaagaaagttggtggcggaatactgaatacaagcgcgaaggagaacagctcggtgccgatggacaacgagtttctcagtcagaacaagagtgtggatgggaacgggctggtgtctatgtcgtctggtgacgggagagtgatcggttctcggaatatatctttctcttcggggataatacagtttcccaacggtaacgatgacggcgcatcgatcatttcggatgctaacgggatcacagtggagcggaaagcttcgattacttcaccaaaatctactatatcattcacagttgatgaaaatgaaaagacatcccatcataggtattccatctctagcaagcccgggaagtccacgacatccatagacagtttagctattgagggtaagaacaacagtatagatgcaaaggattcggtaaaaggtaatacaaaggatgaagttgaggccgtgcccgaacagaaaaactctatagtgaatatgcctggtgacttcatattctttgagtctaggaagcatgaacataattctaacgagacagatggcaaagaaaagagcttgaaaagtaagaaaagtggcatttcaggtgctagcggttcaaaagaggttattggatccacttctggccctcaaattcccttttctgagtatttcctaagacaagatgataagaaatttcatatccttataggtgctactggatctgttgcaactataaaggtgcccttgattatagataagctgctcaaattatacacaccagataaaatttcgatacaactaattgtaaccaagccagctgaacatttcttgaatggtttaaagatttctacccatgtcaagatctggagagaagaggatgtgtggtcggattgcaaaaagatgggagatatgatactgcatcatgaacttaggaaatgggctgatatatttctgatagtcccattgtcagctaacagtctagcaaaaattgcaaacggtatcagcaataacttactaacagcagtactgagagattggtctcctaatacaccaatatacgcagcacctgcaatgaatactttcatgtatatcaatcccatgaccaaaaaacatctcaatatactagcatctgatatgccatatatcacagtcttgaagcctgtcgagaaagtcctaatttgcggcgatattggtatgggtggtatgagagaatggtccgatatagttgaaattgtaaggaagaagattaatgaaatcaaaaaagctagggatgaggatactacaacaccagaaaaagatgaagatgaagacgaggaggaggatgaagatgaagatgaagatgaagatgaggatgaggatgaggatgatagctttagaaagaatgagactgattcagaggatgatgatgacgatgacgaagaagaagaagatgatgatgatgacgacgaagatgatgaagatgggcataatgttgacaaagatagaatgatattaaaagaagaatctgaatccaaacctatatga

SEQ ID NO: 7654 - protein, 544 aa, Candida glabrata CBS 138
MGSDDDRDMRKDVQMEQVPVSILTNKLHISGTGPVPVRDLRSSEKKVGGGILNTSAKENSSVPMDNEFLSQNKSVDGNGLVSMSSGDGRVIGSRNISFSSGIIQFPNGNDDGASIISDANGITVERKASITSPKSTISFTVDENEKTSHHRYSISSKPGKSTTSIDSLAIEGKNNSIDAKDSVKGNTKDEVEAVPEQKNSIVNMPGDFIFFESRKHEHNSNETDGKEKSLKSKKSGISGASGSKEVIGSTSGPQIPFSEYFLRQDDKKFHILIGATGSVATIKVPLIIDKLLKLYTPDKISIQLIVTKPAEHFLNGLKISTHVKIWREEDVWSDCKKMGDMILHHELRKWADIFLIVPLSANSLAKIANGISNNLLTAVLRDWSPNTPIYAAPAMNTFMYINPMTKKHLNILASDMPYITVLKPVEKVLICGDIGMGGMREWSDIVEIVRKKINEIKKARDEDTTTPEKDEDEDEEEDEDEDEDEDEDEDEDDSFRKNETDSEDDDDDDEEEEDDDDDDEDDEDGHNVDKDRMILKEESESKPI

SEQ ID NO: 7655 - DNA, 25 bp, Artificial sequence
  primer
atgacggatgaaaaagtgaactcag

SEQ ID NO: 7656 - DNA, 25 bp, Artificial sequence
  primer
ttaaacttcggttttcacgtcttcc

SEQ ID NO: 7657 - protein, 580 aa, Artificial sequence
  consensus sequence
  Variant (2)..(16): Xaa in position 2 to 16 is any amino acid
  Variant (26)..(28): Xaa in position 26 to 28 is any amino acid
  Variant (29)..(31): Xaa in position 29 to 31 is any or no amino acid
  Variant (33)..(41): Xaa in position 33 to 41 is any amino acid
  Variant (43)..(48): Xaa in position 43 to 48 is any amino acid
  Variant (50)..(55): Xaa in position 50 to 55 is any amino acid
  Variant (57)..(62): Xaa in position 57 to 62 is any amino acid
  Variant (64)..(67): Xaa in position 64 to 67 is any amino acid
  Variant (69)..(70): Xaa in position 69 to 70 is any amino acid
  Variant (72)..(78): Xaa in position 72 to 78 is any amino acid
  Variant (79)..(82): Xaa in position 79 to 82 is any or no amino acid
  Variant (85)..(91): Xaa in position 85 to 91 is any amino acid
  Variant (93)..(98): Xaa in position 93 to 98 is any amino acid
  Variant (100)..(103): Xaa in position 100 to 103 is any amino acid
  Variant (104)..(112): Xaa in position 104 to 112 is any or no amino acid
  Variant (115)..(117): Xaa in position 115 to 117 is any amino acid
  Variant (118)..(128): Xaa in position 118 to 128 is any or no amino acid
  Variant (130)..(132): Xaa in position 130 to 132 is any amino acid
  Variant (134)..(153): Xaa in position 134 to 153 is any amino acid
  Variant (156)..(172): Xaa in position 156 to 172 is any amino acid
  Variant (173)..(178): Xaa in position 173 to 178 is any or no amino acid
  Variant (180)..(183): Xaa in position 180 to 183 is any amino acid
  Variant (185)..(197): Xaa in position 185 to 197 is any amino acid
  Variant (199)..(209): Xaa in position 199 to 209 is any amino acid
  Variant (211)..(217): Xaa in position 211 to 217 is any amino acid
  Variant (219)..(220): Xaa in position 219 to 220 is any amino acid
  Variant (222)..(223): Xaa in position 222 to 223 is any amino acid
  Variant (227)..(232): Xaa in position 227 to 232 is any amino acid
  Variant (238)..(238): Xaa in position 238 is any amino acid
  Variant (245)..(245): Xaa in position 245 is any amino acid
  Variant (247)..(252): Xaa in position 247 to 252 is any amino acid
  Variant (253)..(254): Xaa in position 253 to 254 is any or no amino acid
  Variant (256)..(260): Xaa in position 256 to 260 is any amino acid
  Variant (262)..(264): Xaa in position 262 to 264 is any amino acid
  Variant (266)..(269): Xaa in position 266 to 269 is any amino acid
  Variant (271)..(274): Xaa in position 271 to 274 is any amino acid
  Variant (275)..(278): Xaa in position 275 to 278 is any or no amino acid
  Variant (283)..(286): Xaa in position 283 to 286 is any amino acid
  Variant (289)..(290): Xaa in position 289 to 290 is any amino acid
  Variant (293)..(293): Xaa in position 293 is any amino acid
  Variant (295)..(295): Xaa in position 295 is any amino acid
  Variant (297)..(299): Xaa in position 297 to 299 is any amino acid
  Variant (327)..(327): Xaa in position 327 is any amino acid
  Variant (329)..(329): Xaa in position 329 is any amino acid
  Variant (331)..(331): Xaa in position 331 is any amino acid
  Variant (333)..(333): Xaa in position 333 is any amino acid
  Variant (350)..(350): Xaa in position 350 is any amino acid
  Variant (354)..(354): Xaa in position 354 is any amino acid
  Variant (366)..(366): Xaa in position 366 is any amino acid
  Variant (368)..(368): Xaa in position 368 is any amino acid
  Variant (369)..(375): Xaa in position 369 to 375 is any or no amino acid
  Variant (377)..(383): Xaa in position 377 to 383 is any amino acid
  Variant (399)..(399): Xaa in position 399 is any amino acid
  Variant (405)..(405): Xaa in position 405 is any amino acid
  Variant (409)..(409): Xaa in position 409 is any amino acid
  Variant (414)..(414): Xaa in position 414 is any amino acid
  Variant (420)..(420): Xaa in position 420 is any amino acid
  Variant (422)..(422): Xaa in position 422 is any amino acid
  Variant (428)..(428): Xaa in position 428 is any amino acid
  Variant (431)..(433): Xaa in position 431 to 433 is any amino acid
  Variant (452)..(453): Xaa in position 452 to 453 is any amino acid
  Variant (455)..(456): Xaa in position 455 to 456 is any amino acid
  Variant (458)..(458): Xaa in position 458 is any amino acid
  Variant (460)..(460): Xaa in position 460 is any amino acid
  Variant (462)..(462): Xaa in position 462 is any amino acid
  Variant (485)..(485): Xaa in position 485 is any amino acid
  Variant (493)..(494): Xaa in position 493 to 494 is any amino acid
  Variant (499)..(499): Xaa in position 499 is any amino acid
  Variant (505)..(505): Xaa in position 505 is any amino acid
  Variant (507)..(509): Xaa in position 507 to 509 is any amino acid
  Variant (511)..(514): Xaa in position 511 to 514 is any amino acid
  Variant (516)..(516): Xaa in position 516 is any amino acid
  Variant (518)..(519): Xaa in position 518 to 519 is any amino acid
  Variant (521)..(523): Xaa in position 521 to 523 is any amino acid
  Variant (525)..(525): Xaa in position 525 is any amino acid
  Variant (529)..(530): Xaa in position 529 to 530 is any amino acid
  Variant (534)..(534): Xaa in position 534 is any amino acid
  Variant (536)..(540): Xaa in position 536 to 540 is any amino acid
  Variant (542)..(544): Xaa in position 542 to 544 is any amino acid
  Variant (546)..(553): Xaa in position 546 to 553 is any amino acid
  Variant (555)..(556): Xaa in position 555 to 556 is any amino acid
  Variant (558)..(559): Xaa in position 558 to 559 is any amino acid
  Variant (561)..(561): Xaa in position 561 is any amino acid
  Variant (564)..(564): Xaa in position 564 is any amino acid
  Variant (567)..(567): Xaa in position 567 is any amino acid
  Variant (568)..(577): Xaa in position 568 to 577 is any or no amino acid
  Variant (579)..(579): Xaa in position 579 is any amino acid
MXXXXXXXXXXXXXXXQVPVSILTNXXXXXXIXXXXXXXXXDXXXXXXKXXXXXXNXXXXXXSXXXXDXXFXXXXXXXXXXXDGXXXXXXXSXXXXXXGXXXXXXXXXXXXXSFXXXXXXXXXXXXXXIXXXPXXXXXXXXXXXXXXXXXXXXKAXXXXXXXXXXXXXXXXXXXXXXXKXXXXRXXXXXXXXXXXXXIXXXXXXXXXXXIXXXXXXXGXXNXXDEVXXXXXXKNSIVXMPGDFIXFXXXXXXXXSXXXXXKXXXLXXXXSXXXXXXXXKEVIXXXXGPXXPFXEXFXXXDDKKFHILIGATGSVATIKVPLIIDKLXKXYXPXKISIQLIVTKPAEHFLXGLKXSTHVKIWREEDXWXXXXXXXXDXXXXXXXILHHELRKWADIFLIXPLSANXLAKXANGIXNNLLTXVXRDWSPXTPXXXAPAMNTFMYINPMTKKHLXXLXXDXPXIXVLKPVEKVLICGDIGMGGMREWXDIVEIVRXXINEIXKARDEXTXXXEXXXXEXEXXDXXXDXDEDXXEDEXDXXXXXEXXXEXXXXXXXXEXXDXXDXEDXEDXXXXXXXXXXXKXE

SEQ ID NO: 7658 - protein, 60 aa, Artificial sequence
  protein pattern
  Variant (4)..(4): Xaa in position 4 is any amino acid
  Variant (7)..(7): Xaa in position 7 is Ile or Val
  Variant (8)..(8): Xaa in position 8 is any amino acid
  Variant (9)..(9): Xaa in position 9 is Ala or Ile
  Variant (28)..(28): Xaa in position 28 is Asn or Thr
  Variant (29)..(29): Xaa in position 29 is any amino acid
  Variant (31)..(31): Xaa in position 31 is Ala or Val
  Variant (32)..(32): Xaa in position 32 is Gln or Ser
  Variant (34)..(34): Xaa in position 34 is any amino acid
  Variant (36)..(36): Xaa in position 36 is Phe or Tyr
  Variant (38)..(38): Xaa in position 38 is Gln or Thr
WSPXTPXXXAPAMNTFMYINPMTKKHLXXLXXDXPXIXVLKPVEKVLICGDIGMGGMREW

SEQ ID NO: 7659 - protein, 60 aa, Artificial sequence
  protein pattern
  Variant (25)..(25): Xaa in position 25 is Phe or Leu
  Variant (27)..(27): Xaa in position 27 is Ile or Leu
  Variant (29)..(29): Xaa in position 29 is Gly or Thr
  Variant (31)..(31): Xaa in position 31 is Asp or Glu
  Variant (48)..(48): Xaa in position 48 is any amino acid
  Variant (52)..(52): Xaa in position 52 is Ile or Met
KFHILIGATGSVATIKVPLIIDKLXKXYXPXKISIQLIVTKPAEHFLXGLKXSTHVKIWR

SEQ ID NO: 7660 - protein, 40 aa, Artificial sequence
  protein pattern
  Variant (2)..(2): Xaa in position 2 is any amino acid
  Variant (16)..(16): Xaa in position 16 is Ala or Val
  Variant (22)..(22): Xaa in position 22 is Ser or Thr
  Variant (26)..(26): Xaa in position 26 is Ile or Leu
  Variant (31)..(31): Xaa in position 31 is Cys or Ser
  Variant (37)..(37): Xaa in position 37 is Ala or Ser
  Variant (39)..(39): Xaa in position 39 is Leu or Met
IXHHELRKWADIFLIXPLSANXLAKXANGIXNNLLTXVXR

SEQ ID NO: 7661 - DNA, 1764 bp, Saccharomyces cerevisiae
  CDS (1)..(1764)
atggacaagtatttgaattcatttgttgaccacctttcagagtggtcatctcgtgcctttaggaacaattcatcaagcgctaaccaaagtgcgtcgaacaaggaattagaacaagtttttgaacagatcaatgctatagttgaaaaccacaataacaaattaaccactgcctttgataagatatcatatcgcgttgctcacaagattacacacttggtggaaagccattctttagtattcaactacgccactttagttctcatcgcaagtgctttggtcgttattggctcatttacgtctatttcttctattccatttacagctctacctcctacgagagaacactcattgtttgatcctacagattttgatgtggaccacgactgtcatgttatctaccgcgagaatgacgaagataaaaagaaaaagaagaaaagcaagaggtttttcgatatgatggatgaaaaacatgcgattatactgcccttaactagtggctgtactttactcgctctctattttgtgatcaagaaactacacctaaactggctaaaatatgtggtgaaaattttgaattttaatataacactgctaaatatcccagctggcacatttgtctactcctactttctcaactcacttttcagaaacctatcacatttagcttcttggaatcccctggttgttttaccaaggtatcgtgtaacaatagctgatgataacgaagacctgaacaagataggcgggtttgttaccaatttgaattacaaagatggattgaccaactcagttgttcacaagaaaacattggatgagattgaaaaagatcattggatgaagcatttttacagaagagaattagttgaaccgaaggatattaaatcgaagaggcagatcagcaacatgtatttgaatagcgcattaattgtttcgttcgttctgtccatcgtttctaccgtatatttctatttatcacccaatgattggttaatatccaatgctgtcagtatgaatatggctatttggtccattgctcaattaaaattgaagaatttaaaatcaggggccctaatcctaattgctctatttttttacgacatttgctttgtctttggtaccgatgtaatggttacagtagctactaaccttgatattcccgtaaaactaagcttaccagtcaagtttaatacagctcaaaacaacttcaatttttcaatacttggtctgggtgatattgccttgcctggtatgtttattgcgatgtgctacaaatatgacatctggaagtggcaccttgatcatgatgacactgaattccactttttgaactggtcatacgttggaaaatattttattactgctatggttagttacgttgcttctttggtatctgccatggtctccttgtccattttcaatactgctcaaccggctttattatacattgttccttccttgttgattagtactattttggtagcttgctggaacaaggattttaagcagttttggaattttcagtatgatacgattgaagtggataaaagtttaaaaaaagcgatagaaaaaaaggagaactctataacttattcgaccttcatcctatcagaatactataatgatgccgacaagtatgccttgcttggtgatgatgtaaacgaaaattttgacgatgatgaagaattcgtgcaagaggaagatctcagtgacagctctgaggaagagctttctgaagaagatctcttggatgacgaatcttcttga

SEQ ID NO: 7662 - protein, 587 aa, Saccharomyces cerevisiae
MDKYLNSFVDHLSEWSSRAFRNNSSSANQSASNKELEQVFEQINAIVENHNNKLTTAFDKISYRVAHKITHLVESHSLVFNYATLVLIASALVVIGSFTSISSIPFTALPPTREHSLFDPTDFDVDHDCHVIYRENDEDKKKKKKSKRFFDMMDEKHAIILPLTSGCTLLALYFVIKKLHLNWLKYVVKILNFNITLLNIPAGTFVYSYFLNSLFRNLSHLASWNPLVVLPRYRVTIADDNEDLNKIGGFVTNLNYKDGLTNSVVHKKTLDEIEKDHWMKHFYRRELVEPKDIKSKRQISNMYLNSALIVSFVLSIVSTVYFYLSPNDWLISNAVSMNMAIWSIAQLKLKNLKSGALILIALFFYDICFVFGTDVMVTVATNLDIPVKLSLPVKFNTAQNNFNFSILGLGDIALPGMFIAMCYKYDIWKWHLDHDDTEFHFLNWSYVGKYFITAMVSYVASLVSAMVSLSIFNTAQPALLYIVPSLLISTILVACWNKDFKQFWNFQYDTIEVDKSLKKAIEKKENSITYSTFILSEYYNDADKYALLGDDVNENFDDDEEFVQEEDLSDSSEEELSEEDLLDDESS

SEQ ID NO: 7663 - DNA, 1701 bp, Gibberella zeae PH-1
  CDS (1)..(1701)
atggccgaaaacgctacagatacggcgactctcgaggggtcttttgatgccttgaactctaccataggatctggagagagctggctatcagctttctcatacctccaagatcaaagctttctcatgcttgagatcagacttgttctcagcgccatcggcatcatctatctcggcgcccacgctgctcttcgtcgacctccctccgcggcacctgcaaagaagaagaatttaggtgaagaggaagacgaggagcgtttttctcagggattggagccatcagatgccatcatctttcccctcatggccggtgttgtcctcgttggcttgtactacctcatccagtggctaaaggaccccgacattctcaacaaaattctgagatggtacatgtctaccatgtcgattgctagcttggtgtctatctattctcatggaatcgaagtggttacgagcttagtgttcccacgatactggcggggacgagatggacgtctaagggcagtggaccagacgaatagatctgtccacgtctgtgacgatgcaggcaacccgacgacaaatgtttcgacaacagacaaccctttccccggacctttttcctgtctggcgttctcagacaaaattcgccagtcaggatgggagttgcgcggtcttctcactagacattgggccgtcaagctcttcatccatggcatgggcaaagagcaaggtagaatcaagtttgctcatgtggtgtccttggtcatggctttggctaccgcgctcatctactcttacactacatcgcctctgttggccaacacactcggctacgccatgtgctacggctcactgcttctgatctccccaacggactttttgactagcaccctgattcttgtcggtctgttcttttacgatattataatggtattttacaccccatatatggtcacagtcgcaaccaagctggatgtgcccatcaagctcactttccaggctgcggagcgcaagagtattcttggtctgggtgatatcgtcattccaggcatggttatggctctagccctccgattcgacctctggctccattacgagagcaagatcaagtacgaaagcaccgacttgaagctcattgagaaggacccatcctcaggagcttttgtcactagaagcgagacgaaacacaaggaagtcaaggccaagtatgtcaacgtcaagggtaactggggagacaacctttggactcgcggagctttcttcctctttggatctaagcaggtgccccaagacctggcggccacacgtttccgcaagacctatttctatgcttcagtcgctggctatcttctcggaatgtgtgttaccttggctatgcttttggtgttcaagcgcggccagcctgcactcctgtatcttgttcctggcgtgttgggttcgctgtggctgacaggtctggtccgtggagaaatcaagcagatgtggaagtacactgaggacggaagcctcgatattatcgatgtggttgtcgacttggatggtgatggtaatgctgtcaagagaatcggcaagctcgaggatggcgttgtcgaccttaccaaggacgacaagaaggagaaggaggaagacaagacaaaggaagagaagaaaggcgatggaaaggaaaagcaccgtgtcttcatgctctcagtcgatgccgaggaggagaccaattcggagtag

SEQ ID NO: 7664 - protein, 566 aa, Gibberella zeae PH-1
MAENATDTATLEGSFDALNSTIGSGESWLSAFSYLQDQSFLMLEIRLVLSAIGIIYLGAHAALRRPPSAAPAKKKNLGEEEDEERFSQGLEPSDAIIFPLMAGVVLVGLYYLIQWLKDPDILNKILRWYMSTMSIASLVSIYSHGIEVVTSLVFPRYWRGRDGRLRAVDQTNRSVHVCDDAGNPTTNVSTTDNPFPGPFSCLAFSDKIRQSGWELRGLLTRHWAVKLFIHGMGKEQGRIKFAHVVSLVMALATALIYSYTTSPLLANTLGYAMCYGSLLLISPTDFLTSTLILVGLFFYDIIMVFYTPYMVTVATKLDVPIKLTFQAAERKSILGLGDIVIPGMVMALALRFDLWLHYESKIKYESTDLKLIEKDPSSGAFVTRSETKHKEVKAKYVNVKGNWGDNLWTRGAFFLFGSKQVPQDLAATRFRKTYFYASVAGYLLGMCVTLAMLLVFKRGQPALLYLVPGVLGSLWLTGLVRGEIKQMWKYTEDGSLDIIDVVVDLDGDGNAVKRIGKLEDGVVDLTKDDKKEKEEDKTKEEKKGDGKEKHRVFMLSVDAEEETNSE

SEQ ID NO: 7665 - DNA, 1698 bp, Candida glabrata CBS 138
  CDS (1)..(1698)
atgtcgtctccttttagggctgctgcagaacaggtattagccaaatttttaagtcctcatagtaatgaaactaccacagtggactccgaattggtagatgtgttcaataaagtgaacacattcatgtcaactaaccagtctcaacttaataaagtgtttgatagatgggtcgatagaacaacattctcatttactcaacttatatcaacccatccttcgctatatgcttgcgttggtatgctggcctttgcgcttactgttgtaacattagggtctttcacctcaatcaaatcaattccacatactgccttgccaccaacaaagtatgatcctttgttcgaccccactgattttgatttggatactgaaagtataattgttcataaaaatgaaactgatgcccagaagaagaaagatggccataaattagctaactacgacaaaattgacgtaagacattctttattaatccctctgagttgcggtgctgttttgatgacattgtatttttttattaagaggttgcaggtcagatggctttccatcatagttaagggcttgacttatcagtccatactttcccacactttcgctgctacttttgtttacaactatttgatacaaagtttcattagaaacttgtcatacttgtttaaatttaatccgttaaagattttacccagatgccgtctaacagtgtcagacgataatgttgaaattcatcaaacaggagccgttagcaatctttgctataagaatcaaatatctggtaaaatccaggaggctaaaagagttgagaagattaagaagacatcatgggaaagccacatgtacagacgtgaacttaaagcaccatcttccgttaaatctgattcacaaattctcaatgtttatatgtcagatgccacaatttattcgtttatttttgcatgtattatatctgcgctctatttttggtttccaaggaattggatgttgacaaatattgttagcttgaatctttcagtatggacaatttctcaactaaaccttaagaatttgaagtctggaacaatgattctactagtgttgttcttctatgacatttacttcgtgttttacaatgacgtgatggttactgtagccacccaattggagttaccatttaaactttcaattccagtcaaattcaatcctgccagtaaaaagtttgatttttcattccttgggcttggcgatatgatcatccctggcatgtttattgcaatgtgttataagtttgatatctggaaatggcatctaaaaaatgtcgaccgtgaatttcatctcttgaattgggggtacatcggcacatatttcaaagttgccttgatatcttatgcattgtctatggttacctgtatgctttgcttaaacatattcaatgttgcacaacctgcattactttacatcgtcccatttttgttaatatcgataagtgtcgtagctaaattcaacaatgattttaaggatatgtggaatttacaatttgatgtcattgagatagatgatgaaaaactaagttctggtcgtttggagaaggaggaccaactgacctactctgaattattagaatccgattatattgaagattctgacacagatgttaattctgacttcacacctgaatcagatgacgatttgagcttatctgatgatgatgacgaggcggaagattag

SEQ ID NO: 7666 - protein, 565 aa, Candida glabrata CBS 138
MSSPFRAAAEQVLAKFLSPHSNETTTVDSELVDVFNKVNTFMSTNQSQLNKVFDRWVDRTTFSFTQLISTHPSLYACVGMLAFALTVVTLGSFTSIKSIPHTALPPTKYDPLFDPTDFDLDTESIIVHKNETDAQKKKDGHKLANYDKIDVRHSLLIPLSCGAVLMTLYFFIKRLQVRWLSIIVKGLTYQSILSHTFAATFVYNYLIQSFIRNLSYLFKFNPLKILPRCRLTVSDDNVEIHQTGAVSNLCYKNQISGKIQEAKRVEKIKKTSWESHMYRRELKAPSSVKSDSQILNVYMSDATIYSFIFACIISALYFWFPRNWMLTNIVSLNLSVWTISQLNLKNLKSGTMILLVLFFYDIYFVFYNDVMVTVATQLELPFKLSIPVKFNPASKKFDFSFLGLGDMIIPGMFIAMCYKFDIWKWHLKNVDREFHLLNWGYIGTYFKVALISYALSMVTCMLCLNIFNVAQPALLYIVPFLLISISVVAKFNNDFKDMWNLQFDVIEIDDEKLSSGRLEKEDQLTYSELLESDYIEDSDTDVNSDFTPESDDDLSLSDDDDEAED

SEQ ID NO: 7667 - DNA, 1749 bp, Debaryomyces hansenii CBS767
  CDS (1)..(1749)
atgaactatacagacgtcaatactactacgcttcatttcgatcaattaaatttgattgataaactatctattcttgcaccttataaactctataacccaagcaacttcattaatagtcagatcaattatgaaataatctccttcgtgttacttattagcattgcattgagctgcgtggtaatgggagcatatacgacaatcagtaagcctgtgaatgcacttgatcccaacgaagatatgcaagccaaatgggatggtacagacaatgacaattgtaattattacaagtcaacgaatagtgaccttgagatgctcaatattgagtctattggatggaaacatgccttaagcttgcctttgataggctccgttgtattgtacggcttatactacggtttaacgcattttgacaaggatagccttatggttggcttaaactggtacattttaggaatgagcttatttccaaactatcttacgtatcattacttgttgactgtctttacaagaagaattcagaattgtttcaaccttcaacctattttccataggtacagattgacattatcgaaggacgtggacaattttccattgggtgtggttgaacctatcgacaagaccaaattcaaaaaggtgttgcgtcatttgagaaaggttggagtgaaggttatcaaaccaaatttaattaagacagaaaaccaacttattaattgcttttttgatttaaaatttttactcattcttcccgtcagtatatttgtcagttatgggttctatagattcaacccaatcttaaattctcagtacccattaaatcaaaccaattggatgatctctgatattttaggtatcaactttgctgtgtttggaataaatcatacaaggatctctagttttagagttgcatttatattgttagttgggttgttcttctacgatatttactttgtttttggtacaaaagtcatggttactgttgctactggtttagatatcccgatcaaaattcttattccacgcagccccgctatttatgccagcaatgtgtttgttgacttgtacgaagtattaactgactctcgtcattgggataccccaatgtctatacttggacttggggatatcgtcatcccaggtgcgttcgtcgcattatgtctcagatacgacttattcaagcatcacgaagctaatggaaagtcatttcaccatttacagagctaccctaagccatactttgttgtcagcattatttcatatttcattggattattattgaccgtttcagtcttgtatgtgtaccaggtaggtcagcctgccttgttgtacatagtgccatgcttgattttaggtgtttccttattgagcttaatcagaggtgaatttggccaaatcttcaactacagcgaagatatcgaagaacctaccaaagaagaatcaggggatcaggactcagatcaggacccggaagatgaagacagcgaatactccattggcgacgattcagaatgggaaagattagtggaagaaaaaatggagatcgacgaagatttcgaggaaactgatttagacgaaatagacctcttgattgcagaccagtcaaacccagtccatgttcccataacatatgagttcgagtctgaagacgacgacgatactttcattatcgtctccgacgagtcatctgactccgaagaagaagaatctagtgacgaagacgatgcgtccgtcagccaatctgacgaagaataa

SEQ ID NO: 7668 - protein, 582 aa, Debaryomyces hansenii CBS767
MNYTDVNTTTLHFDQLNLIDKLSILAPYKLYNPSNFINSQINYEIISFVLLISIALSCVVMGAYTTISKPVNALDPNEDMQAKWDGTDNDNCNYYKSTNSDLEMLNIESIGWKHALSLPLIGSVVLYGLYYGLTHFDKDSLMVGLNWYILGMSLFPNYLTYHYLLTVFTRRIQNCFNLQPIFHRYRLTLSKDVDNFPLGVVEPIDKTKFKKVLRHLRKVGVKVIKPNLIKTENQLINCFFDLKFLLILPVSIFVSYGFYRFNPILNSQYPLNQTNWMISDILGINFAVFGINHTRISSFRVAFILLVGLFFYDIYFVFGTKVMVTVATGLDIPIKILIPRSPAIYASNVFVDLYEVLTDSRHWDTPMSILGLGDIVIPGAFVALCLRYDLFKHHEANGKSFHHLQSYPKPYFVVSIISYFIGLLLTVSVLYVYQVGQPALLYIVPCLILGVSLLSLIRGEFGQIFNYSEDIEEPTKEESGDQDSDQDPEDEDSEYSIGDDSEWERLVEEKMEIDEDFEETDLDEIDLLIADQSNPVHVPITYEFESEDDDDTFIIVSDESSDSEEEESSDEDDASVSQSDEE

SEQ ID NO: 7669 - DNA, 27 bp, Artificial sequence
  primer
atggacaagtatttgaattcatttgtt

SEQ ID NO: 7670 - DNA, 25 bp, Artificial sequence
  primer
tcaagaagattcgtcatccaagaga

SEQ ID NO: 7671 - protein, 495 aa, Artificial sequence
  consensus sequence
  Variant (2)..(7): Xaa in position 2 to 7 is any amino acid
  Variant (9)..(48): Xaa in position 9 to 48 is any amino acid
  Variant (49)..(74): Xaa in position 49 to 74 is any or no amino acid
  Variant (77)..(81): Xaa in position 77 to 81 is any amino acid
  Variant (83)..(84): Xaa in position 83 to 84 is any amino acid
  Variant (87)..(100): Xaa in position 87 to 100 is any amino acid
  Variant (101)..(103): Xaa in position 101 to 103 is any or no amino acid
  Variant (105)..(119): Xaa in position 105 to 119 is any amino acid
  Variant (121)..(146): Xaa in position 121 to 146 is any amino acid
  Variant (147)..(148): Xaa in position 147 to 148 is any or no amino acid
  Variant (150)..(266): Xaa in position 150 to 266 is any amino acid
  Variant (267)..(271): Xaa in position 267 to 271 is any or no amino acid
  Variant (273)..(274): Xaa in position 273 to 274 is any amino acid
  Variant (281)..(282): Xaa in position 281 to 282 is any amino acid
  Variant (285)..(288): Xaa in position 285 to 288 is any amino acid
  Variant (295)..(295): Xaa in position 295 is any amino acid
  Variant (297)..(298): Xaa in position 297 to 298 is any amino acid
  Variant (300)..(300): Xaa in position 300 is any amino acid
  Variant (302)..(310): Xaa in position 302 to 310 is any amino acid
  Variant (311)..(333): Xaa in position 311 to 333 is any or no amino acid
  Variant (335)..(335): Xaa in position 335 is any amino acid
  Variant (341)..(343): Xaa in position 341 to 343 is any amino acid
  Variant (346)..(348): Xaa in position 346 to 348 is any amino acid
  Variant (350)..(354): Xaa in position 350 to 354 is any amino acid
  Variant (356)..(376): Xaa in position 356 to 376 is any amino acid
  Variant (377)..(435): Xaa in position 377 to 435 is any or no amino acid
  Variant (438)..(443): Xaa in position 438 to 443 is any amino acid
  Variant (445)..(454): Xaa in position 445 to 454 is any amino acid
  Variant (456)..(461): Xaa in position 456 to 461 is any amino acid
  Variant (468)..(468): Xaa in position 468 is any amino acid
  Variant (471)..(494): Xaa in position 471 to 494 is any amino acid
AXXXXXXGXXXXXXXXXXXXXXXXXXXXXXXXXXXXXXXXXXXXXXXXXXXXXXXXXXXXXXXXXXXXXXXXXXPLXXXXXLXXLYXXXXXXXXXXXXXXXXXLXXXXXXXXXXXXXXXYXXXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXLFFYDIXXVFXXXXMVTVATXLXXPXKXXXXXXXXXXXXXXXXXXXXXXXXXXXXXXXXSXLGLGDXXXPGXXXAXXXXXDXXXXXXXXXXXXXXXXXXXXXXXXXXXXXXXXXXXXXXXXXXXXXXXXXXXXXXXXXXXXXXXXXXXXXXXXXXXXXXXXYFXXXXXXYXXXXXXXXXXLXXXXXXQPALLYXVPXXXXXXXXXXXXXXXXXXXXXXXXD

SEQ ID NO: 7672 - protein, 28 aa, Artificial sequence
  protein pattern
  Variant (2)..(2): Xaa in position 2 is Phe or Ile
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (14)..(14): Xaa in position 14 is any amino acid
  Variant (15)..(15): Xaa in position 15 is Phe or Val
  Variant (16)..(16): Xaa in position 16 is Ile, Met or Val
  Variant (18)..(18): Xaa in position 18 is Leu or Met
  Variant (19)..(19): Xaa in position 19 is Ala or Cys
  Variant (20)..(20): Xaa in position 20 is any amino acid
  Variant (21)..(21): Xaa in position 21 is Lys or Arg
  Variant (22)..(22): Xaa in position 22 is Phe or Tyr
  Variant (24)..(26): Xaa in position 24 to 26 is any amino acid
  Variant (27)..(27): Xaa in position 27 is any or no amino acid
SXLGLGDXIXXPGXXXAXXXXXDXXXXH

SEQ ID NO: 7673 - protein, 56 aa, Artificial sequence
  protein pattern
  Variant (2)..(3): Xaa in position 2 to 3 is any amino acid
  Variant (4)..(4): Xaa in position 4 is Gly, Ile or Val
  Variant (5)..(5): Xaa in position 5 is Phe, Trp or Tyr
  Variant (6)..(6): Xaa in position 6 is Ala, Gly, Ser or Thr
  Variant (7)..(7): Xaa in position 7 is Ile or Met
  Variant (8)..(8): Xaa in position 8 is Ala, Cys, Asn or Ser
  Variant (9)..(11): Xaa in position 9 to 11 is any amino acid
  Variant (12)..(12): Xaa in position 12 is Ile or Leu
  Variant (13)..(14): Xaa in position 13 to 14 is any amino acid
  Variant (15)..(15): Xaa in position 15 is Phe, Ile or Leu
  Variant (16)..(17): Xaa in position 16 to 17 is any amino acid
  Variant (18)..(18): Xaa in position 18 is Ala, Gly or Thr
  Variant (19)..(19): Xaa in position 19 is any amino acid
  Variant (20)..(20): Xaa in position 20 is Phe, Ile, Leu or Met
  Variant (21)..(21): Xaa in position 21 is Ile or Leu
  Variant (22)..(23): Xaa in position 22 to 23 is any amino acid
  Variant (24)..(24): Xaa in position 24 is Ala, Gly, Thr or Val
  Variant (26)..(30): Xaa in position 26 to 30 is any or no amino acid
  Variant (36)..(36): Xaa in position 36 is any amino acid
  Variant (37)..(37): Xaa in position 37 is Phe or Met
  Variant (40)..(40): Xaa in position 40 is any amino acid
  Variant (41)..(41): Xaa in position 41 is Asn or Thr
  Variant (42)..(43): Xaa in position 42 to 43 is any amino acid
  Variant (50)..(50): Xaa in position 50 is any amino acid
  Variant (52)..(52): Xaa in position 52 is Asp or Glu
  Variant (53)..(53): Xaa in position 53 is Ile, Leu or Val
  Variant (55)..(55): Xaa in position 55 is Phe, Ile or Val
NXXXXXXXXXXXXXXXXXXXXXXXLXXXXXFFYDIXXVFXXXXMVTVATXLXXPXK

SEQ ID NO: 7674 - protein, 59 aa, Artificial sequence
  protein pattern
  Variant (3)..(3): Xaa in position 3 is any amino acid
  Variant (4)..(4): Xaa in position 4 is Ala, Thr or Val
  Variant (5)..(5): Xaa in position 5 is Ala or Ser
  Variant (6)..(6): Xaa in position 6 is Ile, Leu, Met or Val
  Variant (7)..(7): Xaa in position 7 is Ala, Ile or Val
  Variant (8)..(8): Xaa in position 8 is Gly or Ser
  Variant (10)..(10): Xaa in position 10 is any amino acid
  Variant (11)..(11): Xaa in position 11 is Ala, Ile or Leu
  Variant (12)..(12): Xaa in position 12 is Gly or Ser
  Variant (13)..(13): Xaa in position 13 is Leu or Met
  Variant (14)..(15): Xaa in position 14 to 15 is any amino acid
  Variant (16)..(16): Xaa in position 16 is Ala, Cys or Thr
  Variant (17)..(17): Xaa in position 17 is Leu, Met or Val
  Variant (18)..(19): Xaa in position 18 to 19 is any amino acid
  Variant (21)..(21): Xaa in position 21 is any amino acid
  Variant (22)..(22): Xaa in position 22 is Ile or Val
  Variant (23)..(23): Xaa in position 23 is Phe or Tyr
  Variant (24)..(25): Xaa in position 24 to 25 is any amino acid
  Variant (26)..(26): Xaa in position 26 is Ala or Gly
  Variant (33)..(33): Xaa in position 33 is Ile or Leu
  Variant (36)..(36): Xaa in position 36 is any amino acid
  Variant (37)..(37): Xaa in position 37 is any or no amino acid
  Variant (39)..(39): Xaa in position 39 is Gly, Ile or Leu
  Variant (40)..(44): Xaa in position 40 to 44 is any amino acid
  Variant (45)..(45): Xaa in position 45 is Ala, Gly, Leu or Val
  Variant (46)..(58): Xaa in position 46 to 58 is any amino acid
  Variant (59)..(59): Xaa in position 59 is Glu, Gln or Ser
YFXXXXXXYXXXXXXXXXXLXXXXXXQPALLYXVPXXLXXXXXXXXXXXXXXXXXXXXX

SEQ ID NO: 7675 - DNA, 522 bp, Saccharomyces cerevisiae
  CDS (1)..(522)
atgcaccattggcaatttttcttagcgaagtatacgagagctacgcttgttagcagttcgaggttgttgcactgtaatttcaaagaactatctgcttctataagttccttctcgatcctagaatactctatcaaggaaatggcttcattattaatgctaatatcctcttctttggcgtttagcaaggaagatgtagtatacctaccaatcaagaccctttgccgctgttgccccggatgctgcaatatggatgtcaaaaatttagatactgtctccttaccatttgttcccgctatatgtaggattgacaaactatcttggggatttcccacgtgctccaacaaacggtttattcgaggtaaagtttgccttccgcttatatcatccatctgcttcttatgtaatctgttgccggccaaacgagcaatattattctatatcaaaatcgtcaggaaactggtcgacttgactcaagtttcattaagacaagaatataaatttaaaaaatcattattgacctaa

SEQ ID NO: 7676 - protein, 173 aa, Saccharomyces cerevisiae
MHHWQFFLAKYTRATLVSSSRLLHCNFKELSASISSFSILEYSIKEMASLLMLISSSLAFSKEDVVYLPIKTLCRCCPGCCNMDVKNLDTVSLPFVPAICRIDKLSWGFPTCSNKRFIRGKVCLPLISSICFLCNLLPAKRAILFYIKIVRKLVDLTQVSLRQEYKFKKSLLT

SEQ ID NO: 7677 - DNA, 25 bp, Artificial sequence
  primer
atgcaccattggcaatttttcttag

SEQ ID NO: 7678 - DNA, 30 bp, Artificial sequence
  primer
ttaggtcaataatgattttttaaatttata

SEQ ID NO: 7679 - DNA, 396 bp, Saccharomyces cerevisiae
  CDS (1)..(396)
atgtttggcccattcaaattaacaagccccgtcgctggtggcctactatggaaaattccatggagaatgtccacacatcaaaaaacccgtcaaagggaaagattaagaaacgttgatcaagtcataaagcaattaactttaggtctccacgtccaaagatgtcaggataaaggtcttacttatcaagaagccatggagagcaaaaagaaatacaagccaagaagtaaatcgttaaggttgttaaacaaaccatcagtctttccaaaggagaatcaaatgtcttctaaagataaatattggacttttgataaaaaagctgttggttataggaagggtattcataaggtgcccaagtggacgaagatttccattagaaaggccccaaaattcttttga

SEQ ID NO: 7680 - protein, 131 aa, Saccharomyces cerevisiae
MFGPFKLTSPVAGGLLWKIPWRMSTHQKTRQRERLRNVDQVIKQLTLGLHVQRCQDKGLTYQEAMESKKKYKPRSKSLRLLNKPSVFPKENQMSSKDKYWTFDKKAVGYRKGIHKVPKWTKISIRKAPKFF

SEQ ID NO: 7681 - DNA, 408 bp, Aspergillus fumigatus
  CDS (1)..(408)
atgttcaaggcctcgtcaccgctcctctcgggtcttctctggtacgccccaagcctccgatggagcctctacagtggctcttcccctcttgtccttttttcactgccatcaagcacacgactaatgaagatcccatggcgtctttcacggcatcaaaaagcacggcaacggaagcgtctacgcgccgttgaccgggtagtcgacaccctgagcgccgccttgcgacgaaacggccagagcacaaaagccattgatcggtggtatgcggaaatgcctcgggaggaagaaatgttgcccaaggacaaatacacgctgttcgataagaaggaaaagacttatcggaagggtattcacaaactgcccaagtggacaagagtcagccagcgcttgaaccctcccggtttctaa

SEQ ID NO: 7682 - protein, 135 aa, Aspergillus fumigatus
MFKASSPLLSGLLWYAPSLRWSLYSGSSPLVLFSLPSSTRLMKIPWRLSRHQKARQRKRLRAVDRVVDTLSAALRRNGQSTKAIDRWYAEMPREEEMLPKDKYTLFDKKEKTYRKGIHKLPKWTRVSQRLNPPGF

SEQ ID NO: 7683 - DNA, 348 bp, Schizosaccharomyces pombe 972h-
  CDS (1)..(348)
atgctgggtgcatttaactcgactttggctcgctttggcggtcttgttcataaagtaccttggagattatcccagcgaagaaaatatcgtcaccgtcaacgacttcgtgccgtcgatgaggtggtagatgttttgcgcacggcgttgcaagagaaaaatcaatcgtgcaaacgaattgaaagtttcgttgctaaccatcagcctgaatcccaaatgtcaccaaaggataaatacactatgtttaccaggaagactcaaggtgccggtctccaaggcttccgcaagggtgtccataaatcaccaaaatggacccgtagtactaatcgtgttaatcccactggcttttaa

SEQ ID NO: 7684 - protein, 115 aa, Schizosaccharomyces pombe 972h-
MLGAFNSTLARFGGLVHKVPWRLSQRRKYRHRQRLRAVDEVVDVLRTALQEKNQSCKRIESFVANHQPESQMSPKDKYTMFTRKTQGAGLQGFRKGVHKSPKWTRSTNRVNPTGF

SEQ ID NO: 7685 - DNA, 333 bp, Magnaporthe grisea 70-15
  CDS (1)..(333)
atgtttggaccatttaggataacaaacgtcttaaatggcggtcttctatggaagaccccatggcgactctctcgattccagaaactccgccagcgcaggcggctgcgagctgtcgacgacgttgtagcaactttggacaaggcattagccaagaagggcgaatcgctcaagtcgctcgagaggtggaaggaggagatgccgaccgaggctgagatggctcccagggacaagtacaccatctttgcgcggtacgagaagaagtaccggaagggcattcacaagctgccaaagtggacaagagtgtcacagagagtcaaccctcctggtttctga

SEQ ID NO: 7686 - protein, 110 aa, Magnaporthe grisea 70-15
MFGPFRITNVLNGGLLWKTPWRLSRFQKLRQRRRLRAVDDVVATLDKALAKKGESLKSLERWKEEMPTEAEMAPRDKYTIFARYEKKYRKGIHKLPKWTRVSQRVNPPGF

SEQ ID NO: 7687 - DNA, 333 bp, Gibberella zeae PH-1
  CDS (1)..(333)
atgttcggcgcatttcgcttcacgaatcctctatctggtggccttctatggaaggttccctggaggatgtccaagttccagaagcgccgccacagacttcgcctccgagccgtcgacgatgttgtagctaccgttgacgctgctctcgccaagaagggacagactctcgaggccctcgaccgatggaaggctgagatgcctactgaggctgaaatgctgccaagggataaatacaccatgtttgaccgcaaggctaagcgttaccgcaagggtattcacaagctacccaagtggacaagggtgtcacaacgagtcaacccccctggttactag

SEQ ID NO: 7688 - protein, 110 aa, Gibberella zeae PH-1
MFGAFRFTNPLSGGLLWKVPWRMSKFQKRRHRLRLRAVDDVVATVDAALAKKGQTLEALDRWKAEMPTEAEMLPRDKYTMFDRKAKRYRKGIHKLPKWTRVSQRVNPPGY

SEQ ID NO: 7689 - DNA, 393 bp, Candida glabrata CBS 138
  CDS (1)..(393)
atgtttggtccattcagaggtactcagttcctgcaaggcgggttgttgtggaaagttccatggaggatgtccggtccccagaagttccgtcaaagacagaggctaaaggctgttgatgatgtagtgaagaacctaacacttggattgcacgtacagcgctgtcaggagaaagggttgcagtttgaacaagcactggaagaacgcaagtacaagcccagaagtgccattatgcgtctgctgaacaaagcgtcgttcttccctaaggagtaccagatgtcagcaaaggacaaatacacagtgtttgacaagaagagcagaggctacaggaaaggtatacacaaggtgccaaagtggactaagatttcagctaggcgcaaccctcaattcttttag

SEQ ID NO: 7690 - protein, 130 aa, Candida glabrata CBS 138
MFGPFRGTQFLQGGLLWKVPWRMSGPQKFRQRQRLKAVDDVVKNLTLGLHVQRCQEKGLQFEQALEERKYKPRSAIMRLLNKASFFPKEYQMSAKDKYTVFDKKSRGYRKGIHKVPKWTKISARRNPQFF

SEQ ID NO: 7691 - DNA, 390 bp, Kluyveromyces lactis NRRL Y-1140
  CDS (1)..(390)
atgttcggtgcattcagagctacacaacctgcattaggtggattattatggaaagtcccatggcgtatgtctggtcctcaaaaagcaagacaaagagaccgtttgagaagcgttgatgatgttctttcaactcttaagttaggtcttcatcttgaaagaaaccatatggcggtttctgagggatctcagctgaatctacgtaagattaaacctcgtgtgaagagcttacgtattttagacaaggctcagtatttcccaaaggaaccggagatgtctgctactgataagtacagtgtattcaacaggtactcgaagggatatagaaagggtatacataaagttcccaaatggaccaagctttccatcagaagaaacccacgtcatttctga

SEQ ID NO: 7692 - protein, 129 aa, Kluyveromyces lactis NRRL Y-1140
MFGAFRATQPALGGLLWKVPWRMSGPQKARQRDRLRSVDDVLSTLKLGLHLERNHMAVSEGSQLNLRKIKPRVKSLRILDKAQYFPKEPEMSATDKYSVFNRYSKGYRKGIHKVPKWTKLSIRRNPRHF

SEQ ID NO: 7693 - DNA, 342 bp, Debaryomyces hansenii CBS767
  CDS (1)..(342)
atgtttggtgcattcaagtcaaccttatcgttgagcggtggttacttatggaaagtagcaccaagaatgtctggtccccaaaaatacagattaagaagaagaatgaaaacagtcgatgaaaatattgaagttttatataaatcattgaaattagataatgtcgaatccaccggatacgacaagattgattatttaaagtttcaatttccaaaggagcacgaaatgacacctaaagataaatatactacatttgacaagaaggccaaagattatagaaaatcaatccatagagttcctaaatggaccaagttatcgttcagagaaaatccaaaatacttctag

SEQ ID NO: 7694 - protein, 113 aa, Debaryomyces hansenii CBS767
MFGAFKSTLSLSGGYLWKVAPRMSGPQKYRLRRRMKTVDENIEVLYKSLKLDNVESTGYDKIDYLKFQFPKEHEMTPKDKYTTFDKKAKDYRKSIHRVPKWTKLSFRENPKYF

SEQ ID NO: 7695 - DNA, 315 bp, Yarrowia lipolytica CLIB122
  CDS (1)..(315)
atggtcacctttggtggctacgtccacaagcagcgataccgatggagattgtctcctacacagaaggctggccagcgaaagcgaatgaaggccgtcgactcagtcatggatgttctgcgatctagcatggagaagctcggcgtcactcccaagttcctcatcaaggctgagaccgagtgccctccttcttcggccatgctccccaaggacaagtacaccgttttcagcaagaaccacaagggttaccgaaaatccgttcaccgggtgcccaacttcaccaagactaccaaccgaaagaatccccttggtttctaa

SEQ ID NO: 7696 - protein, 104 aa, Yarrowia lipolytica CLIB122
MVTFGGYVHKQRYRWRLSPTQKAGQRKRMKAVDSVMDVLRSSMEKLGVTPKFLIKAETECPPSSAMLPKDKYTVFSKNHKGYRKSVHRVPNFTKTTNRKNPLGF

SEQ ID NO: 7697 - DNA, 324 bp, Aspergillus nidulans FGSC A4
  CDS (1)..(324)
atgttcaagccttcatcaccattattctcgggtcttctctggaagatcccatggcgtatctcgcagccccagaaggcccggcaacgtaaacgccttcgtgctgtcgacaaggtagtcgacaccgtcagcgcggccctggcccgaaacggccagaccacgaaggctgttgagagatggtacagagagatgccccgagaggaggagatgctgccgcgtgacaaatacacgatctttgataagaaggagaagacataccgcaagggcattcacaaattaccgaagtggacgagagtcagccagcgcgtcaacccccctggtttctaa

SEQ ID NO: 7698 - protein, 107 aa, Aspergillus nidulans FGSC A4
MFKPSSPLFSGLLWKIPWRISQPQKARQRKRLRAVDKVVDTVSAALARNGQTTKAVERWYREMPREEEMLPRDKYTIFDKKEKTYRKGIHKLPKWTRVSQRVNPPGF

SEQ ID NO: 7699 - DNA, 342 bp, Candida albicans SC5314
  CDS (1)..(342): transl_table=12
atgtttgaatcattagttagatcaggaggttatgtttggaaattcacttcaagattaaccactacacaaaaatataaattacgtagtcgaatgaaacaagttgatgaaaacatcaagaatatttatcaaggattaattgccatggaaaataaatcaatgggtgaacctacaggattgaaaaaaattgattatttacaatttgaatttcctaaagaaaatgaaatgactacaagagataaatatactacttttaatagacattcgaaaaattatcgtaaaccagttcatcgagtgcctaaatggacaaaattatcatttagagaaaatccaaaatatttttaa

SEQ ID NO: 7700 - protein, 113 aa, Candida albicans SC5314
MFESLVRSGGYVWKFTSRLTTTQKYKLRSRMKQVDENIKNIYQGLIAMENKSMGEPTGLKKIDYLQFEFPKENEMTTRDKYTTFNRHSKNYRKPVHRVPKWTKLSFRENPKYF

SEQ ID NO: 7701 - DNA, 387 bp, Cryptococcus neoformans var. neoformans B-3501A
  CDS (1)..(387)
atgttcggagcattcaggcctacatccttcgtttccggaggtcttctctggaaaaatccctggcgtctttctccgacccggaaagctaaccagcgcaagcgcctgaagagagtcgatgatgttatctccatggtggctgaaagcggagtgacgacacgtagcctagtgaaggctttggccttgccaactgaggcggaaatgagcccaaggggtaagttgaagtgtcttcgtctgcggttggcaaggtgtatgcaggtcgtgtacgggcaaagaagagagtataagtatacaacgttctcaaaacgcgatcccggttacagaaagagtcaacataaagtgccaaagtggacacgattgacgttacgcgaaaaccccaagggtttctaa

SEQ ID NO: 7702 - protein, 128 aa, Cryptococcus neoformans var. neoformans B-3501A
MFGAFRPTSFVSGGLLWKNPWRLSPTRKANQRKRLKRVDDVISMVAESGVTTRSLVKALALPTEAEMSPRGKLKCLRLRLARCMQVVYGQRREYKYTTFSKRDPGYRKSQHKVPKWTRLTLRENPKGF

SEQ ID NO: 7703 - DNA, 324 bp, Aspergillus oryzae
  CDS (1)..(324)
atgttcaaagcgacgtctcctctcttttcgggtcttctttggaagatcccatggcgaatctcgcagccccagaaggctcgccagaggaagcgccttcgctccgttgataatgtggtagacaccatcagcgccgcccttgcacgtaacggcctgaaggcgcgatccgtcgatcggtggtaccgggaaatgcctcgcgaggaggagatgctgccaaaggataaatacacgctgttcgacaagaaggaaaagacgtaccgcaagggtattcacaagctgccgaaatggacacgagtcagccagcgcgtgaaccctcccggtttctaa

SEQ ID NO: 7704 - protein, 107 aa, Aspergillus oryzae
MFKATSPLFSGLLWKIPWRISQPQKARQRKRLRSVDNVVDTISAALARNGLKARSVDRWYREMPREEEMLPKDKYTLFDKKEKTYRKGIHKLPKWTRVSQRVNPPGF

SEQ ID NO: 7705 - DNA, 26 bp, Artificial sequence
  primer
atgtttggcccattcaaattaacaag

SEQ ID NO: 7706 - DNA, 25 bp, Artificial sequence
  primer
tcaaaagaattttggggcctttcta

SEQ ID NO: 7707 - protein, 160 aa, Artificial sequence
  consensus sequence
  Variant (2)..(9): Xaa in position 2 to 9 is any amino acid
  Variant (11)..(12): Xaa in position 11 to 12 is any amino acid
  Variant (14)..(15): Xaa in position 14 to 15 is any amino acid
  Variant (16)..(41): Xaa in position 16 to 41 is any or no amino acid
  Variant (43)..(43): Xaa in position 43 is any amino acid
  Variant (44)..(44): Xaa in position 44 is any or no amino acid
  Variant (47)..(47): Xaa in position 47 is any amino acid
  Variant (49)..(50): Xaa in position 49 to 50 is any amino acid
  Variant (53)..(55): Xaa in position 53 to 55 is any amino acid
  Variant (57)..(57): Xaa in position 57 is any amino acid
  Variant (59)..(61): Xaa in position 59 to 61 is any amino acid
  Variant (64)..(64): Xaa in position 64 is any amino acid
  Variant (66)..(95): Xaa in position 66 to 95 is any amino acid
  Variant (96)..(116): Xaa in position 96 to 116 is any or no amino acid
  Variant (118)..(120): Xaa in position 118 to 120 is any amino acid
  Variant (125)..(125): Xaa in position 125 is any amino acid
  Variant (127)..(132): Xaa in position 127 to 132 is any amino acid
  Variant (133)..(137): Xaa in position 133 to 137 is any or no amino acid
  Variant (141)..(142): Xaa in position 141 to 142 is any amino acid
  Variant (144)..(145): Xaa in position 144 to 145 is any amino acid
  Variant (150)..(153): Xaa in position 150 to 153 is any amino acid
  Variant (155)..(155): Xaa in position 155 is any amino acid
  Variant (158)..(159): Xaa in position 158 to 159 is any amino acid
FXXXXXXXXGXXWXXXXXXXXXXXXXXXXXXXXXXXXXXXXKXXWRXSXXQKXXXRXRXXXVDXVXXXXXXXXXXXXXXXXXXXXXXXXXXXXXXXXXXXXXXXXXXXXXXXXXXXMXXXDKYTXFXXXXXXXXXXXYRKXXHXXPKWTXXXXRXNPXXF

SEQ ID NO: 7708 - protein, 28 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any amino acid
  Variant (6)..(6): Xaa in position 6 is any or no amino acid
  Variant (8)..(8): Xaa in position 8 is any or no amino acid
  Variant (10)..(10): Xaa in position 10 is Ile, Leu or Met
  Variant (12)..(13): Xaa in position 12 to 13 is any amino acid
  Variant (14)..(14): Xaa in position 14 is Gln or Arg
  Variant (16)..(16): Xaa in position 16 is any amino acid
  Variant (17)..(17): Xaa in position 17 is Asn or Arg
  Variant (18)..(18): Xaa in position 18 is any amino acid
  Variant (20)..(20): Xaa in position 20 is any amino acid
  Variant (22)..(22): Xaa in position 22 is Leu or Met
  Variant (23)..(23): Xaa in position 23 is Lys or Arg
  Variant (24)..(24): Xaa in position 24 is any amino acid
  Variant (27)..(27): Xaa in position 27 is any amino acid
  Variant (28)..(28): Xaa in position 28 is Asn or Val
LXXKXXPXRXSXXXKXXXRXRXXXVDXX

SEQ ID NO: 7709 - protein, 17 aa, Artificial sequence
  protein pattern
  Variant (2)..(2): Xaa in position 2 is any amino acid
  Variant (3)..(3): Xaa in position 3 is Glu or Ser
  Variant (4)..(4): Xaa in position 4 is any amino acid
  Variant (5)..(5): Xaa in position 5 is Ala, Glu or Gln
  Variant (7)..(7): Xaa in position 7 is any amino acid
  Variant (8)..(8): Xaa in position 8 is Ala, Pro, Ser or Thr
  Variant (9)..(9): Xaa in position 9 is any amino acid
  Variant (13)..(14): Xaa in position 13 to 14 is any amino acid
  Variant (16)..(16): Xaa in position 16 is Ala, Asp, Asn or Ser
  Variant (17)..(17): Xaa in position 17 is Lys or Arg
PXXXXMXXXDKYXXFXX

SEQ ID NO: 7710 - DNA, 1413 bp, Saccharomyces cerevisiae
  CDS (1)..(1413)
atgtcatacaagtcagcaataatagggctttgtttgctagctgtgatactattagctccccctttagcatggcattcacataccaagaatattccagcaatcattttgataacatggcttcttacaatgaatttaacgtgtattgtagatgcggcaatatggagtgacgacgatttcctcacgagatgggatggtaaaggttggtgtgatattgtcatcaagttgcaggttggtgcgaatattggcatatcatgtgccgttaccaacatcatttacaacttgcatacaattttgaaggcagatagtgttttaccggatctttcatcatggacgaaaatcgtcaaggaccttgtgattagcttgttcacacctgtcatggtcatgggattttcatatctgttacaagtatttagatatggtatcgctcgttacaacggttgccaaaacttattgtctccgacatggattaccactgttttgtataccatgtggatgcttatatggtcatttgtgggcgctgtttatgccaccttagtactgttcgtgttttataaaaaacgcaaggacgttagggatattttacactgtaccaattcaggtttaaacctgacaaggttcgcaaggctgttgatattctgtttcattattattttagtcatgttccctttttctgtttacacctttgttcaagatttacagcaggtagaaggacactatacttttaaaaatacccattccagcaccatctggaataccattattaaatttgaccctggcagaccaatttataatatatggctttatgttttgatgtcttacctagtatttctaatctttggcttaggttctgatgctttgcatatgtactctaaattcctgcgttccatcaaactaggatttgtacttgacatgtggaaaagattcattgataagaataaggaaaaacgagtaggcatattgctaaacaagctgtcctcacgcaaagagagccgtaacccattttctacagactctgagaactatatctccacgtgtacagaaaactattctccctgtgtaggtacaccaatatcacaagcgcatttctatgtcgactataggattccagatgatcctagaaaatctcaaaataaaagcaaaaaatatttgtttgctgataaagaaacagatgatattcttgatgaaatagacctaaaagaaagtaggcacatcccttacgtcacgcaaggacagagctttgacgacgaaatatcacttggaggattctcaaaagttactctcgattattcagaaaagcttcataattctgcaagctccaattttgaaggggaaagtctttgctactctccagcttcaaaagaagagaattcaagctcaaacgaacatagttcagaaaatactgcaggcccttaa

SEQ ID NO: 7711 - protein, 470 aa, Saccharomyces cerevisiae
MSYKSAIIGLCLLAVILLAPPLAWHSHTKNIPAIILITWLLTMNLTCIVDAAIWSDDDFLTRWDGKGWCDIVIKLQVGANIGISCAVTNIIYNLHTILKADSVLPDLSSWTKIVKDLVISLFTPVMVMGFSYLLQVFRYGIARYNGCQNLLSPTWITTVLYTMWMLIWSFVGAVYATLVLFVFYKKRKDVRDILHCTNSGLNLTRFARLLIFCFIIILVMFPFSVYTFVQDLQQVEGHYTFKNTHSSTIWNTIIKFDPGRPIYNIWLYVLMSYLVFLIFGLGSDALHMYSKFLRSIKLGFVLDMWKRFIDKNKEKRVGILLNKLSSRKESRNPFSTDSENYISTCTENYSPCVGTPISQAHFYVDYRIPDDPRKSQNKSKKYLFADKETDDILDEIDLKESRHIPYVTQGQSFDDEISLGGFSKVTLDYSEKLHNSASSNFEGESLCYSPASKEENSSSNEHSSENTAGP

SEQ ID NO: 7712 - DNA, 1895 bp, Saccharomyces exiguus
  CDS (366)..(1727)
aagcttcatattatagttcattaatgtcttgtttcatgtttaaccccctctcaccttgactgccattaatggttgtgttaatttttgcatctatttttttgccttgatgtcgcactggccatagatcgaccaaataggaaactcaccgatttttatgaggttccttgtaacatcacaatacaaatacaatacctttttcctaattcgatattaattaaatcttttactgatcttgcatttgttctgatctcatttatatataagacggtatacctttcctaaatttttttattgtaatccatttgagatgtgtttcatccaagtcgtaatttaattataaatacagattaaacaaaccagagttaatgacttataaatctacgattatagggctttgctccctcgcactcatatctctatttccgcccttagcatggcacacacattccagaaatattccggcgataatcctaattacgtggttattaataatgaatatcacttgtattgtaaatgcagcggtatggagtgatattgattttatgaatagatgggatggaaaaggttggtgtgattttgtcatcaaattacaagttggtgcaaatattggaatatcttgtgccgtgacaaatattacatttaatttacaccagattctaaaagctgaaaacgttttacccgaatcaaattcaataaagaaaatttgtactgatttgatgattagtttatttactccaactgcagttatggggttttcatatttattacaagtattccgttatggtattgctaggtataatggttgtcaaaatttgttatctccgacatggattacaacggtactgtatacaatgtggatgctgatttggtccttagttggtactgtgtacgcctgtttggtgctatatgttttctacaaaaagagaaaggatgtcagagatattttgcactgtacaaattctggattgaatttaactaggttttctagattactaactttctgttttattattattttggtcatgttcccattctcaatctttacatttgttcaagatctaagacaggttagtgggtcttatgattttaaaggtacacacgcgaaagagctctgggatgtgattatcaagttcgacccaggcaagccagtttatagtgtctggctgtatgtccttatgtcatacgttgtatttttcatatttggtcttggtacggatgcattaaacatgtattctagctttttgcgtatgattggtttggggtcggtgttggattatgcaaatgaacgtatccaaagaaacagatccaacagagtgggcaagttactacggaagctggtcggaaagactgataaccaagctacagaagtttatggtacaacagaacattataacgatattagattttccccagcattaataacacctacatcaaataaccacgttaccgttgattataaattttctaaagaaggtagagataccggtgcttacaatgacagatttaatccttttgaggagaatgcggatagtttcgattttgataaggatctagaactcgggaatcataatttcatgccatacataactaaggagtataatttcctagacgatatatctttagatgatttgacaagtttaaaaggtaatagtaatggtcatgtgagctctgagaaaaagagcagtttcgaaacctatgaacgttctgcaacatctgacgacgactaattaattccaatggggtcaattctttcaaataaataatactaaataaataaatatattcgacacaagacgatataaacattgcactatttcttccctctaaatttttttaattgctgacacttttatagattttcagtgtcgaggtcaggcatgtgtattttttggacg

SEQ ID NO: 7713 - protein, 453 aa, Saccharomyces exiguus
MTYKSTIIGLCSLALISLFPPLAWHTHSRNIPAIILITWLLIMNITCIVNAAVWSDIDFMNRWDGKGWCDFVIKLQVGANIGISCAVTNITFNLHQILKAENVLPESNSIKKICTDLMISLFTPTAVMGFSYLLQVFRYGIARYNGCQNLLSPTWITTVLYTMWMLIWSLVGTVYACLVLYVFYKKRKDVRDILHCTNSGLNLTRFSRLLTFCFIIILVMFPFSIFTFVQDLRQVSGSYDFKGTHAKELWDVIIKFDPGKPVYSVWLYVLMSYVVFFIFGLGTDALNMYSSFLRMIGLGSVLDYANERIQRNRSNRVGKLLRKLVGKTDNQATEVYGTTEHYNDIRFSPALITPTSNNHVTVDYKFSKEGRDTGAYNDRFNPFEENADSFDFDKDLELGNHNFMPYITKEYNFLDDISLDDLTSLKGNSNGHVSSEKKSSFETYERSATSDDD

SEQ ID NO: 7714 - DNA, 1850 bp, Saccharomyces paradoxus
  CDS (74)..(1486)
cattacctaccacgttttaactaacacaattaaatctgtgtagaaaacaaagaacaccactcaataaagtacaatgtcatacaagtcaacaataatagggctttgtctgctagctgtgatattattagttccccctttagcatggcactcacatacgaaaaatattccagcaatcattttgataacatggctcctcataatgaatataacatgtattgtagatgcggcgatatggagtgacgacgatttcctcacgagatgggatggtaaaggctggtgcgatattgtcatcaagttgcaagttggagcgaatattggcatatcgtgtgccgttacgaacatcatttacaacttgcatgctattctgaaggcagatagtgttttaccggatctgtcatcttggacaaaaatcgtcaaggaccttgtgattagcttattcacacccgtgatgatcatgggattttcgtatctattacaagtgtttagatatggtatcgctcgctacaatggctgccaaaacctattgtccccgacatggattactactattttgtatacaatgtggatgcttatatggtcatttgtgggtgccgtttatgccaccttggtgctgttcgttttctataaaaaacgcaaagatgttagagatattttacactgtaccaattcgggtttaaacttgacaaggtttgcaaggctactaatcttctgtttcatcattattctagttatgttccctttttctatttacacctttgttcaggatttacagcaggtggatggacactatagttttaagaatacccattccagtactatttggaataccattattaaatttgatcctggtagaccgatttataacatatggctttacgttttgatgtcttacttagtatttctaatctttgggttaggctctgatgctttggatatgtactctaagttcctgcgttcgattaaactaggctttgtgctagacctgtggaaaacttttgttgataagaataaggaaaaacgagttggtaaattgctcaccaagctttccccaggcaaagaattccacaatccattctctaccgattctgaaaactatatctccacgtatacggaaaactattccccctgtgcaggcacaccaatatcacaagcacatttctacgtcgattatagaattcctgatgatcttggaagatctcaaaataaaagcagaaaaaatttgtttgctagtaaagaaacagatgatattcttgatgacatagagctgaaagagagcagacatatcccttacctcacacaaggacagagttttgacgacgaaatatcacttggaggattctcaaaggttactctagattattcagaaaagcttcacaattctgccacctcgaatcttgagggggaaagcctttgctactctccagctttcaaagaagaagattcaagttcaaatgagcatagttcagaaagtactgcaggcccttaatacgaaagtattgcagtatgtttcctcttcctgtgaatgagatctaaattggggttgcaatgcaatgcagtgatgacctcactaactaatatgatgcaacttagtagtgatacttcgaactctatgtgaatattttttaatatttactattttcttattgctttaacttcaatttttctaacaaaaaaagcaacatctgtactatatataaaaaaaagaaattgatataatttgtgcacaaaaaaggtcatcaagttgaaaaccaaactaaacttttgttctaaaaaaacacccaccgcaaatgtcactaatacacaagagaatattggttcgtccacttaataggccatttttgaagaatttt

SEQ ID NO: 7715 - protein, 470 aa, Saccharomyces paradoxus
MSYKSTIIGLCLLAVILLVPPLAWHSHTKNIPAIILITWLLIMNITCIVDAAIWSDDDFLTRWDGKGWCDIVIKLQVGANIGISCAVTNIIYNLHAILKADSVLPDLSSWTKIVKDLVISLFTPVMIMGFSYLLQVFRYGIARYNGCQNLLSPTWITTILYTMWMLIWSFVGAVYATLVLFVFYKKRKDVRDILHCTNSGLNLTRFARLLIFCFIIILVMFPFSIYTFVQDLQQVDGHYSFKNTHSSTIWNTIIKFDPGRPIYNIWLYVLMSYLVFLIFGLGSDALDMYSKFLRSIKLGFVLDLWKTFVDKNKEKRVGKLLTKLSPGKEFHNPFSTDSENYISTYTENYSPCAGTPISQAHFYVDYRIPDDLGRSQNKSRKNLFASKETDDILDDIELKESRHIPYLTQGQSFDDEISLGGFSKVTLDYSEKLHNSATSNLEGESLCYSPAFKEEDSSSNEHSSESTAGP

SEQ ID NO: 7716 - DNA, 1924 bp, Saccharomyces paradoxus
  CDS (66)..(1478)
  misc_feature (492)..(492): n is a, g, c or t
  misc_feature (538)..(538): n is a, g, c or t
  misc_feature (639)..(639): n is a, g, c or t
  misc_feature (844)..(844): n is a, g, c or t
  misc_feature (1004)..(1004): n is a, g, c or t
  misc_feature (1034)..(1034): n is a, g, c or t
  misc_feature (1050)..(1050): n is a, g, c or t
  misc_feature (1057)..(1057): n is a, g, c or t
taccacgttttaactaacacaattaaatctgtgtagaaaacaaaaacaccactcaataaagtacaatgtcatacaagtcaacaataatggggctttgtctgctagctgttatattattagttccccctttagcatggcactcacatacgaaaaatattccagcaatcattttgataacatggctcctcataatgaatataacatgtattgtagatgcggcgatatggagtgacgacgatttcctcacgagatgggatggtaaaggctggtgcgatattgtcatcaagttgcaagttggagcgaatattggcatatcgtgtgccgttacgaacatcatttacaacttgcatgctattctgaaggcagatagtgttttaccggatctgtcatcttggacaaaaatcgtcaaggaccttgtgattagcttattcacacccgtgatgatcatgggattttcgtatctgttacaagtgtttagatatggtatcgctngctacaatggctgccaaaacctattgtccccgacatggattactantattttgtatacaatgtggatgcttatatggtcatttgtgggcgccgtttatgccaccttggtgctgttcgtgttctataaaaaacgcaaagatgttaganatattttacactgtaccaattcgggtttaaacttgacaaggtttgcaaggctactagtcttctgtttcatcattattctagttatgttccctttttctatatacacctttgttcaggatttacagcaggtggatggacactatagttttaaaaatacccattccagcactatttggaataccattattaaatttgatcctggtanaccgatttataatatatggctttacgttttgatgtcttacttagtatttctaatctttgggttgggctctgatgctttggacatgtactctaagttcctgcgttcgattaaactaggctttgtgctagacctgtggaaaacttttgttgataagaataangaaaaacgagttggtaaattgctcaccaanctttcctcgggcaaanaattccncaatccattttctactgattctgagaactatatctccacgtatacggaaaactattccccctgtgcaggcacaccaatatcacaagcacatttctacgtcgattatagaattcctgatgatcttggaagatctcaaaataaaagcagaaaaaatttgtttgctagtaaagaaacagatgatattcttgatgatatagagctgaaagagagcagacatatcccttacctcacacaaggacagagttttgacgacgaaatatcacttggaggattctcaaaggttactctagattattcagaaaagcttcacaattctgccacctcgaatcttgagggggaaagcctttgctactctccagctttcaaagaagaggattcaagttcaaatgagcatagttcagaaagtactgcaggcccttaatacgaaagtattgcagtatgtttccttcctatgaatgagatctaaattggggttgcaatgtaatgcagtgatgaccccactaactaatatgatgcaacttagtagtgatacttcgaactctatgtgaatattttttaatatttactattttcgtattgctttagcttcaatttttcttacaaaaaaagcaacatctgtactatatataaaaaaaaaagaaattgatgtaatttgtgcacaaaagaggtcatcaagttgaaaacaaaactaaacttttgttttaaaaaaacagccaccgcaaaagtcaccaatacacaagagaatattggttcgtccacttaataggccatttttggagattttttttataagccaacgcaagaaaacatgaaaagatttctgattctcgcttataatcaaagaatatttcgttgcttacaattaga

SEQ ID NO: 7717 - protein, 470 aa, Saccharomyces paradoxus
  misc_feature (143)..(143): The Xaa at location 143 stands for Arg, Cys, Gly, or Ser.
  misc_feature (158)..(158): The Xaa at location 158 stands for Asn, Ile, Ser, or Thr.
  misc_feature (192)..(192): The Xaa at location 192 stands for Asn, Asp, His, or Tyr.
  misc_feature (260)..(260): The Xaa at location 260 stands for Arg, Ile, Lys, or Thr.
  misc_feature (313)..(313): The Xaa at location 313 stands for Asn, or Lys.
  misc_feature (323)..(323): The Xaa at location 323 stands for Asn, or Lys.
  misc_feature (329)..(329): The Xaa at location 329 stands for Stop, Gln, Glu, or Lys.
  misc_feature (331)..(331): The Xaa at location 331 stands for Arg, His, Leu, or Pro.
MSYKSTIMGLCLLAVILLVPPLAWHSHTKNIPAIILITWLLIMNITCIVDAAIWSDDDFLTRWDGKGWCDIVIKLQVGANIGISCAVTNIIYNLHAILKADSVLPDLSSWTKIVKDLVISLFTPVMIMGFSYLLQVFRYGIAXYNGCQNLLSPTWITXILYTMWMLIWSFVGAVYATLVLFVFYKKRKDVRXILHCTNSGLNLTRFARLLVFCFIIILVMFPFSIYTFVQDLQQVDGHYSFKNTHSSTIWNTIIKFDPGXPIYNIWLYVLMSYLVFLIFGLGSDALDMYSKFLRSIKLGFVLDLWKTFVDKNXEKRVGKLLTXLSSGKXFXNPFSTDSENYISTYTENYSPCAGTPISQAHFYVDYRIPDDLGRSQNKSRKNLFASKETDDILDDIELKESRHIPYLTQGQSFDDEISLGGFSKVTLDYSEKLHNSATSNLEGESLCYSPAFKEEDSSSNEHSSESTAGP

SEQ ID NO: 7718 - DNA, 1917 bp, Saccharomyces paradoxus
  CDS (71)..(1483)
atacctaccacgttttaactaacacaattaaatctgtgtagaaaacaaaaacaccactcaataaagtacaatgtcatacaagtcaacaataatggggctttgtctgctagctgttatattattagttccccctttagcatggcactcacatacgaaaaatattccagcaatcattttgataacatggctcctcataatgaatataacatgtattgtagatgcggcgatatggagtgacgacgatttcctcacgagatgggatggtaaaggctggtgcgatattgtcatcaagttgcaagttggagcgaatattggcatatcgtgtgccgttacgaacatcatttacaacttgcatgctattctgaaggcagatagtgttttaccggatctgtcatcttggacaaaaatcgtcaaggaccttgtgattagcttattcacacccgtgatgatcatgggattttcgtatctgttacaagtgtttagatatggtatcgctcgctacaatggctgccaaaacctattgtccccgacatggattactactattttgtacacaatgtggatgcttatatggtcatttgtgggcgccgtttatgccaccttggtgctgttcgtgttctataaaaaacgcaaagatgttagagatattttacactgtaccaattcgggtttaaacttgacaaggtttgcaaggctactaatcttctgtttcatcattattctagttatgttccctttttctatatacacctttgttcaggatttacagcaggtggatggacactatagttttaaaaatacccattccagcactatttggaataccattattaaatttgatcctggtagaccgatttataatatatggctttacgttttgatgtcttacttagtatttctaatctttgggttgggctctgatgctttggacatgtactctaagttcctgcgttcgattaaactaggctttgtgctagacctgtggaaaacttttgttgataagaataaggaaaaacgagttggtaaattgctcaccaagctttcctcgggcaaagaattccacaatccattttctactgattctgagaactatatctccacgtatacggaaaactattccccctgtgcaggcacaccaatatcacaagcacatttctacgtcgattatagaattcctgatgatcttggaagatctcaaaataaaagcagaaaaaatttgtttgctagtaaagaaacagatgatattcttgatgatatagagctgaaagagagcagacatatcccttacctcacacaaggacagagttttgacgacgaaatatcacttggaggattctcaaaggttactctagattattcagaaaagcttcacaattctgccacctcgaatcttgaaggggaaagcctttgctactctccagctttcaaagaagaagattcaagttcaaatgagcatagttcagaaagtactgcaggcccttaatacgaaagtattgcagtatgtttccttcctatgaatgagatctaaattggggttgcaatgtaatgcagtgatgaccccactaactaatatgatgcaacttagtagtgatacttcgaactctatgtgaatattttttaatatttactattttcgtattgctttagcttcaatttttcttacaaaaaaagcaacatctgtactatatataaaaaaaaaagaaattgatgtaatttgtgcacaaaagaggtcatcaagttgaaaacaaaactaaacttttgttttaaaaaaacagccaccgcaaaagtcaccaatacacaagagaatattggttcgtccatttttggagattttttttataagccaacgcaagaaaacatgaaaagatttctgattctcgcttataatcaaagaatatttcgttgcttacaattaga

SEQ ID NO: 7719 - protein, 470 aa, Saccharomyces paradoxus
MSYKSTIMGLCLLAVILLVPPLAWHSHTKNIPAIILITWLLIMNITCIVDAAIWSDDDFLTRWDGKGWCDIVIKLQVGANIGISCAVTNIIYNLHAILKADSVLPDLSSWTKIVKDLVISLFTPVMIMGFSYLLQVFRYGIARYNGCQNLLSPTWITTILYTMWMLIWSFVGAVYATLVLFVFYKKRKDVRDILHCTNSGLNLTRFARLLIFCFIIILVMFPFSIYTFVQDLQQVDGHYSFKNTHSSTIWNTIIKFDPGRPIYNIWLYVLMSYLVFLIFGLGSDALDMYSKFLRSIKLGFVLDLWKTFVDKNKEKRVGKLLTKLSSGKEFHNPFSTDSENYISTYTENYSPCAGTPISQAHFYVDYRIPDDLGRSQNKSRKNLFASKETDDILDDIELKESRHIPYLTQGQSFDDEISLGGFSKVTLDYSEKLHNSATSNLEGESLCYSPAFKEEDSSSNEHSSESTAGP

SEQ ID NO: 7720 - DNA, 26 bp, Artificial sequence
  primer
atgtcatacaagtcagcaataatagg

SEQ ID NO: 7721 - DNA, 25 bp, Artificial sequence
  primer
ttaagggcctgcagtattttctgaa

SEQ ID NO: 7722 - protein, 472 aa, Artificial sequence
  consensus sequence
  Variant (8)..(8): Xaa in position 8 is any amino acid
  Variant (19)..(19): Xaa in position 19 is any amino acid
  Variant (96)..(96): Xaa in position 96 is any amino acid
  Variant (127)..(127): Xaa in position 127 is any amino acid
  Variant (159)..(159): Xaa in position 159 is any amino acid
  Variant (211)..(211): Xaa in position 211 is any amino acid
  Variant (236)..(236): Xaa in position 236 is any amino acid
  Variant (240)..(240): Xaa in position 240 is any amino acid
  Variant (260)..(260): Xaa in position 260 is any amino acid
  Variant (287)..(287): Xaa in position 287 is any amino acid
  Variant (304)..(304): Xaa in position 304 is any amino acid
  Variant (307)..(307): Xaa in position 307 is any amino acid
  Variant (309)..(309): Xaa in position 309 is any amino acid
  Variant (313)..(313): Xaa in position 313 is any amino acid
  Variant (322)..(322): Xaa in position 322 is any amino acid
  Variant (326)..(327): Xaa in position 326 to 327 is any amino acid
  Variant (329)..(331): Xaa in position 329 to 331 is any amino acid
  Variant (345)..(345): Xaa in position 345 is any amino acid
  Variant (353)..(353): Xaa in position 353 is any amino acid
  Variant (372)..(374): Xaa in position 372 to 374 is any amino acid
  Variant (376)..(376): Xaa in position 376 is any amino acid
  Variant (387)..(387): Xaa in position 387 is any amino acid
  Variant (388)..(388): Xaa in position 388 is any or no amino acid
  Variant (409)..(409): Xaa in position 409 is any amino acid
  Variant (440)..(440): Xaa in position 440 is any amino acid
  Variant (443)..(443): Xaa in position 443 is any amino acid
  Variant (454)..(454): Xaa in position 454 is any amino acid
  Variant (458)..(458): Xaa in position 458 is any amino acid
  Variant (468)..(468): Xaa in position 468 is any amino acid
MSYKSTIXGLCLLAVILLXPPLAWHSHTKNIPAIILITWLLIMNITCIVDAAIWSDDDFLTRWDGKGWCDIVIKLQVGANIGISCAVTNIIYNLHXILKADSVLPDLSSWTKIVKDLVISLFTPVMXMGFSYLLQVFRYGIARYNGCQNLLSPTWITTXLYTMWMLIWSFVGAVYATLVLFVFYKKRKDVRDILHCTNSGLNLTRFARLLXFCFIIILVMFPFSIYTFVQDLQQVXGHYXFKNTHSSTIWNTIIKFDPGXPIYNIWLYVLMSYLVFLIFGLGSDALXMYSKFLRSIKLGFVLDXWKXFXDKNXEKRVGKLLXKLSXXKXXXNPFSTDSENYISTXTENYSPCXGTPISQAHFYVDYRIPDDXXXSXQNKSRKNLFAXXKETDDILDDIELKESRHIPYXTQGQSFDDEISLGGFSKVTLDYSEKLHNSAXSNXEGESLCYSPAXKEEXSSSNEHSSEXTAGP

SEQ ID NO: 7723 - protein, 60 aa, Artificial sequence
  protein pattern
  Variant (23)..(23): Xaa in position 23 is Ile or Val
  Variant (34)..(34): Xaa in position 34 is Phe or Leu
  Variant (37)..(37): Xaa in position 37 is Ala or Thr
  Variant (41)..(41): Xaa in position 41 is Cys or Thr
  Variant (45)..(45): Xaa in position 45 is Phe or Tyr
FRYGIARYNGCQNLLSPTWITTXLYTMWMLIWSXVGXVYAXLVLXVFYKKRKDVRDILHC

SEQ ID NO: 7724 - protein, 60 aa, Artificial sequence
  protein pattern
  Variant (23)..(23): Xaa in position 23 is any amino acid
  Variant (26)..(26): Xaa in position 26 is Ile or Leu
PPLAWHSHTKNIPAIILITWLLXMNXTCIVDAAIWSDDDFLTRWDGKGWCDIVIKLQVGA

SEQ ID NO: 7725 - protein, 56 aa, Artificial sequence
  protein pattern
  Variant (16)..(16): Xaa in position 16 is Ala or Thr
  Variant (47)..(47): Xaa in position 47 is Ile or Val
IGISCAVTNIIYNLHXILKADSVLPDLSSWTKIVKDLVISLFTPVMXMGFSYLLQV

SEQ ID NO: 7726 - protein, 40 aa, Artificial sequence
  protein pattern
  Variant (9)..(9): Xaa in position 9 is Asp or His
  Variant (26)..(26): Xaa in position 26 is Leu or Met
  Variant (29)..(29): Xaa in position 29 is any amino acid
  Variant (31)..(31): Xaa in position 31 is Ile or Val
  Variant (35)..(35): Xaa in position 35 is any amino acid
FGLGSDALXMYSKFLRSIKLGFVLDXWKXFXDKNXEKRVG

SEQ ID NO: 7727 - protein, 25 aa, Artificial sequence
  protein pattern
  Variant (7)..(7): Xaa in position 7 is Ala or Val
ENYSPCXGTPISQAHFYVDYRIPDD

SEQ ID NO: 7728 - protein, 29 aa, Artificial sequence
  protein pattern
  Variant (2)..(2): Xaa in position 2 is Asp or Glu
  Variant (4)..(4): Xaa in position 4 is Asp or Glu
  Variant (14)..(14): Xaa in position 14 is Leu or Val
DXIXLKESRHIPYXTQGQSFDDEISLGGF

SEQ ID NO: 7729 - protein, 21 aa, Artificial sequence
  protein pattern
  Variant (11)..(11): Xaa in position 11 is any amino acid
  Variant (15)..(15): Xaa in position 15 is Asp or Asn
EGESLCYSPAXKEEXSSSNEH

SEQ ID NO: 7730 - protein, 14 aa, Artificial sequence
  protein pattern
TNSGLNLTRFARLL

SEQ ID NO: 7731 - protein, 15 aa, Artificial sequence
  protein pattern
  Variant (6)..(6): Xaa in position 6 is Ala or Thr
  Variant (8)..(8): Xaa in position 8 is Ile or Met
MSYKSXIXGLCLLAV

SEQ ID NO: 7732 - protein, 15 aa, Artificial sequence
  protein pattern
  Variant (15)..(15): Xaa in position 15 is Ser or Thr
KVTLDYSEKLHNSAX

SEQ ID NO: 7733 - protein, 15 aa, Artificial sequence
  protein pattern
  Variant (5)..(5): Xaa in position 5 is Lys or Arg
  Variant (7)..(7): Xaa in position 7 is any amino acid
  Variant (11)..(11): Xaa in position 11 is Asp or Ser
QNKSXKXLFAXKETD

SEQ ID NO: 7734 - protein, 15 aa, Artificial sequence
  protein pattern
  Variant (14)..(14): Xaa in position 14 is any amino acid
NPFSTDSENYISTXT

SEQ ID NO: 7735 - DNA, 2040 bp, Saccharomyces cerevisiae
  CDS (1)..(2040)
atggatacgtcagtatattctcatgcattggatatttgggccaaggcagatttaacgaatcttcaaagagaattggatgctgatgttatagagattaaggataaagaaaccctgtccttgaattcaagaaagtcattagccactgagactaaaaaatttaaaaaactcgaacctgaggaaaaattgaacaatgtgaataaaataattaagcagtaccaacgtgaaattgataatttgacacagagatcaaaattctctgaaaaggttctttttgacgtatacgaaaagctttcagaggctcctgatccacagccgctactacaaagttcgttggaaaaattgggcaaaattgatgactcgaaggaacttaaggaaaaaataagctacctagaagataagctagccaaatatgcagattatgagactttgaaatcaaggttactggacctagagcaaagctctgcaaaaacattggcaaaaagactgactgcgaaaactcaagaaatcaattctacctgggaggaaaaaggaagaaattggaaagagagagaagcagatctattgaaacaattaacaaatgtacaggagcaaaacaaggcactagaggccaaaatatctaaaaatatagatatagaaggtaatggaaacgaagatggtgaccaagaaaacaatcaaaaagaagtatctacaaggattgctgaatataatctagtaacacaggagttggaaactacgcaggctagaatatatcagttagagaaaagaaatgaggaactaagtggtgctcttgcaaaggcaactagtgaagcagaaaaagaaactgagttacatgcaaaggaactaaaacttaaccagctggaaagcgaaaatgcattgttgagtgcatcctatgagcaggaacggaaatcaacatcacatgcaataaatgagttaaaagaacaattaaatagcgttgtggcggaatcggaatcttacaagtcggagctagaaactgttagaagaaaactaaacaattattctgattacaataagataaaagaagaactttctgcattgaaaaaaattgagtttggggtaaacgaagatgattctgataatgacattcgctctgaagacaagaatgataatactttcgaaagttccttactatctgcaaataagaagctccaggctactttggcggaataccgctcaaaaagtacggctcaagaggaagaacgaaacgaattgaaaaaatctgtggaccaattgaagcagcaaatagctactctcaaagaagcaaatgaaaaattagagacggacctagaaaaagtagagaacgtcagtcctcacttcaacgagactgcaagtatgatgtctggtgtaacaagacaaatgaacaatcgtacgtcccataaaatgtccccaacgagttctattattggtattccagaagatggggaactttctggaaaccaatcaaccattttaccaatagttactaaacaaagagacagatttcgttcgagaaatatggatctggaaaagcaactaagacaaggaaactcagaaaagggtaagcttaaactagaaatttcgaagctaaaaggcgacaatacgaagctttatgaacggattaggtatctgcaatcctataataataacaacgctcccgttaatcaaagtacagagcgtattgacgtggaatcccaatactcaagggtgtatgatgaatcgttgcatccaatggcaaattttagacagaacgaattaaaccactacaaaaacaagaaattatcagctttagagaagttattttccagttttgcaaaagtcattttacaaaataaaatgacaaggatggtattcctcttttactgtatcggtttacacggactcgtattcatgatgagcatgtatgtgattaatattagcggctacatgacacctgaggttggtatagtacaatcggcaaagtcttcttcaaatctcaacggaggacttgggggagcagaaaaagtagctgcaggcgttggttcagttcatggcataaatcgatag

SEQ ID NO: 7736 - protein, 679 aa, Saccharomyces cerevisiae
MDTSVYSHALDIWAKADLTNLQRELDADVIEIKDKETLSLNSRKSLATETKKFKKLEPEEKLNNVNKIIKQYQREIDNLTQRSKFSEKVLFDVYEKLSEAPDPQPLLQSSLEKLGKIDDSKELKEKISYLEDKLAKYADYETLKSRLLDLEQSSAKTLAKRLTAKTQEINSTWEEKGRNWKEREADLLKQLTNVQEQNKALEAKISKNIDIEGNGNEDGDQENNQKEVSTRIAEYNLVTQELETTQARIYQLEKRNEELSGALAKATSEAEKETELHAKELKLNQLESENALLSASYEQERKSTSHAINELKEQLNSVVAESESYKSELETVRRKLNNYSDYNKIKEELSALKKIEFGVNEDDSDNDIRSEDKNDNTFESSLLSANKKLQATLAEYRSKSTAQEEERNELKKSVDQLKQQIATLKEANEKLETDLEKVENVSPHFNETASMMSGVTRQMNNRTSHKMSPTSSIIGIPEDGELSGNQSTILPIVTKQRDRFRSRNMDLEKQLRQGNSEKGKLKLEISKLKGDNTKLYERIRYLQSYNNNNAPVNQSTERIDVESQYSRVYDESLHPMANFRQNELNHYKNKKLSALEKLFSSFAKVILQNKMTRMVFLFYCIGLHGLVFMMSMYVINISGYMTPEVGIVQSAKSSSNLNGGLGGAEKVAAGVGSVHGINR

SEQ ID NO: 7737 - DNA, 1995 bp, Oryza sativa (japonica cultivar-group)
  CDS (1)..(1995)
atggaggcctcgccggccgcggcggagcgcgaccgctcgccgccgccgccgccgcctcccccgcccccttcctcgtcggccgccgccgcagcggcgatgtcgtcgccgctcgccgtcgtctccagcttctggaaagactttgatctggagaaggaaagaggtggtttggatgagcagggtttaaagattgcagagaatcaagagaccagccagaaaaacagacgccggcttgctgagagcactagggatttcaagaaggcgtcttcagatgataagcttagtttattcaattctttgctgaagagttatcaagaggaagttgataatctcacaaagagagcaaaatttggagaaaatgcatttctcaacatctaccagaagctctatgaagcccctgatccatacccagctcttgcttctatggctgagcaagatcagaaactatctgaactggagactgaaaatcggaagatgaaacttgagcttgaagagtaccgggcagaagccgcccacctaaagaaccaacaagcaacaattaggcgacttgaggagcgaaaccgccaactagaacaacagatggaggaaaaagtcagagagatggttgaaatgaagcagaggagtttggcagaagatagccagaaaactcttgaagccctgaaagacagggagcgggcattgcaggaccagctaagacaagccacagaaagtgtaaagaatatgcagaagctacatgaatcagcacaaagtcaattgtttgagcttcgtactcaatcagaggaggaccgggctgcaaaggaaactgaagtcaatcttctgttggatgaagttgaacgggcccaagcacgtttagttagtcttgagagagaaaagggtgatttacgatctcagttgcaaacaacaaatgaagatgcaaccaatagtagtgactacgtggactcaagtgatatacttgagagttccttgaatgccaaggagaagatcatctcagagctgaatgcagaactgcgtagtattgaaaatactttatcttctgagagagaaacacatgttaatgaactgaaaaagttgactgctttgctcagtgagaaggaaaatgctctgacagagttgaagaaagaacttcaagaaagaccaacaagaagactagtagatgatctcaagaaaaaggttcagattttgcaggctgtagggtacaactccattgaagctgaagattgggagctagcaacaaatggtgaagaaatgagcaagttggaagctttgcttcttgataagaaccgtaaaatggagcatgaactaacacagctgaaggtcaaaatatcagagaagtcaaatcttcttgaggaggctgaaaaaaagattgctgagctaactgcaaaggctgaagagcagcagaagttgattttgaaactcgaggatgacatactaaagggctatagttcaactgataggaggacttcacttctgaatgattgggatcttcaagaaattggctcaaatgaagtagcagagggtactgatccaaggcatgcaccacaagaccaagaccaaagttccatgcttaaggtcatttgcaatcagagggatcgtttccgtacacgtctacgtgaaactgaggaggaactaagaagactaaaagagaagtatgaaatgctagttgtagaattggaaaaaactaaagcagataatgttcaactgtatgggaagattcgttacgtgcaggactacagccatgagaagattgtttccagaggaccaaagaagtatgcagaagatgttgaaagtggttcttcagatgttgagacgaagtacaagaaaatgtatgaggatgacataaatccttttgctgctttttcaaagaaggaaaaggatcaacggtacaaggaacttggtttaagagacaaaatcactcttagcagtggacgttttctccttggtaacaaaatgtcagctttgagctatctcagatatggagacggggtggatgggaaatga

SEQ ID NO: 7738 - protein, 664 aa, Oryza sativa (japonica cultivar-group)
MEASPAAAERDRSPPPPPPPPPPSSSAAAAAAMSSPLAVVSSFWKDFDLEKERGGLDEQGLKIAENQETSQKNRRRLAESTRDFKKASSDDKLSLFNSLLKSYQEEVDNLTKRAKFGENAFLNIYQKLYEAPDPYPALASMAEQDQKLSELETENRKMKLELEEYRAEAAHLKNQQATIRRLEERNRQLEQQMEEKVREMVEMKQRSLAEDSQKTLEALKDRERALQDQLRQATESVKNMQKLHESAQSQLFELRTQSEEDRAAKETEVNLLLDEVERAQARLVSLEREKGDLRSQLQTTNEDATNSSDYVDSSDILESSLNAKEKIISELNAELRSIENTLSSERETHVNELKKLTALLSEKENALTELKKELQERPTRRLVDDLKKKVQILQAVGYNSIEAEDWELATNGEEMSKLEALLLDKNRKMEHELTQLKVKISEKSNLLEEAEKKIAELTAKAEEQQKLILKLEDDILKGYSSTDRRTSLLNDWDLQEIGSNEVAEGTDPRHAPQDQDQSSMLKVICNQRDRFRTRLRETEEELRRLKEKYEMLVVELEKTKADNVQLYGKIRYVQDYSHEKIVSRGPKKYAEDVESGSSDVETKYKKMYEDDINPFAAFSKKEKDQRYKELGLRDKITLSSGRFLLGNKMSALSYLRYGDGVDGK

SEQ ID NO: 7739 - DNA, 1902 bp, Schizosaccharomyces pombe 972h-
  CDS (1)..(1902)
atggcagttgcttcagaagctttactccaaaagctaacggagtcatggaaaaattcgcggtttgaggaattacaacgggaagcagatgaagctgcagcagaaattgagaagatgcaaaagacatctttggatgaaaggaaagagctttcgtcaaaaacgaaggaatttcgcaagcagcctgatgaagtcaagctaggcgaaatgaagggccttttaaagctttatcagtctggaatcgattctttgaccaaacgagcaaagtccgctgaagcaacattctttcgagtgtatgaaacactaggcgaggttcctgatccctaccctttgctgattgaggctgcgaacaaccttaaaactcaaaaacagattgaagatttaaaaaaggaaaaggaagaaatggaaggctcgctacagggtaaggaaaagctggaacgtgaagtggaaaatttacgaaaagagcttgacaaatacaaggaccttgtagagactgaagcggaaaagcgtgccgcaatcacaaaagaagaatgcgaaaagtcttggcttgagcaacaaaagctatataaagacatggaacaggaaaatgctagtacgattcaaaaattaacttcaaaaattcgggaattacaagcatcacaactagatcatgatttacaggccagtcagaatgaatcagcagggttggacgttaatgccaaatctgccgaagtgaatgctattctttctgaattggatgatgctaacaaaatcattgtcgaattgcaagcagaaattgctgtgctcaagcaaaacaccaaagagcaaaagagcgggtcgtcacaggatgacctgagtaaccagcagaaacaacaattggattttatggattctcttaataaaaaattgtctactgaattggaatcaataaaggaagcatcaagaaaagaaatggaaacacattgtgccaccattcaaacgctggaaaatgaagttaaagaggcccgcaaagttaaagaagaaagcttaacattggccaataaattttcggattacgacgagattaaacgagaactatctgttttaaaacaaattgaatttagtggagaacatgcgactcatgaaaacacttctctagagtctcaattactcaagcgcgaaaagcaactatctgaggagttggccaagctacgctccacaaatgcccagttaactgatagaattactcaagagtcgaagaaggcttcatttttggaacaaaaagcttctgaacaagaggaggtaattcgaaaactagagaaagaccttgccgatgttgatgttgagggaagtgtttacttgtccaacaccacctatcgccgtgaaggaactagcggtcaactttctccaacatcgtcaatcatgggtggcaatcctagtttatttaacggaagcgtgttgtcaaggaattcagttaacgaaactggttctgccattgttgacgttatcaaacagcaaagagatcggttcagacgtgcgaatgtaactttagtaaaccaagtgagtgctgcaaatgacaagattgcattattggagagtaaattggaggaggtggaaaagagcaacacccttctttatgaacaaatgcgttttcgcgaccattatcagaagcatgttgagcctagctcttctcacctccaaactgccgcagcctacgaaaacagcatttcaccgtttgcctcgtttcgtaaaaaagaggctgaaagagcttattcgagaatgggttcttttgagcgaatagtgtatgctttattacgcaccttgttattcagcagagcaactagggggttatttttcatgtatctaatacttttgcatcttttcattatgattgttcttttaaaattgggaatcgctggcaataccgcatatactcctatgaattattga

SEQ ID NO: 7740 - protein, 633 aa, Schizosaccharomyces pombe 972h-
MAVASEALLQKLTESWKNSRFEELQREADEAAAEIEKMQKTSLDERKELSSKTKEFRKQPDEVKLGEMKGLLKLYQSGIDSLTKRAKSAEATFFRVYETLGEVPDPYPLLIEAANNLKTQKQIEDLKKEKEEMEGSLQGKEKLEREVENLRKELDKYKDLVETEAEKRAAITKEECEKSWLEQQKLYKDMEQENASTIQKLTSKIRELQASQLDHDLQASQNESAGLDVNAKSAEVNAILSELDDANKIIVELQAEIAVLKQNTKEQKSGSSQDDLSNQQKQQLDFMDSLNKKLSTELESIKEASRKEMETHCATIQTLENEVKEARKVKEESLTLANKFSDYDEIKRELSVLKQIEFSGEHATHENTSLESQLLKREKQLSEELAKLRSTNAQLTDRITQESKKASFLEQKASEQEEVIRKLEKDLADVDVEGSVYLSNTTYRREGTSGQLSPTSSIMGGNPSLFNGSVLSRNSVNETGSAIVDVIKQQRDRFRRANVTLVNQVSAANDKIALLESKLEEVEKSNTLLYEQMRFRDHYQKHVEPSSSHLQTAAAYENSISPFASFRKKEAERAYSRMGSFERIVYALLRTLLFSRATRGLFFMYLILLHLFIMIVLLKLGIAGNTAYTPMNY

SEQ ID NO: 7741 - DNA, 2286 bp, Magnaporthe grisea 70-15
  CDS (1)..(2286)
atggccgaagctgccccttccacctcccgaacctctgcgggcgggacggagaacgcaaacaagtttcaacatgccatatccgcctggaggaccgtcgacctcaccaatctggtctcagggctggacaataccgcatccgagattgtcacctatcagcgcgactcggttgttcaacgcaaagatctagcacaaaagacgaaggacttcagaaaactagacgatgccagcaagttggcagagatcaagggcttgctcaaagcatatcaaacgtttattgacctccttacgaatcactccaaatcaatcaattcttccttcatacaagcatacaacgctctttccgaagcccccgatccatacccgctcctcgaggctgcagtggactcgatgctcctgacagaggacacccttcccaagttgactgaggagaaccaacatttgcaaaagacagtcactcagctgacttcgcagcttgatgatactgaatctcgcctgcagacggagcgcgccgcgcgcaaagaactggaggacaacctcgaatccagagtcaaggaggtagagaccacatggatcgcagtagtggacgaaaagaaggataactgggctgccaaggaaaaggctttggaggagaaacttgagaaccaggaacggttactgagtggcattcgggccacagaggaggtcaatgagcggcttggcaagtctacgagcgatgcagatgagtctcagcaaagatcatacgtcatgggcgctgagcttgagatggtcaattctgaactggaacgcacaagtgctcgtttggccgaggtcgaggctcgcaacgagcagctacgtctcgagcttgcggaacaggccaagaagtcacaaagcagcaaccagctccagaaccaacaactcgaagatgacccggcgtacatgcgtatgcgctcagagaactcgtcgctgatgcgcaaactggacgcctcgcgagtcgaaaaggaatcgctcaggcgcgaccttgatacacgcatgcgcggactcgagcgtgaggtggctttgcttcgggaggagcgggaaaacttgcgtgcaaaggtgcagaagtggagtgattacgaagacataaagcaggagcttgaggtgctaaagagcattgagttcgccatgggtgacgaagatgatgtccaaggcggccaggacgatgacactggtgctgacgcttccaataccggcaagggcaagggagacacactcgagcagcttttgttggcgagaaacaagaagctcagcgatgagcttaccattctgagagtttcgcaccaagatcttcagacacgactttcggatctacaagaagaactctcaaggacgaatgcggagctggaaaggtcacagaacttgaacgaaaagcttgagaatgacctctcgacgctccaggctgagggggctaatgctttcccgtcaggcgcatcggtggctgggacttatgtgaaccgatatgcgccttctatggctggcagtcggaggcctggggccgggggcggacggacaagccctacctcctcaatcatcagtggcttcgcatccggcggaggtggcctgggcagtgagcgcgacccgatgggtggcggctctggtatcttgccaatgatcactgctcagcgtgacagattcaagaaacgaaacgcacaactcgaacaggagctctccgagacacaccgcaacatctcacagctaaggcaggagattgctgccctgcaaaaggacaacttgaagctgtacgaaaaatcccggtatgtgcaaagctacaaccgaggcggcgggatgcaccccacggcggcggccggagcctcgcccatgatgggcggcgccgtgagctcctcatcctcagccttctcagccaatcccaacccgtcgacgatatcaattggtggtgggagtatcaatgggcccatagctctggaccaataccgaaaggcatacgagtccaacttgagcccgtttgcggcgttcaggggccgggagtcggcgcgcgcctacaagcgcatgtcacttcctgaacgagtcgtctattcgattacacgtatggtgcttgccagccgcaccagtcgcaacctctttgcggcgtactgtctggcgcttcatttgctggtcttcatgtcactctattggctcggtactgtagatgtcgagaaccacgccagcaacctcggcggcgcggcggctgcggcggcagcagctggtcatggagcaaaaggagcagcagccgcgcatggagactggcacagtgacgattttaaggggacataa

SEQ ID NO: 7742 - protein, 761 aa, Magnaporthe grisea 70-15
MAEAAPSTSRTSAGGTENANKFQHAISAWRTVDLTNLVSGLDNTASEIVTYQRDSVVQRKDLAQKTKDFRKLDDASKLAEIKGLLKAYQTFIDLLTNHSKSINSSFIQAYNALSEAPDPYPLLEAAVDSMLLTEDTLPKLTEENQHLQKTVTQLTSQLDDTESRLQTERAARKELEDNLESRVKEVETTWIAVVDEKKDNWAAKEKALEEKLENQERLLSGIRATEEVNERLGKSTSDADESQQRSYVMGAELEMVNSELERTSARLAEVEARNEQLRLELAEQAKKSQSSNQLQNQQLEDDPAYMRMRSENSSLMRKLDASRVEKESLRRDLDTRMRGLEREVALLREERENLRAKVQKWSDYEDIKQELEVLKSIEFAMGDEDDVQGGQDDDTGADASNTGKGKGDTLEQLLLARNKKLSDELTILRVSHQDLQTRLSDLQEELSRTNAELERSQNLNEKLENDLSTLQAEGANAFPSGASVAGTYVNRYAPSMAGSRRPGAGGGRTSPTSSIISGFASGGGGLGSERDPMGGGSGILPMITAQRDRFKKRNAQLEQELSETHRNISQLRQEIAALQKDNLKLYEKSRYVQSYNRGGGMHPTAAAGASPMMGGAVSSSSSAFSANPNPSTISIGGGSINGPIALDQYRKAYESNLSPFAAFRGRESARAYKRMSLPERVVYSITRMVLASRTSRNLFAAYCLALHLLVFMSLYWLGTVDVENHASNLGGAAAAAAAAGHGAKGAAAAHGDWHSDDFKGT

SEQ ID NO: 7743 - DNA, 2169 bp, Gibberella zeae PH-1
  CDS (1)..(2169)
atgagcgacgcagctgttgaagccgctctggcatccacacctgagcccgttgcgcctgcgccaacctttgaaggagagaacaaatttcaacatgcgatctcagcatggaggacaatcgacctcacaactcttgtctcgaacctagataacactgcttccgacattgtcgcctatcaacgtgactcaactgttcagcgtaaagaactggcacaaaaaacgaaggagttccggaaactcgatgattcttccaagttgacagaaatcaagggcttgttaaaatcttatcagaccttcatcgatcttctcacgaaccattccaagtctgtcaactcggcctttctgcagacatatgcctctttctccgatgcgcccgacccatacccactccttgaggcctcggtcgactcgatgctccttgctgaggatactttaccgaaaataacagaagaaaaccaacacctgcaagaaaatgttacaactctcacgactcagttagaggatgtcgaatcaaagctacagactgagcgaaaagctcgaaaggatttagaagagaacctcgagaaacgtgtcaaggaagttgagacatcatggactgctgtcctagacgagaagacggacaattgggaggccaaggaaaagagcctggaggataaggtcgagaagcaagagcgcctgttgactgagatgcgtgcaagctatgaagtcaaccaacgattgggcaagaatggcgaagaacaagagacccagcgcaaccaggtctcaagtgccgagcttgagatgcttcactccgacttggatcgtacgagtgctcgtctcgctgagattgaagcccgtaacgagcagatgcgtctagagctcgcgcaggccaagtcatcagcccagcagcaacctgaaacaaaccttgaagacgacccaggttacatgcgcgtcaggtcagagaaccaatctatgattcgcaaactggatgctgctcgcgtggagaaagaaggcctcaagcgagatttggacggcaaactacgatctatcgaaagagaggtgaatgctctaaaggaagagagggacacattgaagaataaggtgcaaaagtggggcgattatgatgagataaaacaagagctcgaggttttgaagagtatcgagttctctacaggtgacgacgatgaggtacgagagcatctcgagtcaaaggattctgagggcaactccctggagaaacttctcttggcacgcaacaagaagctcggcgatgaattgacagttctgcgtgtctcgcacaacgacttacagagtcgtctggaggatcttcaagaagaactctcaagaacaaacgcagaattggagcggtctcagaagctcaaccagaagttggagactgatttagagacaatccaggaggagggggccaatgcattcccgtccggagcatccgttgctggaacatatgtcacacgagcagttggacgcaagagtggtagaatttctccaacatcatcgatcatcagtggtatggatcctcgaatgggaggtggcgagcctggcgagcgagtctacggcggtggctcgggcatgctgccaatggtcacggcccagcgcgaccgttacaagaagaagaacggtgaattggaggaagaactgtccaacacacaccggacagtgtcacaactgcgccaggaggtcgcagcactgcaaaaggataacctaaacctctatgaaaagacaagatacgtctcgacatacaaccgagggggtggagcagcaacatcgtctgcgtatggcgcaaaccccaacccgtcgacggtgtcgattggcgaaacaggtaatcctggaatcgccatggatcgataccggcaggcatacgagtccaatatctctccatttgcagctttccgcgggcgggaatctgctcgagcctacaagcggatgagtctaccagagcgggcagtttattcgctgactcgtacagttcttgcttcaagaaccagtagaaacctgtttggagcatactgcgtggcacttcatttgctggtcttcatgtgcttgtactggatgagttcgtcggatgtccagcgggtaacccatctcgagtctgcagcggcagcggcagcgggagtggccgggggctcacttggcagtccaatggacggagcgcctaaagatcccgccaagtag

SEQ ID NO: 7744 - protein, 722 aa, Gibberella zeae PH-1
MSDAAVEAALASTPEPVAPAPTFEGENKFQHAISAWRTIDLTTLVSNLDNTASDIVAYQRDSTVQRKELAQKTKEFRKLDDSSKLTEIKGLLKSYQTFIDLLTNHSKSVNSAFLQTYASFSDAPDPYPLLEASVDSMLLAEDTLPKITEENQHLQENVTTLTTQLEDVESKLQTERKARKDLEENLEKRVKEVETSWTAVLDEKTDNWEAKEKSLEDKVEKQERLLTEMRASYEVNQRLGKNGEEQETQRNQVSSAELEMLHSDLDRTSARLAEIEARNEQMRLELAQAKSSAQQQPETNLEDDPGYMRVRSENQSMIRKLDAARVEKEGLKRDLDGKLRSIEREVNALKEERDTLKNKVQKWGDYDEIKQELEVLKSIEFSTGDDDEVREHLESKDSEGNSLEKLLLARNKKLGDELTVLRVSHNDLQSRLEDLQEELSRTNAELERSQKLNQKLETDLETIQEEGANAFPSGASVAGTYVTRAVGRKSGRISPTSSIISGMDPRMGGGEPGERVYGGGSGMLPMVTAQRDRYKKKNGELEEELSNTHRTVSQLRQEVAALQKDNLNLYEKTRYVSTYNRGGGAATSSAYGANPNPSTVSIGETGNPGIAMDRYRQAYESNISPFAAFRGRESARAYKRMSLPERAVYSLTRTVLASRTSRNLFGAYCVALHLLVFMCLYWMSSSDVQRVTHLESAAAAAAGVAGGSLGSPMDGAPKDPAK

SEQ ID NO: 7745 - DNA, 1983 bp, Candida glabrata CBS 138
  CDS (1)..(1983)
atggatggttctgtgtatcaccatgcggcagacctttgggcaaaagccgacttgactaacttgcaaaaggatctggatacgtcgattctggcaataaaggatagagagtcaagttctttagaatcgagaaagcaccttgcaagtgagaccaaagttttcaagaaactagagtcggatgagaagctcaatggtatcaacaagattatcaaacaataccagcaggaaatcgacagtttgacgaaaagagctaagagtgcagagcaagacttgcttgatttctactcaaagatatcagaagcccctgatcctttacccttattaaaaaattcggcggataacgtggaaaagattgaagattcagataaattgaatggtaaaattactgagttagaagataagctggcgagatgcgctgactacgataagatcaaagagagattatctgatttggaacaaagttcagtgaagacacttgcaaaaagactagcagccaaggagcaagagttaaattccacttgggaggaaaaacagagaaactggagtgagaaggaaaaggaattatccaaacagattaccatattacaagacaataataaagccttagaagctaccattgccaagaagattgatatcgaaggtggtgaaactactagtacgggtactccttcgtcaatggactttagtgcttctactgagagaaatcttcttatgcaggagctagaatcttctcaatcccgagtattccaattagaaaagagaaatgaagagttgagtggtaaattagctaaggcaaccagtgaagctgaaaaggaatcagatttagctgcaaaacaacagcaaatcagtcaattggaaagtgaaaatgccttgattatggcatcttccgaaagggagcgtacaaatttaaataatataaccagagaacttcagcaaaaagtggataatctgaagactgaatcggtatcgtataaaaatgaattagaaacgctcagaagaaaggtcaatactttctctgattataatgaaattaaaagtgaacttgaagctcttaagaagattgagtttggagctagtgatgatgctgatgatgaagatgaccagaaccaagagtctaataaggttcaaaagagtctaatgaatgctaataagaaactgcaagcaacattggtagagttgagaactgaaaatataagtcaaaaggaactaaactcaaagctacaaaaagaaatcgcacaattaactgataaactgggtgaactggaagaggctaatgctaaactcgagattgacctgcagcagattgaagatattgatcaaaagtttaatgatacagcaagcatggtatcaggagcgacgagacagatgaacaatagaacatcgaagggaagaggaaagttatctcccacaagttctattgttggtatacctgaagaaggcgagtatgagcctatgcaaaacactgccattttaccaattattacaaagcaaagagatagattcagaaatagagctacagatttggaaaagcaactacgtcaattgaatcaggataagggtaaactaagacaggaaatgcaaatactaaaggctgaaaatactaaactttatgaaaaggtacgctacctaactaacaatcaaaattcttctacaattggagtttccagtttagatacagaggctcaattgtctcatagttatgacgagtcattgaaccctctttcaaaatttaagaagactgaaagagattattatctcaacagacatctatctgtatgggagaaactcttttcaacgtttgcgaaaattgtccttcaaaataagtctactaggctaattttcttactatactgtgtgtgtctacatggattagtattcatgatgtcgatgtatgttattaacataagcggttatctcaccccagaggtcaatgtcgtgcaaacatcggcttcaaagattggtaacgcggttgataaaaatatataa

SEQ ID NO: 7746 - protein, 660 aa, Candida glabrata CBS 138
MDGSVYHHAADLWAKADLTNLQKDLDTSILAIKDRESSSLESRKHLASETKVFKKLESDEKLNGINKIIKQYQQEIDSLTKRAKSAEQDLLDFYSKISEAPDPLPLLKNSADNVEKIEDSDKLNGKITELEDKLARCADYDKIKERLSDLEQSSVKTLAKRLAAKEQELNSTWEEKQRNWSEKEKELSKQITILQDNNKALEATIAKKIDIEGGETTSTGTPSSMDFSASTERNLLMQELESSQSRVFQLEKRNEELSGKLAKATSEAEKESDLAAKQQQISQLESENALIMASSERERTNLNNITRELQQKVDNLKTESVSYKNELETLRRKVNTFSDYNEIKSELEALKKIEFGASDDADDEDDQNQESNKVQKSLMNANKKLQATLVELRTENISQKELNSKLQKEIAQLTDKLGELEEANAKLEIDLQQIEDIDQKFNDTASMVSGATRQMNNRTSKGRGKLSPTSSIVGIPEEGEYEPMQNTAILPIITKQRDRFRNRATDLEKQLRQLNQDKGKLRQEMQILKAENTKLYEKVRYLTNNQNSSTIGVSSLDTEAQLSHSYDESLNPLSKFKKTERDYYLNRHLSVWEKLFSTFAKIVLQNKSTRLIFLLYCVCLHGLVFMMSMYVINISGYLTPEVNVVQTSASKIGNAVDKNI

SEQ ID NO: 7747 - DNA, 1968 bp, Kluyveromyces lactis NRRL Y-1140
  CDS (1)..(1968)
atgaatttgtctacatatgagcatgcgttgtcattgtggaaagaagctggcttcagcagtatacaatcgttacttgatgatagcatagctaagataaaggatttagaaacttcatccttggaatcaagaaaaacgttagccagtgagaccaagaagtacaagaaattgccagatgatgagaaacctagccaatctttgaaattagtgaaagaataccagaaggagattgattcgttgactaccagatcaacgttctccgaaaaggttgttatcgaattatatgagaagttaattgaacaaccggacccaacagggatcctagagtctattgtagaggaactgaagaaagatggcacaaatgtcgatgatatcaaagctgaaaaccaaaaattggcggcaattgttagcaagtgtgccgattatgacactttaaagaaaagattatcggatcttgaacaaaattcggctaagacattatccaatagattaatcgccaaagagaaagaaattacatccaaatgggaagaaaagcaacgtaattggaataatagagaggacgaattattgaaacagttagaaacgttgaaaaataccaatagcatcttggaaaagaaaataggtgctcaggtcgatttggagcaacaagaagatggcgatgatgacaccgttctcgttagtggaaagaatagcgctcaaagtgagcttctggtacaagaacttgaggctgcacaaattcgtatcatgagtcttgaatcacgtaatgaagaattaaattctgaggtaaccaaattgaagagcgatgaacaacaggattccatatttcaagagaaagagactaaattgaaccaattggaaagtgaaaatgctaaattggttacatgtttagaagaagaacgcaagagtttgaaggaaacatcccaaacgttgagctcacaattgaaatcatctgcacttgaaacgcagacttataaatcggaattagagacattgagacgcaagttaacgaactactcagattatgaaaaaataaagcaagaattgaatgccatgaagaagattgaattcggaaccagtgatgacagtgacaacgaaaacgatgatggtgatgactctatcaccagttcattgaaacatgcgaaccaaaaactccaaaataatttggtgaaggccaatactgaaaagaacaaatatatgaacgaaacccaaacgctcaagaaaagcatagaagctttatattctaagattcaaaatctagaaactttgaatgcgaaattagaagcagacattgagaaggtcgaagatgtaacgaaccaattctccgatacacaatcaatgatgtcaggggcaacaaggcaaataagtaatagacatgccactaacgaaaaactatctcctacaagctcaatcattggaataccagaagaaaaagaactagataccttctccggcaattttaacggctctccatctatcctaccaattgtcaccaaacagagagacagattccgctcaagaaatctagagcttgaaaggcaaataaagcattgtaaccaagaacagacgaaacttaaggtacaagtgaaggaattaaaggccgataattccaaattgtacgagaaggcaaagctactaagttcgtattcgaacaattccgcagtgcgcaatacagtagatttggaatctccattttccgaagaatatgaggagtcattacatccattatctagtttcaaagaaagagagctagaaagatacgaacgacgtaagatgccacccttggaaagactattcttgagttttgcaaaagttattctagcgaacaaacagacaagaatgctattcatgttgtattgccttggattacatggattggtgatggtgatgactatatatgtcacaagtttcaccaactacataactccagacgttagctcctcatcaggtagtatgattaacaccaatcagtga

SEQ ID NO: 7748 - protein, 655 aa, Kluyveromyces lactis NRRL Y-1140
MNLSTYEHALSLWKEAGFSSIQSLLDDSIAKIKDLETSSLESRKTLASETKKYKKLPDDEKPSQSLKLVKEYQKEIDSLTTRSTFSEKVVIELYEKLIEQPDPTGILESIVEELKKDGTNVDDIKAENQKLAAIVSKCADYDTLKKRLSDLEQNSAKTLSNRLIAKEKEITSKWEEKQRNWNNREDELLKQLETLKNTNSILEKKIGAQVDLEQQEDGDDDTVLVSGKNSAQSELLVQELEAAQIRIMSLESRNEELNSEVTKLKSDEQQDSIFQEKETKLNQLESENAKLVTCLEEERKSLKETSQTLSSQLKSSALETQTYKSELETLRRKLTNYSDYEKIKQELNAMKKIEFGTSDDSDNENDDGDDSITSSLKHANQKLQNNLVKANTEKNKYMNETQTLKKSIEALYSKIQNLETLNAKLEADIEKVEDVTNQFSDTQSMMSGATRQISNRHATNEKLSPTSSIIGIPEEKELDTFSGNFNGSPSILPIVTKQRDRFRSRNLELERQIKHCNQEQTKLKVQVKELKADNSKLYEKAKLLSSYSNNSAVRNTVDLESPFSEEYEESLHPLSSFKERELERYERRKMPPLERLFLSFAKVILANKQTRMLFMLYCLGLHGLVMVMTIYVTSFTNYITPDVSSSSGSMINTNQ

SEQ ID NO: 7749 - DNA, 2151 bp, Debaryomyces hansenii CBS767
  CDS (1)..(2151)
atggcagaagaagataaagccagttcaaacccaggactagatacaaaaatttctaaagtcgaacaggtgcaagaaatcaaaggtaaatcgcaaacctcgacttcattccattctgcattacagacgtggacacaaattgatcttccttcgctacaaaagaaattggatgttcaagggttggagttgaaagatgatcaggcagactctttattacgtaggaaaaatttggccactaagaccaaagagttcagaaagttagaagaccctgacaaactcgatcaaattaaaggattactcaagttgtatcaaaatgaaattgactctttaacaaataagaagaaagacgtggagggctatttctttgggttttaccggttgttggcagaagcaccggatcctagacctctcttggaattatcgttggacgcggtaatcgcatcctctgagactgaatcattacggaaggaagtatcaaaattaaacgacgagttatcaaagaaggctgattatgatcaattgaaacagaggcttttgagaaatgaacagaaatcagcagaattgttaagttccaagttgcatgccaaagaagaagagttcaaggcattgattgatgaaaaacagagcaattggctcgaaaaagagaagaactatgaaaagcaaatgcacgagacgaaggcaaaagtggaggaattaagaacttccaaagaagtcaccgagttgcaattgacatcgcataataagcagcttggaagtacggaaacgaatgcgtctgcttctgtattagcagaattagaaatagtttcaagagatgcagaatcagctaagaaaagggtatttgaattggaaaagagaaatgaagaactcagacgagagttatctagatccaagagtgatgtcgaaagaaagaatttgaaggaagaatatgagaaaaaggtttcagagcttgaaggggagaatgctttattgattgctaatttagatcagcatagaaagaaattggatggcataactaaggaaaatgcaaacaagaccgattcattcaatagagaaatttctcaattgacgcaggaggttaagaattgtaaagaaaagcttgaaaaaacaggcgactacgacgaaataaagcgtgaattgtacttaataagacaaattgaattcggacatgacgaagatggtgttgaagatggggccgattctgacggaaccgataataaccgcaagcaaattgattcgctcttgattcaaagaaataaaaccttaactcagggattggccgatttcagatctcagcatgaggatttaactaacagaatcaaccatttggattctaagcttactaaggcaaatgaagaattagtcaaggcgcaggagttgaaccaaaggttagaaaatgacttagcaggtgtgcaagacggacaaaagtttaacgacaacatgagcatgatctcaggcgtgagtagaataaccccagggcgtccgaaaaatggaagtattgcatctttaaacacagtcggctcgtcacctgcgggtgatgtgtcatccatattaccaataattaccaaacaaagagacagatttagagataggaataatgagttggaagatgatctcaggaaacagtacaatattgttagcgatttgaagagacaaatgaacagccttaagaaagataatgaggaattatatgaaagaactagatatttggcatccttcaagaacagcaataatagtggatcaacagagacccagtcatttagctccagaacatctaatagaagacttctccagcctaaaccaaattcaattgatcttgagcgcaacccataccaagaaacgtacgaatccaaattgcaccccatcgaacaatttagagtccgcgaacaggaaagaattagttcaaagctttccccaatagagcgattatttatttcacttacaagagcaattcttgctactagaactaccagaatgctatttatggtatattgtttcggcctacactgtattgttatgtttataacaatttatgctatgggcttaagtacccgaatgattccagaagtgggtatgaataacagtacaggcggagttgcaaacggagtcgcaggaggccctgattccatagataatgtaactgaagctattccttag

SEQ ID NO: 7750 - protein, 716 aa, Debaryomyces hansenii CBS767
MAEEDKASSNPGLDTKISKVEQVQEIKGKSQTSTSFHSALQTWTQIDLPSLQKKLDVQGLELKDDQADSLLRRKNLATKTKEFRKLEDPDKLDQIKGLLKLYQNEIDSLTNKKKDVEGYFFGFYRLLAEAPDPRPLLELSLDAVIASSETESLRKEVSKLNDELSKKADYDQLKQRLLRNEQKSAELLSSKLHAKEEEFKALIDEKQSNWLEKEKNYEKQMHETKAKVEELRTSKEVTELQLTSHNKQLGSTETNASASVLAELEIVSRDAESAKKRVFELEKRNEELRRELSRSKSDVERKNLKEEYEKKVSELEGENALLIANLDQHRKKLDGITKENANKTDSFNREISQLTQEVKNCKEKLEKTGDYDEIKRELYLIRQIEFGHDEDGVEDGADSDGTDNNRKQIDSLLIQRNKTLTQGLADFRSQHEDLTNRINHLDSKLTKANEELVKAQELNQRLENDLAGVQDGQKFNDNMSMISGVSRITPGRPKNGSIASLNTVGSSPAGDVSSILPIITKQRDRFRDRNNELEDDLRKQYNIVSDLKRQMNSLKKDNEELYERTRYLASFKNSNNSGSTETQSFSSRTSNRRLLQPKPNSIDLERNPYQETYESKLHPIEQFRVREQERISSKLSPIERLFISLTRAILATRTTRMLFMVYCFGLHCIVMFITIYAMGLSTRMIPEVGMNNSTGGVANGVAGGPDSIDNVTEAIP

SEQ ID NO: 7751 - DNA, 1800 bp, Yarrowia lipolytica CLIB122
  CDS (1)..(1800)
atggaagacaaattcgaagctgcaatccaaaagtggacggagattgatctgctggggctgcagaaacagctggataaggagggcgagaccattgtggaggcacagacggactccgtggcgagccgaaaagagttggcctccaaaaccagagatttcaagaagctggaggacaacgacaagttggagggcatcaagacactgctcaaggcgtaccagggcgagattgatcggctgactcaacgagctcgcaactcggaaaccgccttcctcaacgtctacaagctgctagccgaagctccggacccaagaccgctgctggaagcctctagtgacgctgtgggtgtagcgtcaagccagagtcggctcattgctgagaatgccaagctcagcgaacaggttgcccgatatgccgactacgacactctcaaacaaaaggtgctgcggctggaaatgtccaatgccgagactgtggcggcaaaggtcaaggccaaacaacaggagatggaggccgcctttgacgaggagcgacggacgtggaagtctcgagaaaccgagctcacagagcaggtcaacgagtcccgtgaaatgggcaaggaactgagacgtaaggtcgagacttacgaagagaagctcggtgaggaagtggaggttcctaagacctccgccaccactgccatttcgtctgcagagatggagattgtcacttctgacctggagaaggcccagaggcgacttttggaccttgaggctcgaaacctcgatctcagaaagcagattgaggacaagcccgatgctgtggttgactcgtcgcttgaggaggaaaacaagggtctgcttgcccgtctggaggctgccaagcagcagcttcagtcggcttcagcctctgcccaggaggaggctgagcaattgaggaagacggtccagagaagagaagacgagactgcggctctcaaggcccgtctggcggctcagactgactacgacgagctgaagcgggaattggaggtgttccggtcggtggagttttcgcaggagtccgaagaccgagagtccctggagcacatgctgcttcagaagaacaaaaaacagcagtctgatctgacagtacttcgaaacaaaacaaaggagtatgaggagacgatcgccaagctcaccaagtcactacaggatgccaagacttcttacgataaggcatctacgttgaatgctcgtcttgagtccgacttgactacaacttctcttggatcagttgctggatccatcgcaccctcccgtcgaaccaccagaggaggccccagtggacgtctttcgcccacttcgtcgatcattggaggttatgatcgatctgtgcagtccggaggaggaggctcggatctgcttcccatcatcacccagcagcgagaccgtttcaaggagcgaatcgcgcagctggaagacgagctgagaaagaactttgccctcgtgtccgagcttcgtcaagaggctgcagtactcaagtcagacaacctcgagctctacgagaagactcgatacatggcatctcatgctgccagtggcacaaaggcgcccaccaccacaaataccgcatccaagtacagagatgcctacgaagaaggtctgacgccattccaacagttcagaggcagagagacagatagaatgtattcgagactgactccgattgagcgggtcacgctggcgttggccaagggcattttgagaaacagaatcacccgaaactgcttctcagcgtatgttttggcgttgcatattgttaccgtgatgcttgtggcagcatag

SEQ ID NO: 7752 - protein, 599 aa, Yarrowia lipolytica CLIB122
MEDKFEAAIQKWTEIDLLGLQKQLDKEGETIVEAQTDSVASRKELASKTRDFKKLEDNDKLEGIKTLLKAYQGEIDRLTQRARNSETAFLNVYKLLAEAPDPRPLLEASSDAVGVASSQSRLIAENAKLSEQVARYADYDTLKQKVLRLEMSNAETVAAKVKAKQQEMEAAFDEERRTWKSRETELTEQVNESREMGKELRRKVETYEEKLGEEVEVPKTSATTAISSAEMEIVTSDLEKAQRRLLDLEARNLDLRKQIEDKPDAVVDSSLEEENKGLLARLEAAKQQLQSASASAQEEAEQLRKTVQRREDETAALKARLAAQTDYDELKRELEVFRSVEFSQESEDRESLEHMLLQKNKKQQSDLTVLRNKTKEYEETIAKLTKSLQDAKTSYDKASTLNARLESDLTTTSLGSVAGSIAPSRRTTRGGPSGRLSPTSSIIGGYDRSVQSGGGGSDLLPIITQQRDRFKERIAQLEDELRKNFALVSELRQEAAVLKSDNLELYEKTRYMASHAASGTKAPTTTNTASKYRDAYEEGLTPFQQFRGRETDRMYSRLTPIERVTLALAKGILRNRITRNCFSAYVLALHIVTVMLVAA

SEQ ID NO: 7753 - DNA, 2199 bp, Aspergillus nidulans FGSC A4
  CDS (1)..(2199)
atggactctttcgccattacggagggcattattccccagtccgagaaacaagatgcccaagctcccgagtctgggctaggtccagctctacctgagggagccaacaagtttcagcgcgccattgcagcttggagaggtatcgacttgtccaatacccttgcgaaactagacagcaccgcttccgatatagttgccgaacaacgagacgcactggtacaaaggaaggatcttgcgcaaaagaccaaggatttccggaagctcgacgatgcttccaagttggcggaatacaagggtcttttgaaagcctatcaaggattcatcgacctcttaacaaaccaggggaagtcttcttcgtctgcgttcctccagttatactcgtccttgtccgaggcaccagatccgtatcctcttctcgaagcctcaatcgactcgctcgtcgtcgccgaagaaacggttcctaaattgacttctgaacgtgatcagctgcagagctcagtggaccgccttacttcacagttggaagacacggaacgacggcttgaagaagagcgagctgcaaggaagaagttggaggataaccaagacgcaaagatcaaagagattgaaacatcatggtcggcagttctgaccgagaagacgaacaattggacatctaaggaaaagagcttggaggagaaggtagagaaccaggaacgtttgattaaagagctcaaggcgagctatgaggtctcgcagcgcctaggccaaactgatgaaagcggcaaccacccccagggaggcgcaaccgctgccgaactggagttggtgtccagcgaattggaaaagactagcctgaggttggcagagatggagggacggaatgagcagttgaggcttgagctggctcaagctgtttctcattccaaggaggagcggacaacgtctatcgacgacgatcctggatatctccgcctccagtctgagaattcttcgctgttacgaaaactcgatgctgcgcgatttgaccgagagtctgaacggcacacttgggaggccaaacttttgcagtctgagaggcagttctccaaagtcaacgctgaaaaggaagagctgaagacaaggctggagaaggtggcggattacgaagacatccgtcgcgagctggagatgatcaagtctattgaattctcagctggtgacgacgaggaggccggtgatctcaatgatggtaccaatggcactgtagacaaggctaaagagggcggtaaaaatggctccctggaacagctactgttagcgagaaacaagaagctcaccgatgagcttactgttctgcgggtatcgcaccgtgatctacaaggccagcttgagactctccgcgaggatctttctaccactaaagaggaattggagaaatcgcaaaacctctctaccactctagagaatgatcttctccgcctgcaacaggaggcggcgaatgccttcccatcctcggcgatgtcagtggccggcacatatgtttcaaaatacccccattcttcacgaagaggcgtatcaccaacatcatcaatcatctccggcttcgatcaatcggccgcatctaacaatacgatggacgccatccgcgctggggaagcggttggtggaggatccggtcttttgcccatgatacaagcgcagcgcgaccggtttaagaagaagaacactgaactggaagaagaactatccaagctctatagcacagtcaaatctctcagacaagaagtcgcatctctgcaaaaggacaatctcaacctttacgagaaaacgagtgcgtcttctatccatacatccgccgatactccctcaggtttgtctatcgatcgctatcagtccgcgtacgaagctcaaatatccccgttcgctgccttccgggggcgcgaatccactcgcgcatacaaacggatgagcctgccggaacgggtagtattctcgctgacacgcatcatccttgcaaaccgtactagccggaacctctttgcagggtactgcttcgccctacacattcttctattcatcatgttgtatatgatgagtacaatggagattgaaagtcatagcgcagcaagcctcggtgcagcagcgggggctgcaatgaatgcagcaggcaatggtaatgcatatagcgggcagctcgatggcgacgactggcagcaggagggattcaatcacgctgggtag

SEQ ID NO: 7754 - protein, 732 aa, Aspergillus nidulans FGSC A4
MDSFAITEGIIPQSEKQDAQAPESGLGPALPEGANKFQRAIAAWRGIDLSNTLAKLDSTASDIVAEQRDALVQRKDLAQKTKDFRKLDDASKLAEYKGLLKAYQGFIDLLTNQGKSSSSAFLQLYSSLSEAPDPYPLLEASIDSLVVAEETVPKLTSERDQLQSSVDRLTSQLEDTERRLEEERAARKKLEDNQDAKIKEIETSWSAVLTEKTNNWTSKEKSLEEKVENQERLIKELKASYEVSQRLGQTDESGNHPQGGATAAELELVSSELEKTSLRLAEMEGRNEQLRLELAQAVSHSKEERTTSIDDDPGYLRLQSENSSLLRKLDAARFDRESERHTWEAKLLQSERQFSKVNAEKEELKTRLEKVADYEDIRRELEMIKSIEFSAGDDEEAGDLNDGTNGTVDKAKEGGKNGSLEQLLLARNKKLTDELTVLRVSHRDLQGQLETLREDLSTTKEELEKSQNLSTTLENDLLRLQQEAANAFPSSAMSVAGTYVSKYPHSSRRGVSPTSSIISGFDQSAASNNTMDAIRAGEAVGGGSGLLPMIQAQRDRFKKKNTELEEELSKLYSTVKSLRQEVASLQKDNLNLYEKTSASSIHTSADTPSGLSIDRYQSAYEAQISPFAAFRGRESTRAYKRMSLPERVVFSLTRIILANRTSRNLFAGYCFALHILLFIMLYMMSTMEIESHSAASLGAAAGAAMNAAGNGNAYSGQLDGDDWQQEGFNHAG

SEQ ID NO: 7755 - DNA, 2091 bp, Candida albicans SC5314
  CDS (1)..(2091): transl_table=12
atgtcaaacacagagacggaatcaaagaaaacagagggaggggatacatcttcccatgtatttggtaatgcattgcagacttgggtagaaattgatttaccatcattgcaaaagaaattggatgaacaagggatagaattgaaagaggatcaaaaagcttctttattaagcagaaagaacttggcttcaaaaacaaaagagtttaaaaaattggaagattctgagaaattaaatcaattcaaatctttattgaagttgtatcaaaatgaaattgataatttgaccaataagaataaaatggttgaaaactatttctttggaatttatagaagtttggcagaagcaccggatccacgtccactacttgaaatgtcattagactcggtaattgaatcaaaggaaactttgtcattgagaaaagaggtggataggttgaccgatgaattggcaaaacgtgccgattatgacaatttaaaacaaaggttgttacagaatgaacaaaaggcagcagagttattgagtttgaaattaaatgccaaagaagacgaattcaagtcgataatagatgaaaaggaatccaactggttagaaaaggaaaacaatttaaaagatcaaatcaaaatagcacaaagacagattgaagaattacgaacttctaatgaggtgactgaattaaaattggataatcaaaacaaacaaacaggaagggatggagtttcagcttctacattggcagaattggaaattgtaaccagagacgcagaggcatcgaagaaaagagtgtttgaattggaaaaaagaaatgaggacttgagacgtgaattgtcaaaatcacaaaatgatatcgaaattaaactgatcaaagaagattattccaaaagagtatctgaattggagggtgaaaatgtgcttttagtggccaatttaaatcaaacccgtaaaaaattacaagattctgataaagaacatgcattgaaaacagattcattaaatcgagatatctctagtatggaacttgagattaagaatttaaaggctcaattggacaaagcatctgactacgaggagatcaaaagcgagttacaattactcagacaaattgagtttggacatggagatgatgacgatgatgatgacgaaactggaaatgctaatgctaaagtggactcgatacttatagaaagaaacaaatcgcttacacaacaattggcagatcatagagcacaacatgacgatttgaattcaaagatagtgagtctagaagcacaagtagaatcatctttagcagaagttaacagactcagagagttgaatgaaaaattggaaaatgatttgaccaatcttcaagatgttactagcaacaacagattcaacgataatgcaagtttaatctcaggtatgaccagaatgactagaccgaatggtagaaacggaagtattatttctggacaaccaggcaacaattttggtagtggattggggattgtcgctgaggactcaccatcaattctaccaataataaccaaacaaagagatagattcagagaaaaaaacaacgagttggaggaagaactcagaaaacaacttaacctagtgaacgaattaaagagacagaacaattcattgaaaaaagataacgaagagttatatgaaaggacaagatatttggcatcatttcaaacaccagggacaagaaatattaccactacgtcatcaggaagaaaatttttgaatccaagaccaaatactgacatagaaagtaatccataccaacaaagctatgaatcgaaattgcatccaattgagcagtttagaatgagagaacaggaaagaataaattctagattgtctccgttggaaagattatttatatcgataacaagagcagttttggccaccagaacaacacgtatgttatttttagcatattgtttaggactacatattgtcgtcatgtttgtgactatttatgctatgaatttgctgactgcattgatacctgaagttggaaagaacacgagcactggtggaatagcttcaaataaagtaattagtgacgttctgtcaggaaaagtagcgaaccccttataa

SEQ ID NO: 7756 - protein, 696 aa, Candida albicans SC5314
MSNTETESKKTEGGDTSSHVFGNALQTWVEIDLPSLQKKLDEQGIELKEDQKASLLSRKNLASKTKEFKKLEDSEKLNQFKSLLKLYQNEIDNLTNKNKMVENYFFGIYRSLAEAPDPRPLLEMSLDSVIESKETLSLRKEVDRLTDELAKRADYDNLKQRLLQNEQKAAELLSLKLNAKEDEFKSIIDEKESNWLEKENNLKDQIKIAQRQIEELRTSNEVTELKLDNQNKQTGRDGVSASTLAELEIVTRDAEASKKRVFELEKRNEDLRRELSKSQNDIEIKSIKEDYSKRVSELEGENVLLVANLNQTRKKLQDSDKEHALKTDSLNRDISSMELEIKNLKAQLDKASDYEEIKSELQLLRQIEFGHGDDDDDDDETGNANAKVDSILIERNKSLTQQLADHRAQHDDLNSKIVSLEAQVESSLAEVNRLRELNEKLENDLTNLQDVTSNNRFNDNASLISGMTRMTRPNGRNGSIISGQPGNNFGSGLGIVAEDSPSILPIITKQRDRFREKNNELEEELRKQLNLVNELKRQNNSLKKDNEELYERTRYLASFQTPGTRNITTTSSGRKFLNPRPNTDIESNPYQQSYESKLHPIEQFRMREQERINSRLSPLERLFISITRAVLATRTTRMLFLAYCLGLHIVVMFVTIYAMNLSTALIPEVGKNTSTGGIASNKVISDVSSGKVANPL

SEQ ID NO: 7757 - DNA, 2088 bp, Candida albicans SC5314
  CDS (1)..(2088): transl_table=12
atgtcaaacacagagacggaatcaaagaaaacagagggaggggatacatcttcccatgtatttggtaatgcattgcagacttgggtagaaattgatttaccatcattgcaaaagaaattggatgaacaagggatagaattgaaagaggatcaaaaagcttctttattaagcagaaagaacttggcttcaaaaacaaaagagtttaaaaaattggaagattctgagaaattaaatcaattcaaatctttattgaagttgtatcaaaatgaaattgataatttgaccaataagaataaaatggttgaaaactatttctttggaatttatagaagtttggcagaagcaccggatccacgtccactacttgaaatgtcattagactcagtaattgaatcaaaagaaactgtgtcattcagaaaagaggtggataggttgaccgatgaattggcaaaacgtgccgattatgacaatttaaaacaaagattgttacagaatgaacaaaaggcagcagagttattgagtttgaaattaaatgccaaagaagatgaattcaagtcaataatagatgaaaaagaatccaattggttagaaaaggaaaacaatttaaaagatcaaatcaaaatagcacaaagacaaattgaagaattacgaacttctaatgaggtgactgaattaaaattggataatcaaaacaaacaaacaggaagggatggagtttcagcttctacattggcagaattggaaattgtaaccagagacgcagaggcatcgaagaagagagtgtttgaattggaaaaaagaaatgaggacttgagacgtgaattgtcaaaatcacaaaatgatatcgagattaaactgatcaaagaggattattccaaaagggtatctgaattagagggtgaaaatgtgcttttagtggccaatttaaatcaaacccgtaaaaaattacatgattctgataaagaacatgcatcgaaaacagattcattaaatcgagatatctctagtatggaacttgagatcaagaatttaaaggctcaattggacaaagcatctgactacgaggagattaaaagcgagttacaattactaagacaaattgagtttggacatggagatgatgacgacgaggacgaaactggaaatgctaatgctaaagtggactcgatacttatagaaagaaacaaatcgcttacacaacaattggcagatcatagagcacaacatgacgatttgaattcaaagattgtgagtctagaagcacaagtagaatcatctttagcagaagttaacagactcagagagttgaatgaaaaattggaaaatgatttgaccaatcttcaagatgttaccagcaacaacagattcaacgataatgcaagtttaatttcaggtatgaccagaatgactagaccgaatggtagaaacggaagtattatttctggacaaccaggcaacaattttggtagtggattggggattgtcgctgaggactcaccatcaattctaccaataataaccaagcaaagagatagattcagagaaaaaaataatgagttggaggaagaactcagaaaacaactcaacctagtgaacgaattaaagagacagaacaattcattgaaaaaagataacgaagagttatatgaaaggacaagatatttggcatcatttcaaacaccagggacaagaaatattaccactacgtcatcaggaagaaaatttttgaatccaagaccaaatactgacatagaaagtaatccataccaacaaagctatgaatcgaaattgcatccaattgagcagtttagaatgagagaacaggaaagaataaattctagattgtctccgttggaaagattatttatatcgataacaagagcagttttggccaccagaacaacacgtatgttatttttagcatattgtttaggactacatattgtcgtcatgtttgtgactatttatgctatgaatttgctgactgcattgatacctgaagttggaaagaacacgagcactggtggaatagcttcaaataaagtaattagtgacgttctgtcaggaaaagtagcgaaccccttataa

SEQ ID NO: 7758 - protein, 695 aa, Candida albicans SC5314
MSNTETESKKTEGGDTSSHVFGNALQTWVEIDLPSLQKKLDEQGIELKEDQKASLLSRKNLASKTKEFKKLEDSEKLNQFKSLLKLYQNEIDNLTNKNKMVENYFFGIYRSLAEAPDPRPLLEMSLDSVIESKETVSFRKEVDRLTDELAKRADYDNLKQRLLQNEQKAAELLSLKLNAKEDEFKSIIDEKESNWLEKENNLKDQIKIAQRQIEELRTSNEVTELKLDNQNKQTGRDGVSASTLAELEIVTRDAEASKKRVFELEKRNEDLRRELSKSQNDIEIKSIKEDYSKRVSELEGENVLLVANLNQTRKKLHDSDKEHASKTDSLNRDISSMELEIKNLKAQLDKASDYEEIKSELQLLRQIEFGHGDDDDEDETGNANAKVDSILIERNKSLTQQLADHRAQHDDLNSKIVSLEAQVESSLAEVNRLRELNEKLENDLTNLQDVTSNNRFNDNASLISGMTRMTRPNGRNGSIISGQPGNNFGSGLGIVAEDSPSILPIITKQRDRFREKNNELEEELRKQLNLVNELKRQNNSLKKDNEELYERTRYLASFQTPGTRNITTTSSGRKFLNPRPNTDIESNPYQQSYESKLHPIEQFRMREQERINSRLSPLERLFISITRAVLATRTTRMLFLAYCLGLHIVVMFVTIYAMNLSTALIPEVGKNTSTGGIASNKVISDVSSGKVANPL

SEQ ID NO: 7759 - DNA, 2271 bp, Ustilago maydis 521
  CDS (1)..(2271)
atggcggcagcaacagcagcagcagcgccgtacaccatcgatggtgctggtccaagcagatcccccgtcgacttttccgcagcattgtccatttggcgagacatcaacctcgtcgatcttcagcaacaactcagcaccaccgcgcccgaactgttcgaagcgcagaaggcagccgtctccaatcggaaaaagctcgccgatcagacacgagaattcaaaaagcaacctgatgctaacaagctggaaagcttcaagcccctgctcaaggcctaccagaccgagatcgatacgttgaccaaacgttccaaagcagcagagaatgcctttctcaacgtgcactcggctttgacaaacgcgcctgatccatatccgcttcttgaggtcacgctggaacaagcagcatcgctcaatgatctcgagagcctgaaacacgagaatgcaaagctgcaaaccgatctcgcacgcagcgctgctgaggctcaggtcagccaggagagagaagctgagaatgctcgattgcagcagcgtctgcgctcactcgagcaggattttgaggcaaaagtacagcagcgaacgtccgcatttgaactcgaattatcggcaaagtgggacgagaggatacacaacctgaaggagcgagaagctgatctcacaaagtctttgaacttagcccaagagcaacttcagcatctcaagtccaaagacgagacagccaccgccaagttgctcgaaaagggccttgatgaagacggcgaccatgcaaggaacgtcgatggcaactttgccgaagtcgaattgctgtctcgtgacttggaacgtgcgcacgcccgggttgagaccctcgagaggcgcaacgagcagttgcgtgtcgacattgaaagcgtcaagagtggtcgtcatgacacggaacgaatccaaacgctcgaagcggaaacgcaagaaaaagaccgcaagctgcaacagcttcaatctttgctcgagaccgaacgtcagcaatcggcaaacttgacaaagcaacttgccgcggcgcgcgatgaaaagcttaagctgcaaaacgaaaaggaagcagagatcgaatcgcttcgcaccaaattgctccagcgcagtgattacgccaacatcaagcgcgagctcgagatcgtcaaggcggttcacttcaatgctgaagacgatgaagatctcgatgcatctgcccatgtcgctggcgatgcagagcagagttcgaacaagcagcgacccgcagatgcaaagagtctcgaagcattgttgctggaaaggaacaagcgacttgaggacaacttggcgacattgcgtgtatctaactctgagttgtcgagttcgctcgagcaggccaacttggagcttgttcgactcaagcaacaacgctcgcatctcaagaccctgaatgataagctcgagatggatcttgcttgcgttggcacgggacatcgttccaatagcaagcgcatggctgcgctgagcgccgaggacgctctaaaggaaatagagtcgctcgaagctcaagttgagcaagcaggtcaacttggcaaagcgagcagcaaaccagtggtccaatctacgcctgcacaccaggccgtcgccaacggagtcgaatcagcatcactagcaaggtccgtcgaaccctctgcagcttcgaggtcgtctgtctcttctgctgctccctcttccggcggcggcggaggcatcgggggtgacaacagcatcctgcccatcgttacttcccagcgagaccgtttccgtacgcgcaatgccgagttggaagaagagctgcgcaagcaatttgaaaccatcagcgagcttcgcaacgagatcaagacgttgcaagccgacaaccttggcctgtacgagaaggtgcgctatttgcaaagctatggccctgctggcagcggcgcaacggggggtcgaggcgacgctgtgattcagatcggcactggcaacggagcgtcgggacgcagagacgcatcgggagcctatcctccaccaagaagcgacgataagtatcgtgccaggtacgaagagtcaatgaacccattcgaagccttccgcggacgcgaacagtcgcgcgccatggcgcagctcaacccgctcgaacgtgcgctgcacatgctcacgcgcttggtgctgagccatcgacgcatgcgcttgttcttcatggtgtatgccatctttttgcacttgctcatctttggcatgctcctcgaagtgagtcatacgtcgtccgctcagacttgctctttgccaccacggtga

SEQ ID NO: 7760 - protein, 756 aa, Ustilago maydis 521
MAAATAAAAPYTIDGAGPSRSPVDFSAALSIWRDINLVDLQQQLSTTAPELFEAQKAAVSNRKKLADQTREFKKQPDANKLESFKPLLKAYQTEIDTLTKRSKAAENAFLNVHSALTNAPDPYPLLEVTLEQAASLNDLESLKHENAKLQTDLARSAAEAQVSQEREAENARLQQRLRSLEQDFEAKVQQRTSAFELELSAKWDERIHNLKEREADLTKSLNLAQEQLQHLKSKDETATAKLLEKGLDEDGDHARNVDGNFAEVELLSRDLERAHARVETLERRNEQLRVDIESVKSGRHDTERIQTLEAETQEKDRKLQQLQSLLETERQQSANLTKQLAAARDEKLKLQNEKEAEIESLRTKLLQRSDYANIKRELEIVKAVHFNAEDDEDLDASAHVAGDAEQSSNKQRPADAKSLEALLLERNKRLEDNLATLRVSNSELSSSLEQANLELVRLKQQRSHLKTLNDKLEMDLACVGTGHRSNSKRMAALSAEDALKEIESLEAQVEQAGQLGKASSKPVVQSTPAHQAVANGVESASLARSVEPSAASRSSVSSAAPSSGGGGGIGGDNSILPIVTSQRDRFRTRNAELEEELRKQFETISELRNEIKTLQADNLGLYEKVRYLQSYGPAGSGATGGRGDAVIQIGTGNGASGRRDASGAYPPPRSDDKYRARYEESMNPFEAFRGREQSRAMAQLNPLERALHMLTRLVLSHRRMRLFFMVYAIFLHLLIFGMLLEVSHTSSAQTCSLPPR

SEQ ID NO: 7761 - DNA, 2022 bp, Cryptococcus neoformans var. neoformans B-3501A
  CDS (1)..(2022)
atggcagagcaaaatttctcggccgctttggctacgtggaaggaaattaatctgtcggaacttcaaaagaatttagacacaacggctgttgagcttgttgacaatcaaaaagagaacctgatcggccgtaagaagttagcagagcagactcgagaattcaagaaactcccagatgatgctgagaaatttgcggccatcaaggtccttctcaaggcttatcaaggtgaaatcgatgccctcacccgacggtcaaagatgtctgaaacatcgttcttgaatgtgtacaagttacttgccgacgcgcctgatccctacccccttttggatgcagctgtagatcagacgatcaaagtggcggaagccaggatgctggagagcgagttagccagactgagagaggaaaacggggaattgaagaaaagtttgggagaagccgccaacgtggaggagaagaggaagaaggctgagagcaaggttgaacagctagaggaaaagatggatgatttaattcaagaaagggttactcagaaggaaaacgagctcaatgcagagtacgacgagaggatgcgcaattacgaagaaagagaaaaggaccttcagagacaagtggagatggtcaaaaaacaactgcgagatctccatatgtccaacgagagtgcagaggctaaacttcttaacgctaaccaacgccaagagcaagacgttgctgcgagattggccgagctagacatggtggccgctgaccttgctcgagccaacgaacgtgtagcaagcgtcgaacgacgaaatgagattctccgttctgaaattgagtctgttcgttcaggctcccagcaggctgagaaagtcaaagcattcgaagcacaaatatccgaacttgaagccgaagcatctcgcatactcgccgctcttgatgctgccaaggacgccaaagccgaagcggatcgccagttcaaaaaacaggccgaggaatctgcgaaggaaattgctgctcgaactgccgaggttgatggattgaaggccaagatgaaggggatggccgattacgatgaaatcaagcgagagcttgaaattatgaagtatgtggaattctctggagccgactttgaagataacgacggagaggagcctcggttgcccgacccaaacgcttctgtcgccaacaagcaacgcggtcaatctctcgaaaaactcctcacctcgaagaaccgtcgtcttctggaagatctcacaaagcttcgggtttcttgggaagatctttccagcgagcatgctaaggcggaggagatgattgagggtctgcaggtggatttggccttgcaaagagaattagttgagaagctggaaagtgacttgatggtcttaaacaatcgagaagaccgggttggaaccccagggcagggccttgctgggttagatatcggtagcaagcctgacggccgtgcatcgcccgccaattctggctctcaagatacctctatcctccctatcgtcacttcccaacgtgaccgtttccgacagcgcaatgctgagctggaagacgaattgcggaaacaattcgagaccatatcagatttgcgcactgaagttaaatcccttcaaaccgataatcttaagctgtacgagaaagtgagatacatgggatcgtaccgagattcttcatttgccaaggctggaccctcaggtggggcatactcctcgggaggtggcacagggggactgttgaccggtgtgctgggaaggagagatgaagaaatcggaaagtataaagacaagtacgacgagtcgcttaatccgtttgaggcattcaagggacgagaagcccaaagagctattcaggcgttgaatcccgtggaaagaggagtatttagtttgactagggcgatagtgggtaataagagggcgagaaatctgttcattctctacgcgggaagcttgcatattctgattctcttcattctttggaataccatggctgcaagcgactctacttcacatccaccagtgacaatccacccatag

SEQ ID NO: 7762 - protein, 673 aa, Cryptococcus neoformans var. neoformans B-3501A
MAEQNFSAALATWKEINLSELQKNLDTTAVELVDNQKENLIGRKKLAEQTREFKKLPDDAEKFAAIKVLLKAYQGEIDALTRRSKMSETSFLNVYKLLADAPDPYPLLDAAVDQTIKVAEARMLESELARLREENGELKKSLGEAANVEEKRKKAESKVEQLEEKMDDLIQERVTQKENELNAEYDERMRNYEEREKDLQRQVEMVKKQLRDLHMSNESAEAKLLNANQRQEQDVAARLAELDMVAADLARANERVASVERRNEILRSEIESVRSGSQQAEKVKAFEAQISELEAEASRILAALDAAKDAKAEADRQFKKQAEESAKEIAARTAEVDGLKAKMKGMADYDEIKRELEIMKYVEFSGADFEDNDGEEPRLPDPNASVANKQRGQSLEKLLTSKNRRLLEDLTKLRVSWEDLSSEHAKAEEMIEGLQVDLALQRELVEKLESDLMVLNNREDRVGTPGQGLAGLDIGSKPDGRASPANSGSQDTSILPIVTSQRDRFRQRNAELEDELRKQFETISDLRTEVKSLQTDNLKLYEKVRYMGSYRDSSFAKAGPSGGAYSSGGGTGGLLTGVLGRRDEEIGKYKDKYDESLNPFEAFKGREAQRAIQALNPVERGVFSLTRAIVGNKRARNLFILYAGSLHILILFILWNTMAASDSTSHPPVTIHP

SEQ ID NO: 7763 - DNA, 2052 bp, Medicago truncatula
  CDS (1)..(2052)
atggaatctccgccaagtggatcggagagggacacaaccaattctccgatctccgtcgtctccgctttctggaaagattttgacttagagaaggagaaatccgtgttagatgaacaagggcttcgaattgcagaaaaccaagaaaacagtcagaaaaataggcggaagcttgcagagagcactagaaatttcaagaaagcttcgcccgaggataagtcaagtttgtttaatgccttgcttaaggggtatcaggaagaggttgataatcttacaaaaagagcaaagtttggagaaaatgctttccttaacatctatcaaaagctgtatgaagctccagatccttatccagctcttgcctcagttgctgagcaagatctcaagctgtccgagctagaatctgagaaccggaaaatgaaagtcgagcttgaggaatttagaacagaggcaactcacttgaagaatcagcaggccacaatacgaagacttgaagagcgaagtaggcaattagagcagcagatggaagagaaagtaaaagaaatcgtggagataaagcatcgcaatctagcagaggagaaccagaaaacattagaaattttaaaagaaagggaacaattactacaggaccagctgcagagtgctaaagaaagtgtttcaaatatgaagaaattgcacgaacttgcacaaaaccagttgtttgaactccgtgcccagtctgaggaagagagggcagctaagcaagcagaggccaatctcctgatggatgaagttgaacgagcacaaacaatgcttcttggtttggagagagagaagggggtacttcgatctcagttgcaaacagcaaatgaagattctgaaactaagaagagtgataatttagactcaaataatgcacttgagaattctttaattgccaaagagaagttaatctctgaattgaacatggagctacacaatattgaaacaaccttatcaaatgaacgtgaagaacacattaatgatgtgaaaaaattcactgcaatgcttaatgaaaaggaggcttctattgtggcaatgaagaaagagcttcagacaagaccaacagaaaaaatagttgatgatttgcgcaagaaagtaaaaattttgcaggcagtgggttataattcaattgaggctgaagactgggaagtggccacaagtggggaggagatgagcaagatggaatctctactacttgataagaaccgaaaaatggaacacgagctaacacagttgaaggtcaaactttctgaaaaaacatcttcactcgaaacagccgagcagaaggtggcagaactttcagctaaggttaatgaacaacaaaaactgatacagaagttggaagatgatatatccaagggatataattccagttccaaagatcataaaggaactttccttgatgactgggatctatcagaggctaatcggagtgaggtgtctgagcatcagaatatggatcaaaggcatgccttagatcaagatcaaagctcaatgcttaaagtaatatgtagtcagagagatcgatttaggacacgcttgagagagacagaagaggaaataaggcagttgaaggagaaaattggggtattaacagcggaactggaaaagactaaagcagataatgttaaactgtacgggaagattcgttatgtccaagactataatgttgagaaagtggtttccaggggttctaagaagtatgcagaagatcttgaaagtggtttcacatcagatgttgaatcaaaatacaagaagatatacgaggaagatataaatccttttgctgcattctcaaaaaaggaaagagatcaaagatacaaggagttgggattcagggacagaatcacactcagcagcggacgatttcttctcggtaacaagtatgcccgaacttttgcattcttttatacaatcgggttgcatgtcttggtctttacctgtctctaccgaatgtcagctttgagttatctaagtcatggctcagatgaaacactggctggagagagaaccattgatcttccacgtggactgtag

SEQ ID NO: 7764 - protein, 683 aa, Medicago truncatula
MESPPSGSERDTTNSPISVVSAFWKDFDLEKEKSVLDEQGLRIAENQENSQKNRRKLAESTRNFKKASPEDKSSLFNALLKGYQEEVDNLTKRAKFGENAFLNIYQKLYEAPDPYPALASVAEQDLKLSELESENRKMKVELEEFRTEATHLKNQQATIRRLEERSRQLEQQMEEKVKEIVEIKHRNLAEENQKTLEILKEREQLLQDQLQSAKESVSNMKKLHELAQNQLFELRAQSEEERAAKQAEANLLMDEVERAQTMLLGLEREKGVLRSQLQTANEDSETKKSDNLDSNNALENSLIAKEKLISELNMELHNIETTLSNEREEHINDVKKFTAMLNEKEASIVAMKKELQTRPTEKIVDDLRKKVKILQAVGYNSIEAEDWEVATSGEEMSKMESLLLDKNRKMEHELTQLKVKLSEKTSSLETAEQKVAELSAKVNEQQKLIQKLEDDISKGYNSSSKDHKGTFLDDWDLSEANRSEVSEHQNMDQRHALDQDQSSMLKVICSQRDRFRTRLRETEEEIRQLKEKIGVLTAELEKTKADNVKLYGKIRYVQDYNVEKVVSRGSKKYAEDLESGFTSDVESKYKKIYEEDINPFAAFSKKERDQRYKELGFRDRITLSSGRFLLGNKYARTFAFFYTIGLHVLVFTCLYRMSALSYLSHGSDETLAGERTIDLPRGL

SEQ ID NO: 7765 - DNA, 2064 bp, Oryza sativa subsp
  CDS (1)..(2064)
atgtcgtcgccgctcgccgtcgtctccagcttctggaaagactttgatctggagaaggaaagaggtggtttggatgagcagggtttaaagattgcagagaatcaagagaccagccagaaaaacagacgccggcttgctgagagcactagggatttcaagaaggcgtcttcagatgataagcttagtttattcaattctttgctgaagagttatcaagaggaagttgataatctcacaaagagagcaaaatttggagaaaatgcatttctcaacatctaccagaagctctatgaagcccctgatccatacccagctcttgcttctatggctgagcaagatcagaaactatctgaactggagactgaaaatcggaagatgaaacttgagcttgaagagtaccgggcagaagccgcccacctaaagaaccaacaagcaacaattaggcgacttgaggagcgaaaccgccaactagaacaacagatggaggaaaaagtcagagagatggttgaaatgaagcagaggagtttggcagaagatagccagaaaactcttgaagccctgaaagacagggagcgggcattgcaggaccagctaagacaagccacagaaagtgtaaagaatatgcagaagctacatgaatcagcacaaagtcaattgtttgagcttcgtactcaatcagaggaggaccgggctgcaaaggaaactgaagtcaatcttctgttggatgaagttgaacgggcccaagcacgtttagttagtcttgagagagaaaagggtgatttacgatctcagttgcaaacaacaaatgaagatgcaaccaatagtagtgactacgtggactcaagtgatatacttgagagttccttgaatgccaaggagaagatcatctcagagctgaatgcagaactgcgtagtattgaaaatactttatcttctgagagagaaacacatgttaatgaactgaaaaagttgactgctttgctcagtgagaaggaaaatgctctgacagagttgaagaaagaacttcaagaaagaccaacaagaagactagtagatgatctcaagaaaaaggttcagattttgcaggctgtagggtacaactccattgaagctgaagattgggagctagcaacaaatggtgaagaaatgagcaagttggaagctttgcttcttgataagaaccgtaaaatggagcatgaactaacacagctgaaggtcaaaatatcagagaagtcaaatcttcttgaggaggctgaaaaaaagattgctgagctaactgcaaaggctgaagagcagcagaagttgattttgaaactcgaggatgacatactaaagggctatagttcaactgataggaggacttcacttctgaatgattgggatcttcaagaaattggctcaaatgaagtagcagagggtactgatccaaggcatgcaccacaagaccaagaccaaagttccatgcttaaggtcatttgcaatcagagggatcgtttccgtacacgtctacgtgaaactgaggaggaactaagaagactaaaagagaagtatgaaatgctagttgtagaattggaaaaaactaaagcagataatgttcaactgtatgggaagattcgttacgtgcaggactacagccatgagaagattgtttccagaggaccaaagaagtatgcagaagatgttgaaagtggttcttcagatgttgagacgaagtacaagaaaatgtatgaggatgacataaatccttttgctgctttttcaaagaaggaaaaggatcaacggtacaaggaacttggtttaagagacaaaatcactcttagcagtggacgttttctccttggtaacaaatatgcccggacatttatattcttctacactattggattacatctccttgtatttacattgctgtacagaatgtcagctttgagctatctcagacgtctgaatacgttttctgtagataaaaattttccagatatggagacggggtggatgggaaatgacaggatgaggcgtggtcgtgcgtttgagccgttattatgtaaactgttgtatcactaa

SEQ ID NO: 7766 - protein, 687 aa, Oryza sativa subsp
MSSPLAVVSSFWKDFDLEKERGGLDEQGLKIAENQETSQKNRRRLAESTRDFKKASSDDKLSLFNSLLKSYQEEVDNLTKRAKFGENAFLNIYQKLYEAPDPYPALASMAEQDQKLSELETENRKMKLELEEYRAEAAHLKNQQATIRRLEERNRQLEQQMEEKVREMVEMKQRSLAEDSQKTLEALKDRERALQDQLRQATESVKNMQKLHESAQSQLFELRTQSEEDRAAKETEVNLLLDEVERAQARLVSLEREKGDLRSQLQTTNEDATNSSDYVDSSDILESSLNAKEKIISELNAELRSIENTLSSERETHVNELKKLTALLSEKENALTELKKELQERPTRRLVDDLKKKVQILQAVGYNSIEAEDWELATNGEEMSKLEALLLDKNRKMEHELTQLKVKISEKSNLLEEAEKKIAELTAKAEEQQKLILKLEDDILKGYSSTDRRTSLLNDWDLQEIGSNEVAEGTDPRHAPQDQDQSSMLKVICNQRDRFRTRLRETEEELRRLKEKYEMLVVELEKTKADNVQLYGKIRYVQDYSHEKIVSRGPKKYAEDVESGSSDVETKYKKMYEDDINPFAAFSKKEKDQRYKELGLRDKITLSSGRFLLGNKYARTFIFFYTIGLHLLVFTLLYRMSALSYLRRLNTFSVDKNFPDMETGWMGNDRMRRGRAFEPLLCKLLYH

SEQ ID NO: 7767 - DNA, 2101 bp, Arabidopsis thaliana
  CDS (1)..(2070)
atggaggtttcgcaagatggatcggaaagagataaaactcctcctccttcctcttcttcttcttcttcctctcccattcctgtcgtcaccaatttctggaaagaatttgatttggagaaggagaaaagcctgcttgacgagcaagggcttagaatagctgaaaatcaagaaaacagccaaaagaatcgccgaaagcttgcagagagcacacgagacttcaagaaagcttcgcctgagaacaaacttagtatgtttaattccctcctcaagggatatcaagaagaagtagataatattaccaagagggccaagtttggggagaatgctttcctaaatatctatcagaaactctatgaagcacctgatccgtttcctgctcttgcttctattgctgagcaagatcgtaaattatctgaagtggaatctgaaaatcgaaagatgaaagttgaacttgaggagtttaggacagaagcgactcatcttaaaaatcagcaggccacaataagaaggcttgaagaacggaaccgccagcttgagcaacagatggaagaaaaaatcaaagaagttgttgagatcaagcaacgaaatctggctgaggaaaaccagaaaacgatggagcttttaaaggatagggagcaagctttgcaagatcagttaaggcaagcaaaagacagcgtctccactatgcaaaaattgcatgagttagcacagaaccaactttttgaactccgtgctcaatcagacgaagagaccgcggggaagcaatctgaagttagtctattgatggatgaagtggagcgtgctcagacccgactccttactcttgagagggaaaagggacatctgcgttctcagctgcaaacagctaatgaagatactgataacaagaaaagtgataatattgattcgaatagtatgctggagaactcgttaactgcaaaagagaagattatttcggagcttaatatggagattcacaatgttgagacagctttagctaatgagcgagaaagtcatgttgccgagataaagaaattgaattctttgctcaataaaaaggatactatcattgaagagatgaagaaagagcttcaagaaagaccatcagcaaaattagttgatgatttgcgcaaaaaagtgaaaattctgcaggctgtaggttacaattcaattgaggctgaagactgggatgctgctaccactggtgaagagatgagcaaaatggagtcgcttcttcttgataaaaacagaaaaatggaacatgaggtcactcagttaaaggttcaactttctgagaaagcttccttgcttgagaaggctgaagccaagggagaagaactgacagctaaggttaatgaacaacaaagactgatacaaaagttggaggatgatattttgaagggttacggttcaaaagagcgaaaaggtgctctatttgatgaatgggagttctcagaagcaggtgtggctgagcagtctgagcctatggatcagaaacatgttccatcagagcaagatcaaagctcaatgctaaaagttatctgcagccaaagagatcggttccgagcacgattacgggaaacagaagaggaaataaggcgattaaaagagaagataggttttctcacagacgaattggagaagaccaaagcagacaacgtcaaactctatgggaaaatccgttatgtccaagactataaccatgataaagttgtttcccgaggatcgaaaaagtatgtggaagatcttgaaagtggattcagctcggatgtcgaatcaaaatacaagaaaatttacgaagatgacatcaacccttttgcagcattctcgaaaaaggaaagagagcaacggatcaaagatttgggaatcagagatcggattacgctaagcagtgggcggttccttctaggaaacaaatacgcaaggacatttgctttcttctacacaataggattgcacgtccttgtcttcacttgtctctaccgtatgtctgcttacagttatctcagccatggagcagaggagactctaatgacagaagcaaccacaaaccttcctcacggtctttaagctctcaccctagggacttattcgtttttgg

SEQ ID NO: 7768 - protein, 689 aa, Arabidopsis thaliana
MEVSQDGSERDKTPPPSSSSSSSSPIPVVTNFWKEFDLEKEKSLLDEQGLRIAENQENSQKNRRKLAESTRDFKKASPENKLSMFNSLLKGYQEEVDNITKRAKFGENAFLNIYQKLYEAPDPFPALASIAEQDRKLSEVESENRKMKVELEEFRTEATHLKNQQATIRRLEERNRQLEQQMEEKIKEVVEIKQRNLAEENQKTMELLKDREQALQDQLRQAKDSVSTMQKLHELAQNQLFELRAQSDEETAGKQSEVSLLMDEVERAQTRLLTLEREKGHLRSQLQTANEDTDNKKSDNIDSNSMLENSLTAKEKIISELNMEIHNVETALANERESHVAEIKKLNSLLNKKDTIIEEMKKELQERPSAKLVDDLRKKVKILQAVGYNSIEAEDWDAATTGEEMSKMESLLLDKNRKMEHEVTQLKVQLSEKASLLEKAEAKGEELTAKVNEQQRLIQKLEDDILKGYGSKERKGALFDEWEFSEAGVAEQSEPMDQKHVPSEQDQSSMLKVICSQRDRFRARLRETEEEIRRLKEKIGFLTDELEKTKADNVKLYGKIRYVQDYNHDKVVSRGSKKYVEDLESGFSSDVESKYKKIYEDDINPFAAFSKKEREQRIKDLGIRDRITLSSGRFLLGNKYARTFAFFYTIGLHVLVFTCLYRMSAYSYLSHGAEETLMTEATTNLPHGL

SEQ ID NO: 7769 - DNA, 25 bp, Artificial sequence
  primer
atggatacgtcagtatattctcatg

SEQ ID NO: 7770 - DNA, 25 bp, Artificial sequence
  primer
ctatcgatttatgccatgaactgaa

SEQ ID NO: 7771 - protein, 723 aa, Artificial sequence
  consensus sequence
  Variant (2)..(5): Xaa in position 2 to 5 is any amino acid
  Variant (7)..(12): Xaa in position 7 to 12 is any amino acid
  Variant (15)..(23): Xaa in position 15 to 23 is any amino acid
  Variant (25)..(26): Xaa in position 25 to 26 is any amino acid
  Variant (28)..(30): Xaa in position 28 to 30 is any amino acid
  Variant (32)..(33): Xaa in position 32 to 33 is any amino acid
  Variant (36)..(37): Xaa in position 36 to 37 is any amino acid
  Variant (39)..(40): Xaa in position 39 to 40 is any amino acid
  Variant (42)..(42): Xaa in position 42 is any amino acid
  Variant (44)..(48): Xaa in position 44 to 48 is any amino acid
  Variant (49)..(49): Xaa in position 49 is any or no amino acid
  Variant (52)..(56): Xaa in position 52 to 56 is any amino acid
  Variant (60)..(60): Xaa in position 60 is any amino acid
  Variant (63)..(65): Xaa in position 63 to 65 is any amino acid
  Variant (67)..(67): Xaa in position 67 is any amino acid
  Variant (70)..(72): Xaa in position 70 to 72 is any amino acid
  Variant (74)..(75): Xaa in position 74 to 75 is any amino acid
  Variant (77)..(78): Xaa in position 77 to 78 is any amino acid
  Variant (80)..(82): Xaa in position 80 to 82 is any amino acid
  Variant (84)..(85): Xaa in position 84 to 85 is any amino acid
  Variant (87)..(87): Xaa in position 87 is any amino acid
  Variant (93)..(93): Xaa in position 93 is any amino acid
  Variant (95)..(95): Xaa in position 95 is any amino acid
  Variant (97)..(114): Xaa in position 97 to 114 is any amino acid
  Variant (115)..(121): Xaa in position 115 to 121 is any or no amino acid
  Variant (123)..(179): Xaa in position 123 to 179 is any amino acid
  Variant (180)..(183): Xaa in position 180 to 183 is any or no amino acid
  Variant (185)..(186): Xaa in position 185 to 186 is any amino acid
  Variant (188)..(227): Xaa in position 188 to 227 is any amino acid
  Variant (228)..(233): Xaa in position 228 to 233 is any or no amino acid
  Variant (235)..(242): Xaa in position 235 to 242 is any amino acid
  Variant (244)..(247): Xaa in position 244 to 247 is any amino acid
  Variant (249)..(252): Xaa in position 249 to 252 is any amino acid
  Variant (254)..(258): Xaa in position 254 to 258 is any amino acid
  Variant (260)..(281): Xaa in position 260 to 281 is any amino acid
  Variant (282)..(297): Xaa in position 282 to 297 is any or no amino acid
  Variant (299)..(301): Xaa in position 299 to 301 is any amino acid
  Variant (303)..(350): Xaa in position 303 to 350 is any amino acid
  Variant (351)..(353): Xaa in position 351 to 353 is any or no amino acid
  Variant (355)..(378): Xaa in position 355 to 378 is any amino acid
  Variant (379)..(401): Xaa in position 379 to 401 is any or no amino acid
  Variant (403)..(405): Xaa in position 403 to 405 is any amino acid
  Variant (407)..(412): Xaa in position 407 to 412 is any amino acid
  Variant (414)..(446): Xaa in position 414 to 446 is any amino acid
  Variant (448)..(449): Xaa in position 448 to 449 is any amino acid
  Variant (453)..(453): Xaa in position 453 is any amino acid
  Variant (455)..(497): Xaa in position 455 to 497 is any amino acid
  Variant (498)..(554): Xaa in position 498 to 554 is any or no amino acid
  Variant (556)..(560): Xaa in position 556 to 560 is any amino acid
  Variant (566)..(572): Xaa in position 566 to 572 is any amino acid
  Variant (574)..(585): Xaa in position 574 to 585 is any amino acid
  Variant (587)..(595): Xaa in position 587 to 595 is any amino acid
  Variant (598)..(599): Xaa in position 598 to 599 is any amino acid
  Variant (602)..(604): Xaa in position 602 to 604 is any amino acid
  Variant (607)..(622): Xaa in position 607 to 622 is any amino acid
  Variant (623)..(663): Xaa in position 623 to 663 is any or no amino acid
  Variant (665)..(667): Xaa in position 665 to 667 is any amino acid
  Variant (670)..(673): Xaa in position 670 to 673 is any amino acid
  Variant (675)..(677): Xaa in position 675 to 677 is any amino acid
  Variant (679)..(681): Xaa in position 679 to 681 is any amino acid
  Variant (683)..(704): Xaa in position 683 to 704 is any amino acid
  Variant (705)..(705): Xaa in position 705 is any or no amino acid
  Variant (707)..(708): Xaa in position 707 to 708 is any amino acid
  Variant (709)..(711): Xaa in position 709 to 711 is any or no amino acid
  Variant (713)..(717): Xaa in position 713 to 717 is any amino acid
  Variant (719)..(721): Xaa in position 719 to 721 is any amino acid
WXXXXLXXXXXXLDXXXXXXXXXQXXSXXXRXXLAXXTXXFXKXXXXXXKLXXXXXLLKXYQXXXDXLTXXXKXXEXXFXXXYXXLXEAPDPXPXLXXXXXXXXXXXXXXXXXXXXXXXXXEXXXXXXXXXXXXXXXXXXXXXXXXXXXXXXXXXXXXXXXXXXXXXXXXXXXXXXXXXXXXXEXXLXXXXXXXXXXXXXXXXXXXXXXXXXXXXXXXXXXXXXXXXXXXXXXEXXXXXXXXEXXXXRXXXXEXXXXXLXXXXXXXXXXXXXXXXXXXXXXXXXXXXXXXXXXXXXXLXXXLXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXLXXXNXXXXXXLXXXXXXXXXXXXXXXXXXXXXXXXXXXXXXXXXLXXKLEXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXQRDRFXXXXXXXEXXXXXXXXXXXXLXXXXXXXXXDNXXLYXXXRYXXXXXXXXXXXXXXXXXXXXXXXXXXXXXXXXXXXXXXXXXXXXXXXXXXXXXXXXXYXXXYEXXXXPXXXFXXXEXXXXXXXXXXXXXXXXXXXXXXXLXXXXXRXXXXXYXXXLH

SEQ ID NO: 7772 - protein, 57 aa, Artificial sequence
  protein pattern
  Variant (2)..(2): Xaa in position 2 is any amino acid
  Variant (3)..(3): Xaa in position 3 is any or no amino acid
  Variant (5)..(6): Xaa in position 5 to 6 is any amino acid
  Variant (7)..(7): Xaa in position 7 is any or no amino acid
  Variant (13)..(13): Xaa in position 13 is Lys or Arg
  Variant (14)..(14): Xaa in position 14 is any amino acid
  Variant (15)..(15): Xaa in position 15 is Lys or Arg
  Variant (16)..(17): Xaa in position 16 to 17 is any amino acid
  Variant (18)..(18): Xaa in position 18 is Asp, Glu or Gln
  Variant (19)..(19): Xaa in position 19 is any amino acid
  Variant (21)..(21): Xaa in position 21 is any amino acid
  Variant (22)..(22): Xaa in position 22 is Asp, Glu or Gln
  Variant (23)..(23): Xaa in position 23 is Ile or Leu
  Variant (24)..(32): Xaa in position 24 to 32 is any amino acid
  Variant (34)..(35): Xaa in position 34 to 35 is any amino acid
  Variant (36)..(36): Xaa in position 36 is Glu or Gln
  Variant (37)..(42): Xaa in position 37 to 42 is any amino acid
  Variant (45)..(46): Xaa in position 45 to 46 is any amino acid
  Variant (49)..(49): Xaa in position 49 is Glu or Gly
  Variant (50)..(50): Xaa in position 50 is Lys or Arg
  Variant (51)..(54): Xaa in position 51 to 54 is any amino acid
  Variant (55)..(55): Xaa in position 55 is Ala, Gly, Gln or Ser
  Variant (56)..(56): Xaa in position 56 is any amino acid
  Variant (57)..(57): Xaa in position 57 is Phe, His or Tyr
LXXIXXXQRDRFXXXXXXXEXXXXXXXXXXXXLXXXXXXXXXDNXXLYXXXXXXXXX

SEQ ID NO: 7773 - protein, 23 aa, Artificial sequence
  protein pattern
  Variant (2)..(2): Xaa in position 2 is any amino acid
  Variant (3)..(3): Xaa in position 3 is Asn, Ser or Thr
  Variant (4)..(4): Xaa in position 4 is Lys or Arg
  Variant (5)..(5): Xaa in position 5 is any amino acid
  Variant (6)..(6): Xaa in position 6 is Ala, Ser or Thr
  Variant (8)..(9): Xaa in position 8 to 9 is any amino acid
  Variant (10)..(10): Xaa in position 10 is any or no amino acid
  Variant (12)..(12): Xaa in position 12 is any amino acid
  Variant (13)..(13): Xaa in position 13 is any or no amino acid
  Variant (15)..(15): Xaa in position 15 is any amino acid
  Variant (16)..(16): Xaa in position 16 is Phe, Ile, Leu or Val
  Variant (17)..(17): Xaa in position 17 is any amino acid
  Variant (20)..(20): Xaa in position 20 is any amino acid
  Variant (21)..(21): Xaa in position 21 is Phe, Ile, Leu or Val
  Variant (22)..(22): Xaa in position 22 is any amino acid
  Variant (23)..(23): Xaa in position 23 is Phe, Met or Val
LXXXXXRXXXFXXYXXXLHXXXX

SEQ ID NO: 7774 - protein, 52 aa, Artificial sequence
  protein pattern
  Variant (2)..(2): Xaa in position 2 is any amino acid
  Variant (3)..(6): Xaa in position 3 to 6 is any or no amino acid
  Variant (8)..(10): Xaa in position 8 to 10 is any amino acid
  Variant (11)..(11): Xaa in position 11 is Asp or Asn
  Variant (13)..(18): Xaa in position 13 to 18 is any amino acid
  Variant (20)..(20): Xaa in position 20 is Asp or Ser
  Variant (21)..(21): Xaa in position 21 is any amino acid
  Variant (22)..(22): Xaa in position 22 is Asp, Glu, Gln, Ser or Thr
  Variant (23)..(23): Xaa in position 23 is Ala, Gly, Ile or Val
  Variant (24)..(25): Xaa in position 24 to 25 is any amino acid
  Variant (26)..(26): Xaa in position 26 is Ile or Leu
  Variant (27)..(27): Xaa in position 27 is any amino acid
  Variant (28)..(28): Xaa in position 28 is Ala, Asp, Glu or Thr
  Variant (29)..(29): Xaa in position 29 is any amino acid
  Variant (30)..(30): Xaa in position 30 is Glu or Gln
  Variant (31)..(32): Xaa in position 31 to 32 is any amino acid
  Variant (33)..(33): Xaa in position 33 is Ala, Asn or Ser
  Variant (34)..(36): Xaa in position 34 to 36 is any amino acid
  Variant (38)..(38): Xaa in position 38 is Lys or Arg
  Variant (39)..(39): Xaa in position 39 is any amino acid
  Variant (42)..(42): Xaa in position 42 is Asp, Glu, Gln, Ser or Thr
  Variant (43)..(43): Xaa in position 43 is any amino acid
  Variant (45)..(45): Xaa in position 45 is Lys or Arg
  Variant (46)..(46): Xaa in position 46 is any amino acid
  Variant (48)..(48): Xaa in position 48 is Lys or Arg
  Variant (50)..(50): Xaa in position 50 is any amino acid
  Variant (51)..(51): Xaa in position 51 is Asp, Glu, Pro or Ser
  Variant (52)..(52): Xaa in position 52 is Asp, Pro or Ser
AXXXXXWXXXXLXXXXXXLXXXXXXXXXXXXXXXXXRXXLAXXTXXFXKXXX

SEQ ID NO: 7775 - protein, 22 aa, Artificial sequence
  protein pattern
  Variant (2)..(4): Xaa in position 2 to 4 is any amino acid
  Variant (6)..(6): Xaa in position 6 is any or no amino acid
  Variant (8)..(10): Xaa in position 8 to 10 is any amino acid
  Variant (11)..(11): Xaa in position 11 is any or no amino acid
  Variant (13)..(13): Xaa in position 13 is Phe, Ile or Met
  Variant (14)..(14): Xaa in position 14 is Ala, Glu or Gln
  Variant (15)..(15): Xaa in position 15 is Ala, Asn or Gln
  Variant (17)..(19): Xaa in position 17 to 19 is any amino acid
  Variant (21)..(21): Xaa in position 21 is any amino acid
  Variant (22)..(22): Xaa in position 22 is Ala, Asp, Glu, Asn, Gln, Ser or Thr
YXXXYXEXXXXPXXXFXXXEXX

SEQ ID NO: 7776 - protein, 24 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(8): Xaa in position 7 to 8 is any amino acid
  Variant (9)..(9): Xaa in position 9 is any or no amino acid
  Variant (11)..(11): Xaa in position 11 is Glu, Gln or Ser
  Variant (12)..(12): Xaa in position 12 is Ala, Ile, Leu or Val
  Variant (13)..(13): Xaa in position 13 is Phe, Leu, Met or Val
  Variant (14)..(17): Xaa in position 14 to 17 is any amino acid
  Variant (18)..(18): Xaa in position 18 is Phe or Ile
  Variant (19)..(19): Xaa in position 19 is Ala, Glu, Gly, Asn or Ser
  Variant (20)..(20): Xaa in position 20 is any amino acid
  Variant (21)..(21): Xaa in position 21 is Ala, Glu, Gly, Asn or Ser
  Variant (22)..(23): Xaa in position 22 to 23 is any amino acid
  Variant (24)..(24): Xaa in position 24 is Ala, Asp, Glu or Thr
DXXXXKXXXLXXXXXXXXXXXXXX

SEQ ID NO: 7777 - protein, 31 aa, Artificial sequence
  protein pattern
  Variant (2)..(2): Xaa in position 2 is any amino acid
  Variant (3)..(3): Xaa in position 3 is Asp, Glu, Asn or Ser
  Variant (4)..(4): Xaa in position 4 is Ile, Leu or Met
  Variant (5)..(5): Xaa in position 5 is Leu or Val
  Variant (6)..(7): Xaa in position 6 to 7 is any amino acid
  Variant (8)..(8): Xaa in position 8 is Asp or Glu
  Variant (9)..(9): Xaa in position 9 is Ala, Leu or Val
  Variant (10)..(10): Xaa in position 10 is Ala, Asp or Glu
  Variant (11)..(11): Xaa in position 11 is any amino acid
  Variant (12)..(12): Xaa in position 12 is Ala, Ser or Thr
  Variant (13)..(15): Xaa in position 13 to 15 is any amino acid
  Variant (16)..(16): Xaa in position 16 is Ile, Leu or Val
  Variant (17)..(17): Xaa in position 17 is any amino acid
  Variant (18)..(18): Xaa in position 18 is Glu, Gly, Gln, Ser or Thr
  Variant (19)..(19): Xaa in position 19 is Ile, Leu, Met or Val
  Variant (21)..(21): Xaa in position 21 is any or no amino acid
  Variant (23)..(23): Xaa in position 23 is any or no amino acid
  Variant (25)..(30): Xaa in position 25 to 30 is any amino acid
  Variant (31)..(31): Xaa in position 31 is Ala, Glu, Gln or Ser
EXXXXXXXXXXXXXXXXXXEXRXEXXXXXXX

SEQ ID NO: 7778 - DNA, 1017 bp, Saccharomyces cerevisiae
  CDS (1)..(1017)
atggataagaattcagttaacaaagatagtgaagaaaaagacgaaagacacaagattgaggttgtagacgatacaaatcctgacttcatcactgcagattcggaactgacacaagatctgcctgatgatgtagaggttattgacttggtccatctaaaaatcaaatcgttagaagatttgaacctttataggttcaagaatttgaaacaattatgtctcagacagaacctgatcgaaagcataagcgaagtggaagttttaccccatgacaagattgttgaccttgatttttacgataacaaaattaaacatatctcctctaatgttaataagctcaccaaattaacgtctctagacctgtcgtttaacaagatcaagcacatcaaaaatctagaaaatttgactgatctggagaatttatacttcgtgcagaacagcatttccaaaattgaaaatctgtccactttgaaatcactgaaaaacttagaattaggtggtaataaggttcattctattgaacccgattccttcgaaggtctgtcaaacttggaagaaatttggttgggtaaaaattccataccaagacttattaacttacatcctttaaagaatttgaagatattgtccatccaatctaataaattaaaaaaaattgaaaatctagaagagttgaccaatcttgaagagctctatctgtcacataatttcatcaccaagattgaaggtctagagaaaaacctaaaactaactactttggacgtgacctccaacaaaattacctccctggaaaacttgaaccacctgtcaaatttaactgacatatgggcctcctttaacaagatagatcaatcctttgagagcttgggtgaaaacctgtccgccctatcacgcttggagaccatttatctggagggaaaccctattcaactggaaaataagacttcgtatagaagaaaactgactatgaacttacctccatccctacagaagattgatgcgacatatataagaggctga

SEQ ID NO: 7779 - protein, 338 aa, Saccharomyces cerevisiae
MDKNSVNKDSEEKDERHKIEVVDDTNPDFITADSELTQDLPDDVEVIDLVHLKIKSLEDLNLYRFKNLKQLCLRQNLIESISEVEVLPHDKIVDLDFYDNKIKHISSNVNKLTKLTSLDLSFNKIKHIKNLENLTDLENLYFVQNSISKIENLSTLKSLKNLELGGNKVHSIEPDSFEGLSNLEEIWLGKNSIPRLINLHPLKNLKILSIQSNKLKKIENLEELTNLEELYLSHNFITKIEGLEKNLKLTTLDVTSNKITSLENLNHLSNLTDIWASFNKIDQSFESLGENLSALSRLETIYLEGNPIQLENKTSYRRKLTMNLPPSLQKIDATYIRG

SEQ ID NO: 7780 - DNA, 1105 bp, Saccharomyces cerevisiae
  CDS (41)..(1057)
aactctttgtttcttgtttgttgattaacccttaattaagatggataagaattcagttaacaaagatagtgaagaaaaagacgaaagacacaagattgaggttgtagatgatacaaatcctgacttcatcactgcagattcggaactgacacaagatctgcctgatgatgtagaggttattgacttggtccatttaaaaatcaaatcgttagaagatttgaacctttataggtttaagaatttgaaacaattatgtctcagacagaacctgatcgaaagcataagcgaagtggaagttttaccccatgacaagattgttgaccttgatttttacgataacaaaattaaacatatctcctctaatgttaataagctcaccaaattaacgtctctagacctgtcgtttaacaagatcaagcacatcaaaaatctagaaaatttgactgatctggagaatttatacttcgtgcagaacagcatttccaaaattgaaaatctgtccactttgaaatcactgaaaaacttagaattaggtggtaataaggttcattctattgaacccgattccttcgaaggtctgtcaaacttggaagaaatttggttgggtaaaaattccataccaagacttattaacttacatcctttaaagaatttgaagatattgtccatccaatctaataaattaaaaaaaattgaaaatctagaagagttgtccaatcttgaagagctctatctgtcacacaatttcatcaccaagattgaaggtctagagaaaaacctcaaactaactactttggacgtgacctccaacaaaattacctccctggaaaacttgaaccacctgtcaaatttaactgacatatgggcctcctttaacaagatagatcaatcctttgagagcttgggtgaaaacctgtccgccctatcacgcttggagaccatttatctggagggaaaccctattcaactggaaaataagacttcgtatagaagaaaactgactatgaacttacctccatccctacagaagattgatgcgacatatataagaggctgaatttaaatacccagcaaattggagctctgcagagctttcgttcgtatc

SEQ ID NO: 7781 - protein, 338 aa, Saccharomyces cerevisiae
MDKNSVNKDSEEKDERHKIEVVDDTNPDFITADSELTQDLPDDVEVIDLVHLKIKSLEDLNLYRFKNLKQLCLRQNLIESISEVEVLPHDKIVDLDFYDNKIKHISSNVNKLTKLTSLDLSFNKIKHIKNLENLTDLENLYFVQNSISKIENLSTLKSLKNLELGGNKVHSIEPDSFEGLSNLEEIWLGKNSIPRLINLHPLKNLKILSIQSNKLKKIENLEELSNLEELYLSHNFITKIEGLEKNLKLTTLDVTSNKITSLENLNHLSNLTDIWASFNKIDQSFESLGENLSALSRLETIYLEGNPIQLENKTSYRRKLTMNLPPSLQKIDATYIRG

SEQ ID NO: 7782 - DNA, 1002 bp, Oryza sativa (japonica cultivar-group)
  CDS (1)..(1002)
atggcgtccggcgatccggtggacgcgccggcggcggcggcggagtcgatggaggtggaggcggaccagtgcctcgacctgacgagctgccagctgcacgatctgagcgaggtggagatcccgcccaccctggaggagctcgaactcacggcgaaccgcctcgccgccgtcgacccccgcatcggccgcctcccgggcctccgcaagctctccttccgccagaacctcctcgacgacgccgccgtcgcgcccctctccacctgggccgacatcgctgggctgcaggagttggtctttagagataacaaacttacaacgattcctgatgccagcatcttcaaaggccttctggtctttgatgtatctttcaatgagatatcttccttaaaggggctgtccaaggtttccagcacactgaaggaactctatgtttcaaagaatgaagttgcaaagatggaggaactcgaacactttcatgcattacaaattcttgaacttggtagcaacagattgagggtgatggaaaatctagaaaccttggcaaatctgcaggagctatggctgggaagaaatcgaataaagacaatcaacctatgtagtttgaaagcaataaaaaaattaagcttgcaaagcaacagactgacttcaatgaatgggttacaagaatgtattgcactagaggaactatacctcagtcataatggaatacaaaagatggagggtctctctaccttgcagaaccttcgtgttttagatgtttcatccaacaagctaactgctatcgaagatgttgaaaccttaagcaggttggaggacttgtggttgaatgacaaccaaataccatcactagatgggatagaatctgctttggctagttcacgggagaagctgactaccatatatcttgagcggaatccttgcgcaaaagctccaaactattcatccacgttgaagacaatatttccaaatcttgagcaactcgattcagatatgctagcatga

SEQ ID NO: 7783 - protein, 333 aa, Oryza sativa (japonica cultivar-group)
MASGDPVDAPAAAAESMEVEADQCLDLTSCQLHDLSEVEIPPTLEELELTANRLAAVDPRIGRLPGLRKLSFRQNLLDDAAVAPLSTWADIAGLQELVFRDNKLTTIPDASIFKGLLVFDVSFNEISSLKGLSKVSSTLKELYVSKNEVAKMEELEHFHALQILELGSNRLRVMENLETLANLQELWLGRNRIKTINLCSLKAIKKLSLQSNRLTSMNGLQECIALEELYLSHNGIQKMEGLSTLQNLRVLDVSSNKLTAIEDVETLSRLEDLWLNDNQIPSLDGIESALASSREKLTTIYLERNPCAKAPNYSSTLKTIFPNLEQLDSDMLA

SEQ ID NO: 7784 - DNA, 987 bp, Arabidopsis thaliana
  CDS (1)..(987)
atgaacagtgagaaggaagacgagccattggaagagatcggcgattcgaataatgttctcgatctcactagctatcagctccacagtctcgatacggtcgagttaccgccgaacctgattgagctggaccttacggcgaaccgtttgtcgggattggactcgaggatcgctcagctctccacgcttaagaagctttctctccgccaaaacctaattgatgattccgccgtcgaaccgttgtctcactgggacgccttgtccgatctcgaggagttagttctcagagataacaagctagcgaaagtaccagatgtcagcatattcacgaagcttttggtttacgacatatctttcaatgaaatcacttctttggaaggaatatccaaggcctctagcacactgaaggaactctatgtgtctaaaaatgaagttaacaagattatggagattgaacacttacacaacttgcagattcttgaactggggtctaatagattgcgggtgatggaaaatctggaaaacttcacaaaattagaagaactatggctcggaagaaaccgtatcaaagttgttaacctgtgtgggctcaaatgcataaaaaagattagcttgcagagcaatcgattgacctctatgaaaggatttgaggaatgtgttgctcttgaagagttatatttgagccataatggtatctccaaaatggaaggcttgagtgcattggtcaacctacgggtattggacgtgtcgaacaacaagcttacttcagttgatgacattcagaacctcacaaagttggaagatttgtggcttaatgacaaccagatagaatcactggaagcaatcacagaagctgttacaggatctaaagagaagcttaccactatctacctcgaaaataacccttgtgccaagtcttctgattatgttgctgcggtcagacaaatcttcccgaatgtggagcaaattgattctaacttatttgcttag

SEQ ID NO: 7785 - protein, 328 aa, Arabidopsis thaliana
MNSEKEDEPLEEIGDSNNVLDLTSYQLHSLDTVELPPNLIELDLTANRLSGLDSRIAQLSTLKKLSLRQNLIDDSAVEPLSHWDALSDLEELVLRDNKLAKVPDVSIFTKLLVYDISFNEITSLEGISKASSTLKELYVSKNEVNKIMEIEHLHNLQILELGSNRLRVMENLENFTKLEELWLGRNRIKVVNLCGLKCIKKISLQSNRLTSMKGFEECVALEELYLSHNGISKMEGLSALVNLRVLDVSNNKLTSVDDIQNLTKLEDLWLNDNQIESLEAITEAVTGSKEKLTTIYLENNPCAKSSDYVAAVRQIFPNVEQIDSNLFA

SEQ ID NO: 7786 - DNA, 1146 bp, Magnaporthe grisea 70-15
  CDS (1)..(1146)
atgtctgatcctcttcctgaggaccacgggccacagaaacagggtcgcgttgaacttgcagagtcaaaagacggcgaaatggaccacaagtcggaggaccagcccagcccgggaatccgggacagcaagggatgggacgggaagctcaggtttccaaagaacgctgttgtagccaaccccgaagccttgtcggatgctgagtactctgacgatgagaacgtcaacccgggcgatgtgatccccgcggatgaagatcttctcgacggtgaaccattagacacggaggaactcaacgccacgcactctcgcatccgaagcatcccgagcctcaaactcgagcgattcaagcaggttgtcagcctctgcctgcgtcaaaatgtcatacaagaaatcgatggacttgcctgcctggctggtactttacaagagctcgacctatacgacaatctcataacacacatcaagggactgggcgagttgaaggccctcacatggctggacctgagcttcaacaagatcaagcgcatcgagaacgtcaatcacttgacggaactcacagatttatttttcgtcgccaataagatcaggactattgaaaacctcgaggggctgaacaagctgcgtatgctggagcttggatcgaaccggatccgcgagatgcagaatctcgattcgctcaaggagctacaggagctctatgtagcaaagaacaagatcacccagctgactggattggctgggcttccaaagctccgtctcctcagcatacaatccaaccgaattcaagacctttcgcctctaaaggacgtccatacgctcgaagagctatacataacacacaacgccctgacctctctggaggggctggagcacaacataaacctcaaggtcctggacgtttcaaacaaccagatttccagcctgaagggccttgggccgctgaaggaactgaccgacttttgggccagctacaaccagatagccgactttgccgaggttgagaaggagctcaaggacaaggagaatctcgaaacggtatatttagaaggcaatccgctgcagcttcggggcccggctctctacaggaacaaagtacggctggctttgccccaagtgaagcagattgatgccacttttgttcgctga

SEQ ID NO: 7787 - protein, 381 aa, Magnaporthe grisea 70-15
MSDPLPEDHGPQKQGRVELAESKDGEMDHKSEDQPSPGIRDSKGWDGKLRFPKNAVVANPEALSDAEYSDDENVNPGDVIPADEDLLDGEPLDTEELNATHSRIRSIPSLKLERFKQVVSLCLRQNVIQEIDGLACLAGTLQELDLYDNLITHIKGLGELKALTWLDLSFNKIKRIENVNHLTELTDLFFVANKIRTIENLEGLNKLRMLELGSNRIREMQNLDSLKELQELYVAKNKITQLTGLAGLPKLRLLSIQSNRIQDLSPLKDVHTLEELYITHNALTSLEGLEHNINLKVLDVSNNQISSLKGLGPLKELTDFWASYNQIADFAEVEKELKDKENLETVYLEGNPLQLRGPALYRNKVRLALPQVKQIDATFVR

SEQ ID NO: 7788 - DNA, 1137 bp, Gibberella zeae PH-1
  CDS (1)..(1137)
atgcctgcctccgataaagataacgacgttcatgcccacatcgaactcccttcgggtgatgaacagccatctccgcgtgcagatggcgactccagccctggcctcaggaatagcaagggctgggatggcaagcttcgcgtcccaaagtcgctgtctttggcaaaccctgaagccatgaccgactccgagtactctgacgaagagaacgttatgaagggagagaagattgacgctgatgaggaccttctcgacgatgaagaccccgagactgacgaaattatgtgttctcactctcgcatcgcctcaatttcctccctgcgtctcgagcgcttcaagcaagtttcacgcatttgcctccgccagaacagtatcgagcagatcgatggtctttccgcccttgctgaaaccctcgaagacctcgatctttacgacaacctcatttctcacacccgcggcttggaggatttgacgaacattacgagcctcgacctaagtttcaacaagatcaagcatgtcaagcatatcaaccatctgacgaaactcaaggagctataccttgtcgccaacaagatcagtaaaatcgaggggttggagggactcgacaagttgacgtctcttgagctcggatcgaaccgtattcgcgaaatcaagaacctcgattctcttaaggcgatcgaagagctctggctagcaaagaacaaaatcactgagctcactggtctcggtggcatgcctaatctgcgcctcctcagtattcagtccaaccgtataagcgatctgtcaccactcaaggatgtccctacgcttgaggaactttacatctcacacaatatgctggagtcactcgagggtctagaacacaaccccaggctccatgttctggacatttcgaataataagatcaccagtatcaagggtcttgagttgctctcggagctggaggagttgtgggccagctacaaccttatcagcgattacaaggaggttgccaagtacctctccgacaagaagtgcttgacaacggtgtactttgaggggaacccgctgcaactgcaggagccggtggcatataggaacaggatccgattaacattacctcaagtcaaacaaattgatgccacttttgtgagaacataa

SEQ ID NO: 7789 - protein, 378 aa, Gibberella zeae PH-1
MPASDKDNDVHAHIELPSGDEQPSPRADGDSSPGLRNSKGWDGKLRVPKSLSLANPEAMTDSEYSDEENVMKGEKIDADEDLLDDEDPETDEIMCSHSRIASISSLRLERFKQVSRICLRQNSIEQIDGLSALAETLEDLDLYDNLISHTRGLEDLTNITSLDLSFNKIKHVKHINHLTKLKELYLVANKISKIEGLEGLDKLTSLELGSNRIREIKNLDSLKAIEELWLAKNKITELTGLGGMPNLRLLSIQSNRISDLSPLKDVPTLEELYISHNMLESLEGLEHNPRLHVLDISNNKITSIKGLELLSELEELWASYNLISDYKEVAKYLSDKKCLTTVYFEGNPLQLQEPVAYRNRIRLTLPQVKQIDATFVRT

SEQ ID NO: 7790 - DNA, 1020 bp, Candida glabrata CBS 138
  CDS (1)..(1020)
atggaggttgatggtggcaagcatgaggacaagcaagaggacaagcatgccaagattgagattgttgatgatgacagggaggttgatgttatcaagccagatagtgaacttaccgatgatttgccagacgacacagagaacattgagctggtacatttgaggattggatcccttgaagagctgaaccttaccagattccatcagttaaagtacttatgtgttagacagaacttcattgagagtatcagtgaggtcgatgtattgcctgatgataccgtagaagatttggatttctacgataacaagatcaagcatatttccaaatacatcaataaattcaagaacttgaagaatctggacctgtcattcaacaagattaagaacataaagaacattgacaagttggaaaacctagagaatctatattttgttcagaataagatagaagttattgagaacttgtccactttgaagaaactgaaaaaccttgaattgggtggtaacaggatacatgagattggtgaggactccttgaagggtttggacaagttggaagaaatatggcttggtaaaaaccatataccaagactgataaatctacactggctcaaaaacttaaagattctgtctatacaatccaatagaattaagaaaatagagaatttagaacagctagaaaatttagaggaactatatctctcacataacttcatcgagaagattgagggtctagacaaaaacttgaagttgacaacacttgatattacttcaaacaagattacaaagattgaaaacgtcaaacatttgacaaaattgactgacttatggttgtctttcaataagattgatcagtcatttgagtctatcggtgatgaactacgtgatctgccagagttcgatacaatttatcttgaaggtaatccagttcaattgaataataagacctcctatagaaggaagctgatgttgaaccttggcccttcattgcaaaaaatcgatgctacttacactagacaatga

SEQ ID NO: 7791 - protein, 339 aa, Candida glabrata CBS 138
MEVDGGKHEDKQEDKHAKIEIVDDDREVDVIKPDSELTDDLPDDTENIELVHLRIGSLEELNLTRFHQLKYLCVRQNFIESISEVDVLPDDTVEDLDFYDNKIKHISKYINKFKNLKNLDLSFNKIKNIKNIDKLENLENLYFVQNKIEVIENLSTLKKLKNLELGGNRIHEIGEDSLKGLDKLEEIWLGKNHIPRLINLHWLKNLKILSIQSNRIKKIENLEQLENLEELYLSHNFIEKIEGLDKNLKLTTLDITSNKITKIENVKHLTKLTDLWLSFNKIDQSFESIGDELRDLPEFDTIYLEGNPVQLNNKTSYRRKLMLNLGPSLQKIDATYTRQ

SEQ ID NO: 7792 - DNA, 1089 bp, Kluyveromyces lactis NRRL Y-1140
  CDS (1)..(1089)
atgagccgtgaagagagagttttgagtgatactgataatgaaaatacgaatgaggaaatagagactggtattgattccccggacgaatcatcttcagggttgttcacagcgggacgctcgttacaatcgaacgtcatagaagaccacaaccctgactatatatctgcagatgcagaattggccgcagagataccagatgacaccgaagtaattgacttagtgcatttgaaagtactggcgttggaagacttgaatttgttgagatttaagaatttgaagaagttatatttaagacagaatttgatcgagtcaatagctgaactggaggtactaccgttagaaaacatggaagagattgatttttacgataatagaatcaaacacatctcgaaaagcgttaatcttttctctaatctaaagacactcgacttatcttttaataagattagaactatcaagaacgtcgataaattggtaaacctcgagaatttgtatttcgtccagaataagatatctaagattgaaaatttaggaacccttacaaagttgaaaaatcttgagcttggtggcaacagaatcaaagaaattggtcctgatgacttgaaaggtttggctaatctcgaagagatatggttgggtaagaactcaatccctaaattgataaacttgcaacacctcaaaaatttgagaatattaagcatccaatctaacaaattgaagaaatttgaaggacttgaggagttggagaacttagaagaattgtatgtctctcacaattttatttcgaagatcgaaggacttgaaaataacctaaaattaactactttagatgtaactggtaatagacttacgaagatcgaaaacttaaagcatttgacacatcttactgacctatgggcgtctgataatcaaattgatcaaccgttcgaatctctaggcgaagaattggggaaattacctgaatttgaaacgatatatctcgaaggaaatccaatacagactaaaaatcctacacagtacagaagaaagattatgttgaatttgggggaatcgcttcaaaaaatcgacgctacgtacgttcgtgcctaa

SEQ ID NO: 7793 - protein, 362 aa, Kluyveromyces lactis NRRL Y-1140
MSREERVLSDTDNENTNEEIETGIDSPDESSSGLFTAGRSLQSNVIEDHNPDYISADAELAAEIPDDTEVIDLVHLKVLALEDLNLLRFKNLKKLYLRQNLIESIAELEVLPLENMEEIDFYDNRIKHISKSVNLFSNLKTLDLSFNKIRTIKNVDKLVNLENLYFVQNKISKIENLGTLTKLKNLELGGNRIKEIGPDDLKGLANLEEIWLGKNSIPKLINLQHLKNLRILSIQSNKLKKFEGLEELENLEELYVSHNFISKIEGLENNLKLTTLDVTGNRLTKIENLKHLTHLTDLWASDNQIDQPFESLGEELGKLPEFETIYLEGNPIQTKNPTQYRRKIMLNLGESLQKIDATYVRA

SEQ ID NO: 7794 - DNA, 1110 bp, Debaryomyces hansenii CBS767
  CDS (1)..(1110)
atgaaggagagtgatccaaacattgtggatgataatgcagtagcagattctgaatctgtcgtcgaagaagaaaatatactatctcataccgaagatgagggagatgaagacgaagagaatgacaagaacgagcctttgcctgtggaataccctggtactgtattaccagatgatcatccgcaacacattgatgcggatgcagacttgaccaaaggttatgattcagatactgattatttggatttaattcatatgaaaattgggtcgatggaggacctaaatttgtcgagattcaataagttagagtctttatgcttgagacaaaacttaattacttcaatggtcgaagtgaaagtcttaccgggggaaacattgcaagaattggatttttatgacaatagaatcaatcacatatcaagtcaaattagcaagcttacaaacttgactaatcttgatctttcattcaacaaaattaagaacattaagaatttagaatcattgacaaaacttgagcatttgtattttgtacagaataagatcaaagatatcaagaatttggaaactcttcaaaatttgaagaatttggaattgggtggaaataaaatcgaagtaataagtgaaacccttgataaactagttaatctacaacaattatggcttggtaaaaataagatcgaaaaattagaaaacatgagcaatttgacaaatttaagagttctttcaatacagtccaatagaattactaaaatcgaaggtctagagaacttggttaatttggaagaactatacttgtctcacaatgggatcacgaaaattgaaaatttggataaaaatgccaacttgcaagtattggatgtaacctccaacagacttacgactcttgataacttaaatcatttaaccaagttgactgatttttggtgttcgtataacaaaatatcaagctttgaagagattggtaaagaattaggcaagttaccggaattggatactgtttatttcgaaggtaatctagttcaaacccaaaaccccacggcttatagaagaaaaataaagttatatttgggccctagcttagctaaaatcgatgcaacctatatccgtggttag

SEQ ID NO: 7795 - protein, 369 aa, Debaryomyces hansenii CBS767
MKESDPNIVDDNAVADSESVVEEENILSHTEDEGDEDEENDKNEPLPVEYPGTVLPDDHPQHIDADADLTKGYDSDTDYLDLIHMKIGSMEDLNLSRFNKLESLCLRQNLITSMVEVKVLPGETLQELDFYDNRINHISSQISKLTNLTNLDLSFNKIKNIKNLESLTKLEHLYFVQNKIKDIKNLETLQNLKNLELGGNKIEVISETLDKLVNLQQLWLGKNKIEKLENMSNLTNLRVLSIQSNRITKIEGLENLVNLEELYLSHNGITKIENLDKNANLQVLDVTSNRLTTLDNLNHLTKLTDFWCSYNKISSFEEIGKELGKLPELDTVYFEGNLVQTQNPTAYRRKIKLYLGPSLAKIDATYIRG

SEQ ID NO: 7796 - DNA, 1059 bp, Yarrowia lipolytica CLIB122
  CDS (1)..(1059)
atgaccgcagaggacaccaaacctgaagccaaggctcagcccacccaagagcctgctgctgagacagaatcggctgtcacagtggttcctccatctttcgagtccgacgtttccgaagatgaagaggaggaagctttcgaggcaattgaggccgacgaagaccttctggccgatgctgacctcgacattctcgacattgacctcactcatctcaagatccgtgactttgccaagcttggtctgggtcgattcaagcagcttgagaccctctgtctgcgacagaacatttctcctagcacggatggcctggaggaggtatctgataccctggttgatctcgacgtgtacgataaccgaattggcaagatcgagaatgtgaaccatctggtgaacctcaccaatctggatttctccttcaacaagatccgtcacatcaagaacgtcagcaaactcacaaaggtcatcaacttctatctttgccagaacaagatccaggaaattcgaggtctggacaacatgcctgatcttgttaaccttgagcttggagccaaccgaatccgagtcattgagaacttggaccatctcaagaacctgcgtcagctgtggctcggaaagaacaagatccgaaagctgtctggtctgtcgggactggagagtctagaaaccctgtctattcaatccaacagaatcaccaaaatcgagggtctggagaaactgaagaacctggaagagctgtacattagtcacaacggaatcacgaagatcgagggcctggaacacaacaccaagctgcgaaccctggacattactggaaaccccatcaccaccctggagggtgtttcgcacctcaaggatctggaggagttctgggcctcggattgcaagctctccaactacaaggagattgagactgagcttggacagctgccaaacctcgaaacagtctactttgagcgaaaccctctgcaccgagaaaaccctgccacctacagaaacaaggtgcgactttgtttgggcccttcccttcgacagattgacgctactttcatcaagtcttag

SEQ ID NO: 7797 - protein, 352 aa, Yarrowia lipolytica CLIB122
MTAEDTKPEAKAQPTQEPAAETESAVTVVPPSFESDVSEDEEEEAFEAIEADEDLLADADLDILDIDLTHLKIRDFAKLGLGRFKQLETLCLRQNISPSTDGLEEVSDTLVDLDVYDNRIGKIENVNHLVNLTNLDFSFNKIRHIKNVSKLTKVINFYLCQNKIQEIRGLDNMPDLVNLELGANRIRVIENLDHLKNLRQLWLGKNKIRKLSGLSGLESLETLSIQSNRITKIEGLEKLKNLEELYISHNGITKIEGLEHNTKLRTLDITGNPITTLEGVSHLKDLEEFWASDCKLSNYKEIETELGQLPNLETVYFERNPLHRENPATYRNKVRLCLGPSLRQIDATFIKS

SEQ ID NO: 7798 - DNA, 2733 bp, Aspergillus nidulans FGSC A4
  CDS (1)..(2733)
atgttcggcaagagtccagaacgaagcccgcctccgacgacttcaaagagcacagaacaagcgccaatgcctaccgcgacgggctccttggagccaagtaatgaatcgccatctcacggccgatccgcgacaacagataactcgcccccggcgcctcgtcccaacctttctgagaaagttcaagcaccgtttgtacctggtcaaacttccgaagccgcgcccactgccgttactactgatgctccaaaaaagcaccatcgccttttacccctaccatcgcggacatctctaaaagcagataggtcatcaacgtctgataggactcaagatggaccacatgacggatctgagaacacacttcgtggttcgcggaggagtcttctgaggggccgaagggatagaagcagaggaagcagcatgcgatccaaagagcaaaatccggacgagcctagtctggaggaaaataagactgctagccctgatgtgcacgatcaaacgagatcggacaaggcttctaaaccctcgcgaaaactcttcgcctttctgagctgctgttcgtcatctgatgtcgaccccgaggacggttctattcctccgaagaagactcccacacggctatccgttgttcagactcagccaacgccggagaaagcggatgtcaatgccgccgactcgagtatggcggagtccaagatgtcgagttatttcaaggacgagaagcccaatatgacagtgattcccgacaaacaatcatcacatgaagagggtgctgcggaaccaagctcgcaatatgatggaacaaaaacggcgccagttatacctgaatctgttcaaaatcaaccttcatcaagcgcggacaaagaaacccgagtgccggacacacaatcgtcgatccagccggcgattgtcgccactgagcccacgacggtcgaggaatcagatgaaaatacaaatgcggatgagaatgcggcagaaggccaggagacggagaactttgaggtgtccgctcaacccgctgtgacagaggttgaaccgaagcaacttccacgagacgacgaggctgtcaggttacctcctccgccgccgttaggcaaacagccagaaacttccgtgcaggagagagcgcagcaatggttactgcccccggctttaccacatctacgagatcgcaagtgcttggttctggatctcgacgagacattggtgcatagtagctttaagtgtgatttgaaggttcttgaacgtgctgatttcaccattcctgtggagattgaaggccagtaccataacatttacgtgattaaacggccaggagttgatcagttcatgaagcgagttggagaactgtatgaggtagttgtgttcacagcatctgtttcaaaatatggcgatcctttgttggaccaattggacattcatggtgtcgtccaccacaggctgttccgggatagttgctacaaccaccaagggaactacgtcaaggttggccgtgacctccgggacactattatcattgataactccccaacgtcctatatatttcaccctcaacatgcgatacccatcagcagctggttctctgacgcccacgataacgagcttcttgaccttattcctgttctcgaagatcttgccggtacccagacttctcgatcatggtggcttgcatataggcctgcattgtttgttactgcaaaaacaattcgtgctctagcagttactcactctccaaccatcccacctgcccctcccccaccgaatcgtaccaccatgaaagacagcaaaggctgggatgggaagctacgcgttgaacccaaagcgacaataacaaacccagaggccctggaggacccggattactcagattcggatgcgcctcctgtcgaggagattgaggcggacgaagatttattagaggatgaggataaggacgtcgaacgattatgcctgcggcaaaatcaaatatcacggattgaattaccctctagcctcggcgaaacactacaagagttggatctttacgacaatctcatatcacaccttaaagggcttgatgatttccataacttaactagcttggatttgagcttcaataagctcaagcacatcaagaatatctcgcacctagtcaagctgaaggacctctattttgtgcagaataagatctcgaagattgaagggcttgaggggttgacggaaataaagaacttggaattaggggctaataagattcgagaaatcgagaaccttgagacattgagcgccctagaggagctttggcttgggaagaacaaaatcacagaaatgaagaacctcgacgctctaacgaaccttcgcatactttcaatccaatctaatagactcaccagcctaaaaggtctctcatcgctcaagaacctggaagaactgtacgtgtcgcataacgctattacggatcttgcgggcttagaatcgaacaatgcccttcgcgtgctagacttctcgaacaaccaagtttcaaaattggagcacttgtcccatttgaaagaactggaagagctctgggcatccaataaccagctctcaagctttaacgaggtggagcgcgagctaaaagataaggaaaacttaaaaacagtgtattttgaagggaatccgctgcagacaaatgggccggtcgtgtaccggaacaaggtgcgcttagccataccgcaaattatgcagattgatgctacgtttgtacgagttgcttga

SEQ ID NO: 7799 - protein, 910 aa, Aspergillus nidulans FGSC A4
MFGKSPERSPPPTTSKSTEQAPMPTATGSLEPSNESPSHGRSATTDNSPPAPRPNLSEKVQAPFVPGQTSEAAPTAVTTDAPKKHHRLLPLPSRTSLKADRSSTSDRTQDGPHDGSENTLRGSRRSLLRGRRDRSRGSSMRSKEQNPDEPSLEENKTASPDVHDQTRSDKASKPSRKLFAFLSCCSSSDVDPEDGSIPPKKTPTRLSVVQTQPTPEKADVNAADSSMAESKMSSYFKDEKPNMTVIPDKQSSHEEGAAEPSSQYDGTKTAPVIPESVQNQPSSSADKETRVPDTQSSIQPAIVATEPTTVEESDENTNADENAAEGQETENFEVSAQPAVTEVEPKQLPRDDEAVRLPPPPPLGKQPETSVQERAQQWLLPPALPHLRDRKCLVLDLDETLVHSSFKCDLKVLERADFTIPVEIEGQYHNIYVIKRPGVDQFMKRVGELYEVVVFTASVSKYGDPLLDQLDIHGVVHHRLFRDSCYNHQGNYVKVGRDLRDTIIIDNSPTSYIFHPQHAIPISSWFSDAHDNELLDLIPVLEDLAGTQTSRSWWLAYRPALFVTAKTIRALAVTHSPTIPPAPPPPNRTTMKDSKGWDGKLRVEPKATITNPEALEDPDYSDSDAPPVEEIEADEDLLEDEDKDVERLCLRQNQISRIELPSSLGETLQELDLYDNLISHLKGLDDFHNLTSLDLSFNKLKHIKNISHLVKLKDLYFVQNKISKIEGLEGLTEIKNLELGANKIREIENLETLSALEELWLGKNKITEMKNLDALTNLRILSIQSNRLTSLKGLSSLKNLEELYVSHNAITDLAGLESNNALRVLDFSNNQVSKLEHLSHLKELEELWASNNQLSSFNEVERELKDKENLKTVYFEGNPLQTNGPVVYRNKVRLAIPQIMQIDATFVRVA

SEQ ID NO: 7800 - DNA, 1125 bp, Candida albicans SC5314
  CDS (1)..(1125): transl_table=12
atgccaatacaagaaaccaataaagaattagttgagaaaccggtcgggattctacaagaagaggagaaggaggaaccaattctttctcacactgaagatgaagatgacgatgacgatgatgacgaagacgaagacgataaaaatcaacaaggtaatctggcagttcaatatcctggaactgtcttaccagataatcatccccaagaaattgaagctgatcaggacttaaccactgggtatgatcttgacactgattacattgacttagtgcacttgaagatttcatcacttgaggatttacacttggaacgtttcaagaaattggaatctttgtgtttgagacaaaatttgattacttcgatggttggagtcaaagatttgcctgacactttggaagaactcgatttgtacgataatagaataaaccacatatcaagttccattaaacatttggttcatttgacaaatctagatctttcattcaacagaatcaaaaacatcaaaaatattgagacattagttgaacttgaaaacttgtattttgttcaaaacaagattagggaaatcaagaatcttgacacgttgactaaagtgactaatttagaattaggtgggaataagatagaagtgattgagaatcttgataaacttgtaaatataaagcaattgtggttagggaaaaatagaatatacaagctccagaatatggataatttggtgaatttaagagttctttcaatacaatccaatagaatcactaaaattgaggggcttgaaaacttgaaaaacttagaagaattatatttgtcccacaatgggatttcggagattgagaatctcgaaaataacataaacttacaagtgttggatgtcacggcaaataaaatcagtaacttgaaaggattgtcgcatttagtcaaattgacggacttttggtgttcatataatcaagtatccagtttcgaagaaattggtaaggagttgggtaaattgcctgatttggagtgtgtttattttgaaggcaacccggtgcaactccaaaatccaagtgcatatagacgaaaaatgaagttatatttaggtccatcgttaaacaaaattgacgcaacttatgtccactcctga

SEQ ID NO: 7801 - protein, 374 aa, Candida albicans SC5314
MPIQETNKELVEKPVGILQEEEKEEPILSHTEDEDDDDDDDEDEDDKNQQGNSAVQYPGTVLPDNHPQEIEADQDLTTGYDLDTDYIDLVHLKISSLEDLHLERFKKLESLCLRQNLITSMVGVKDLPDTLEELDLYDNRINHISSSIKHLVHLTNLDLSFNRIKNIKNIETLVELENLYFVQNKIREIKNLDTLTKVTNLELGGNKIEVIENLDKLVNIKQLWLGKNRIYKLQNMDNLVNLRVLSIQSNRITKIEGLENLKNLEELYLSHNGISEIENLENNINLQVLDVTANKISNLKGLSHLVKLTDFWCSYNQVSSFEEIGKELGKLPDLECVYFEGNPVQLQNPSAYRRKMKLYLGPSLNKIDATYVHS

SEQ ID NO: 7802 - DNA, 1119 bp, Cryptococcus neoformans var. neoformans B-3501A
  CDS (1)..(1119)
atggaccagcagcaagcatcgccgagtatctcatcagacgtccagcaatcggcgaaccagcatgtgccttcccaggccaagcctcgggcaaggttaggccccaccgaggtagtccaacttccggcgtcagactcagagcccgacgatgaggacgggaacaatcaggagacagatgcagggggagacgggagtcccgacttcttaaaagattatccagaagatacagaggatcttcaactcttgcatctccgcttgaaaacacctctactcgtacctctcaactttccgaggtttgggaaccatttgaaaaggctatgtctgcgtcaaaacgagcttacttcacccctgccatcaggcgcttttgccaacttgacagagttagaagagctggatttctatgataatagactcggacctcacgtgagggatgaggagttggctggatgccccaatattagtacactggatctcagctttaataacattcggcacgcaccctccctccccagcctgcaacatgtgaatacgttgtatctggttcaaaacaaaatatctaggttagaaaaaggcgagctcgattggtgtcaagacacaatgaaaagcttagagctagggggtaacaggattagggtcatcgagaatctcgacaaattgatacatctgcaggaactgtggctggggaagaataagatccgtgtgcttgagaatctgtccacattctcttctttacgcattctttctttgcaatcaaatcgcatcaccaaattggagaatttagagggactggtcaatcttgaagaattgtatctatcccataacggcttgcaaaagattgagggtttacatcataatttgactacactggatgtcggtaacaatttcataaaagagattgaaaatctgtcgcatctatcaaatctggaagagttttgggcaagtaataatcaaatcggcagtctccatgcactggaatctgaacttcgtcccctaactaacctctgcactatttaccttgaaggaaacccatgccagaaggaagatatgggcaactataggcgaaagatcatgttggccttaccccaagtcaaacaaattgatgcgacgtatgtgaaagcttga

SEQ ID NO: 7803 - protein, 372 aa, Cryptococcus neoformans var. neoformans B-3501A
MDQQQASPSISSDVQQSANQHVPSQAKPRARLGPTEVVQLPASDSEPDDEDGNNQETDAGGDGSPDFLKDYPEDTEDLQLLHLRLKTPLLVPLNFPRFGNHLKRLCLRQNELTSPLPSGAFANLTELEELDFYDNRLGPHVRDEELAGCPNISTLDLSFNNIRHAPSLPSLQHVNTLYLVQNKISRLEKGELDWCQDTMKSLELGGNRIRVIENLDKLIHLQELWLGKNKIRVLENLSTFSSLRILSLQSNRITKLENLEGLVNLEELYLSHNGLQKIEGLHHNLTTLDVGNNFIKEIENLSHLSNLEEFWASNNQIGSLHALESELRPLTNLCTIYLEGNPCQKEDMGNYRRKIMLALPQVKQIDATYVKA

SEQ ID NO: 7804 - DNA, 1140 bp, Phaeosphaeria nodorum
  CDS (1)..(1140)
atgctgccccgcgcagcgagctcgaccccaccccatccggacgcgaacggcacgtctgaactacgcgacgaggacaaggacgaccacaagccgcgggacagcaatggctgggacgggaagctaagagtggacaagcttgcgctgagcgacgagcccagagacccgactgttgagattcagagcgacccggaggtatcagacgaggaagggccggcaccagaacagctgcctgcagacgaggatctgctcgacgatacaccagaagacgaagaagagattgagctggtgcactgcaaaatcgcagacatggcgtcgctgcggttggagcgcttcaagcagatgaagcgcctctgcctacgccaaaacaaaatcgaagcaatcgacatccccgccgccctcgccccctccctcaccgaaatcgacttctacgacaacctcatcgcgcacatcaagggcctcgacgccttcacaaacctcgtctccctcgacctctccttcaacaagataaaacatatcaagcgcctcgcccacctgaccaagctcaaagacctctacttcgtccaaaacaaaatcagcgttatcgagaacctcgaagggctgacaaatctgcgccaaatcgagctgggcgcgaatcgcatccgcgaaataaccggtctcgagacgctgacgaaccttgaggagctgtggctgggaaagaacaagatcacggagataggcggcttgtccacgttgaccaacctgaagatattgagcatccagtccaaccgcctgcgctccatcacaaacctctcctccctcacctccctcgaagaactgcacatctcccacaacctgctcacctcgctctccggcctctcagaaaacaagaacctgcgcgtcatcgacatcagcgcgaatcccatcgagcacctctccggcctggacgggctcacgcacctgacagagttctgggcgagcaactgcaagctggccagtttccaggaggtcgagaaggagctgggggacaaggaggagctcgagacggtctactttgaggggaacccactgcagagacagcagcccgcgctgtatcggaataaggtcaggctggcgttgccgagaattgtgcagattgatgctacgtttgtcaagccggtgtag

SEQ ID NO: 7805 - protein, 379 aa, Phaeosphaeria nodorum
MLPRAASSTPPHPDANGTSELRDEDKDDHKPRDSNGWDGKLRVDKLALSDEPRDPTVEIQSDPEVSDEEGPAPEQLPADEDLLDDTPEDEEEIELVHCKIADMASLRLERFKQMKRLCLRQNKIEAIDIPAALAPSLTEIDFYDNLIAHIKGLDAFTNLVSLDLSFNKIKHIKRLAHLTKLKDLYFVQNKISVIENLEGLTNLRQIELGANRIREITGLETLTNLEELWLGKNKITEIGGLSTLTNLKILSIQSNRLRSITNLSSLTSLEELHISHNLLTSLSGLSENKNLRVIDISANPIEHLSGLDGLTHLTEFWASNCKLASFQEVEKELGDKEELETVYFEGNPLQRQQPALYRNKVRLALPRIVQIDATFVKPV

SEQ ID NO: 7806 - DNA, 990 bp, Medicago truncatula
  CDS (1)..(990)
atggaatcatcaacaacaacaacggctactgatctagaagacgacgaatcatcaaccctattggatctcaccagttaccagcttcacgatctcgactcagtcgaattaccttctaacctcaccgagttagacctcaccgccaatcgtttatccactctcgaccctcgcatcgcccaactctccgatctcaaaaatctctctctccgtcaaaacctaatcaccgacgccgccgttgttcctctctcttcctggaacaccctctcttctctcgaggaattggtgttgcgtgataatcaattaaagaatattcctgatgtaagcatatttaagaagcttttggtttttgatgtgtctttcaacgaaatcgcttcgttacatggtgtgtctagggtttgcaacacgctcaaagagctttatgtgtcaaaaaatgaagttaccaaaattgaggagattgaacattttcatcaattgcagattttggaactcggatccaacaaattacgggtgatggagaatttgcagaccctggtgaatttgcaagagttatggcttggacgtaatcgaattaaagttgtgaatctatgtggtttgaaatgcattaagaagattagtttgcaaagcaatcgtcttacttcgatgataggatttgagggttgcatagctctagaagaactatacttgagccacaatggtatcacaaaaatggaaggcttgtcatctttagccaatctccgggttttagatgtatcatcaaataagctaacctctgtggatgacattcataacctaacacaattagaagatttgtggcttaatgacaaccaaatagaatcactcgaaggatttgctgaggctgtcgctggttcaagagagaagcttaccacaatctacctagaaaataacctttgtgctaagtcacccaactatactgccatcttaagggaagtctttcccaacattcaacaaatcgattctgatgtattttcttaa

SEQ ID NO: 7807 - protein, 329 aa, Medicago truncatula
MESSTTTTATDLEDDESSTLLDLTSYQLHDLDSVELPSNLTELDLTANRLSTLDPRIAQLSDLKNLSLRQNLITDAAVVPLSSWNTLSSLEELVLRDNQLKNIPDVSIFKKLLVFDVSFNEIASLHGVSRVCNTLKELYVSKNEVTKIEEIEHFHQLQILELGSNKLRVMENLQTLVNLQELWLGRNRIKVVNLCGLKCIKKISLQSNRLTSMIGFEGCIALEELYLSHNGITKMEGLSSLANLRVLDVSSNKLTSVDDIHNLTQLEDLWLNDNQIESLEGFAEAVAGSREKLTTIYLENNLCAKSPNYTAILREVFPNIQQIDSDVFS

SEQ ID NO: 7808 - DNA, 1059 bp, Aspergillus oryzae
  CDS (1)..(1059)
atgaaggacagcaaagggtgggacggaaaactgagagttggtccccaagcgaccatcacgaatccggaggcaatcgaggacccggattactcggacgaggatgcgccgccggtagaggagatcgaggcagacgaagacttgctagaggatgaggataaggatacagaggagatcgacctcgtccattgtcgtattgggtccatcccggctttacatctagagcgattccctaaagtacagagaatatgtctgcggcagaaccaaataacgcggatcgcgtttcctcctgaagtcgccgggtcgctggtcgaactcgatctctacgataaccttatttcgcatgtcaagggtctggatgagttcaaggatctgactagtttggatctgagcttcaataagataaagcatataaagaatatctcgcatctggtcaagttgacggacttgtattttgtgcagaacaagatctcgaagattgaagggttggaggggttgaaggtattgaggaatctggagctgggcgctaatcggatcagggaaatcgagaaccttgagtcgttgacgtctctggaggagctgtggcttggaaagaataagatcactgaattcaagaatctggatgctttgcagaatctcaaaatcctctctattcagtcgaaccgacttactagtctgaacggactctcctccctcaagaacctcgaagaactctacgtctctcataacgctattaccgagctcagtggtctcgaatcgaacaccaagctgcgcgttcttgacttctcgaataaccaggtctctaagctggagcatctgtcgcatttggagaacttggaggagctctgggggtcgaacaaccagttatctagcttcgacgaggtggagaaggagctgaaggacaaggagaagctacagacggtctactttgagggcaacccgttgcagacgaagggacccgcggtgtaccggaataaggtgcgcttagcgataccgcatattatgcagatcgacgctagtacggcatggagtacagtccggaaggaattacgctaccattag

SEQ ID NO: 7809 - protein, 352 aa, Aspergillus oryzae
MKDSKGWDGKLRVGPQATITNPEAIEDPDYSDEDAPPVEEIEADEDLLEDEDKDTEEIDLVHCRIGSIPALHLERFPKVQRICLRQNQITRIAFPPEVAGSLVELDLYDNLISHVKGLDEFKDLTSLDLSFNKIKHIKNISHLVKLTDLYFVQNKISKIEGLEGLKVLRNLELGANRIREIENLESLTSLEELWLGKNKITEFKNLDALQNLKILSIQSNRLTSLNGLSSLKNLEELYVSHNAITELSGLESNTKLRVLDFSNNQVSKLEHLSHLENLEELWGSNNQLSSFDEVEKELKDKEKLQTVYFEGNPLQTKGPAVYRNKVRLAIPHIMQIDASTAWSTVRKELRYH

SEQ ID NO: 7810 - DNA, 1381 bp, Arabidopsis thaliana
  CDS (53)..(1039)
agttccccacaaagctcgttgtcgtcatcgcgcgagcttgaaccaaaaaaccatgaacagtgataaggaagaggagccattggaagagatcggcgattcgaataatgttctcgatctcactagctatcagctccacagtctcgatacggtcgagttaccgccgaacctgattgagctggaccttacggcgaaccgtttgtcgggattggactcgaggatcgctcagctctccacgcttaagaagctttctctccgccaaaacctaattgatgattccgccgtcgaaccgttgtctcactgggacgccttgtccgatctcgaggagttagttctcagagataacaagctagcaaaagtaccagatgtcagcatattcacgaagcttttggtttacgacatatctttcaatgaaatcacttctttggaaggaatatccaaggcctctagcacactgaaggaactctatgtgtctaaaaatgaagttaacaagattatggagattgaacacttacacaacttgcagattcttgaactggggtctaatagattgcgggtgatggaaaatctggaaaacttcacaaaattagaagaactatggctcggaagaaaccgtataaaagttgttaacctgtgtgggctcaaatgcataaaaaagattagcttgcagagcaatcgattgacctctatgaaaggatttgaggaatgtgttgctcttgaagagttatatttgagccataatggtatctccaaaatggaaggcttgagtgcattggtcaacctacgggtattggacgtgtcgaacaacaagcttacttcagttgatgacattcagaacctcacaaagttggaagatttgtggcttaatgacaaccagatagaatcactggaagcaatcacagaagctgttacaggatctaaagagaagcttaccactatctacctcgaaaataacccttgtgccaagtcttctgattatgttgctgcggtcagacaaatcttcccgaatgtggagcaaattgattctaacatatttgcttagagatggatatattccttgtcgtgctgtttgtatgaatgtctgcttcctcatcccatgggcatgggcatcgaatttaggaaatcaggtacaacacggattcctcaaaatatacatgtgtctgctgtttatcataaagaagtgcaaatgagcaaattaaatcgctctcgtcatggatatttattaaaacgtttttgaaattctagtgttcccttgcaagtaaaccaattcttgtttttggtctgtaattgtatgtggactgtgtctgtaaaagggaatccccgagtctgaagttgtctttgtttcaagtttcaaccgagaacactaacttgaatactttgatcc

SEQ ID NO: 7811 - protein, 328 aa, Arabidopsis thaliana
MNSDKEEEPLEEIGDSNNVLDLTSYQLHSLDTVELPPNLIELDLTANRLSGLDSRIAQLSTLKKLSLRQNLIDDSAVEPLSHWDALSDLEELVLRDNKLAKVPDVSIFTKLLVYDISFNEITSLEGISKASSTLKELYVSKNEVNKIMEIEHLHNLQILELGSNRLRVMENLENFTKLEELWLGRNRIKVVNLCGLKCIKKISLQSNRLTSMKGFEECVALEELYLSHNGISKMEGLSALVNLRVLDVSNNKLTSVDDIQNLTKLEDLWLNDNQIESLEAITEAVTGSKEKLTTIYLENNPCAKSSDYVAAVRQIFPNVEQIDSNIFA

SEQ ID NO: 7812 - DNA, 999 bp, Schizosaccharomyces pombe
  CDS (1)..(999)
atgagtaacgtttccagtgaagatggaattgctcctgagacacagcttatcattgatgaccctgatgtccagcaaatcgatgcagatgaagatctgcttgatgatgtgccggacgacgtcgattgcgtagagcttattcagtctcgtatacaaagcatggcatctcttggacttgaaagatttaaaaatttacagagtttatgtcttcgccaaaatcaaatcaagaaaattgaatcagttccagaaacattgactgaattggatttgtatgacaacttaattgtcagaattgaaaacttggataatgtcaaaaatctcacttacttggatctgtctttcaacaatattaaaacgattcgaaacattaaccatttaaagggcttagaaaacctcttctttgtccaaaacagaattaggagaattgaaaatttagaaggtttagacaggttaacgaaccttgaattgggggggaacaaaataagagtaattgagaatttggatactttagttaatttagaaaaactctgggttggcaaaaacaaaataaccaaattcgagaattttgaaaaattacagaaactttctcttttatcaattcaatcaaatcgaataactcaatttgaaaacttggcctgcttatcccattgtcttcgagaattatatgtatcgcataatggtctaactagtttctctggtattgaggtcctcgaaaaccttgaaattttggatgtttccaacaacatgattaagcacctttcatacttagcgggactaaaaaatctagtagaattatgggctagcaataacgaactgtcttcttttcaagaaattgaagacgagctttctggtcttaaaaaacttgaaaccgtttattttgagggaaatcctttgcagaaaaccaatcctgctgtttaccgtaacaaagttagattatgtcttccacagttacgccaaatagatgcaactattatccccaaaacttcgaagcaattcccctaa

SEQ ID NO: 7813 - protein, 332 aa, Schizosaccharomyces pombe
MSNVSSEDGIAPETQLIIDDPDVQQIDADEDLLDDVPDDVDCVELIQSRIQSMASLGLERFKNLQSLCLRQNQIKKIESVPETLTELDLYDNLIVRIENLDNVKNLTYLDLSFNNIKTIRNINHLKGLENLFFVQNRIRRIENLEGLDRLTNLELGGNKIRVIENLDTLVNLEKLWVGKNKITKFENFEKLQKLSLLSIQSNRITQFENLACLSHCLRELYVSHNGLTSFSGIEVLENLEILDVSNNMIKHLSYLAGLKNLVELWASNNELSSFQEIEDELSGLKKLETVYFEGNPLQKTNPAVYRNKVRLCLPQLRQIDATIIPKTSKQFP

SEQ ID NO: 7814 - DNA, 987 bp, Brassica napus
  CDS (1)..(987)
atgagcagtgaaaaggaagagcaaccatcaatggagatcgacgattcggacaatgttgtcgatctcactagctgccagctccacactctcgatgcgatcgagttaccaccgactctaattgagctggaccttacggcgaaccgtttatcggaattagactcgagaatcgctcagctctctgcgctcaagaagctttctcttcgccaaaacctaatcgacgattccgccgtcgagcctttgtctcgctgggacgccttgtccgatctcgaggagctgattctcagagataacaagctagcaaaggttccagatactgccatattctcaaagcttttggtttttgacgtatctttcaatgagatcacttcgctgcaagggttatcaaaggcctctagcacgctcaaggagctctacgtgtctaagaacgaagttaacaagattatggagattgaacacttgcacgacttgcagattcttgaactcggttctaatagattacgggtaatggagaatatggagaacttcactaaattagatgaactgtggcttggaagaaaccgtatcaaagttgtgaacctgtgtgggctcacatgtattaagaagattagcttgcagagtaatcgattgacctctatgaaaggatttgaggagtgtgttgctctggaagaaaggtatttgagccataatggtatctcaaaaatggaaggcttgagtgcattggttaacctacgggtattggacgtctcgaacaacaagctcacatcagttgatgacattcagaacctcacaaagttggaggatttatggcttaatgacaaccagatagaatcacttgaagctatcacagaagctgttacaggctctaaagagaaactcaccactatctacctcgaaaataacccctgtgccaagtcttctgattacgttgctgtgctgagacaaatcttcccaaatgtggagcaaatagattctaacttatttgcttga

SEQ ID NO: 7815 - protein, 328 aa, Brassica napus
MSSEKEEQPSMEIDDSDNVVDLTSCQLHTLDAIELPPTLIELDLTANRLSELDSRIAQLSALKKLSLRQNLIDDSAVEPLSRWDALSDLEELILRDNKLAKVPDTAIFSKLLVFDVSFNEITSLQGLSKASSTLKELYVSKNEVNKIMEIEHLHDLQILELGSNRLRVMENMENFTKLDELWLGRNRIKVVNLCGLTCIKKISLQSNRLTSMKGFEECVALEERYLSHNGISKMEGLSALVNLRVLDVSNNKLTSVDDIQNLTKLEDLWLNDNQIESLEAITEAVTGSKEKLTTIYLENNPCAKSSDYVAVLRQIFPNVEQIDSNLFA

SEQ ID NO: 7816 - DNA, 993 bp, Glycine max
  CDS (1)..(993)
atggaggcagtggaatcaatagcggttccggaaccggacgaagacgatccttcatcgacgcttctggatctctcgagttaccagctccacgaccttgactcggtcgagttgccacccagcctcaccgagttggacctcaccgcgaatcgcttgtccacgctggacccgcgcatagggaacctctcccatctcaagaagctctccctccgccaaaacctcatcaccgacgccgccgttctccctctctcttcctggaacgccatttcctctctcgaggagcttgtgctgcgcgataatcaattgaagaacattcctgatgtcaccgtatttaagaaacttctggttttcgatgttgcgttcaacgagattagttcgctacatggcttgtccagggtctccgataccctcaaggaactctacgtgtccaacaacgaagttgcgaagattgaggagatcgagcacttccatcagctccagattcttgaactcggctccaataaattacgggtgatggagaatttacagagcctcgagaatttgcaggagctgtggcttgggcagaatcgaattaaagttgtgaatctgtgtggtctcaaatgcattaaaaagattagtttccaaagcaatcgcctcacttcaatgacgggatttgagggttgtgtagctctagaagaactgtacttgagccataatggtattgcaaaaatggaagggttgtcatcgttggtcaatcttcgggttttagatgtatcatcaaataagataactttggtggatgacattgtgaacctgacgaaattggaagatttgtggcttaatgataaccaaatagcatcgctcgaaggaattgcggaggctgtcactggttcaaaagagaagcttaccaccatctacctagaaaataacccatgtgctaagacgcccaactatactggaattctacggaaaatcttccccaacattcaacaaattgattctgatatattttcttag

SEQ ID NO: 7817 - protein, 330 aa, Glycine max
MEAVESIAVPEPDEDDPSSTLLDLSSYQLHDLDSVELPPSLTELDLTANRLSTLDPRIGNLSHLKKLSLRQNLITDAAVLPLSSWNAISSLEELVLRDNQLKNIPDVTVFKKLLVFDVAFNEISSLHGLSRVSDTLKELYVSNNEVAKIEEIEHFHQLQILELGSNKLRVMENLQSLENLQELWLGQNRIKVVNLCGLKCIKKISFQSNRLTSMTGFEGCVALEELYLSHNGIAKMEGLSSLVNLRVLDVSSNKITLVDDIVNLTKLEDLWLNDNQIASLEGIAEAVTGSKEKLTTIYLENNPCAKTPNYTGILRKIFPNIQQIDSDIFS

SEQ ID NO: 7818 - DNA, 993 bp, Glycine max
  CDS (1)..(993)
atggaggcagtggaatcaatagcggttccggaaccggacgaagacgatccttcatcgacgcttctggatctctcgagttaccagctccacgaccttgactcggtcgagttgccacccagcctcaccgagttggacctcaccgcgaatcgcttgtccacgctggacccgcgcatagggaacctctcccatctcaagaagctctccctccgccaaaacctcatcaccgacgccgccgttctccctctctcttcctggaacgccatttcctctctcgaggagcttgtgctgcgcgataatcaattgaagaacattcctgatgtcaccgtatttaagaaacttctggttttcgatgttgcgttcaacgagattagttcgctacatggcttgtccagggtctccgataccctcaaggaactctacgtgtccaacaacgaagttgcgaagattgaggagatcgagcacttccatcagctccagattcttgaactcggctccaataaattacgggtgatggagaatttacagagcctcgagaatttgcaggagctgtggcttgggcagaatcgaattaaagttgtgaatctgtgtggtctcaaatgcattaaaaagattagtttccaaagcaatcgtctcacttcaatgacgggatttgagggttgtgtagctctagaagaactgtacttgagccataatggtattgcaaaaatggaagggttgtcatcgttggtcaatcttcgggttttagatgtatcatcaaataagataacttcagtggatgacattgtgaacctgacaaaattggaagatttgtggcttaatgataaccaaatagcatcacttgaaggaattgctgaggcagtctctggttcaaaagagaagcttaccaccatctacctaaaaaataacccatgtgctaagacgcccaactatactggaatcctacgggaaatcttccccaacattcaacaaatagattctgatatattttcttag

SEQ ID NO: 7819 - protein, 330 aa, Glycine max
MEAVESIAVPEPDEDDPSSTLLDLSSYQLHDLDSVELPPSLTELDLTANRLSTLDPRIGNLSHLKKLSLRQNLITDAAVLPLSSWNAISSLEELVLRDNQLKNIPDVTVFKKLLVFDVAFNEISSLHGLSRVSDTLKELYVSNNEVAKIEEIEHFHQLQILELGSNKLRVMENLQSLENLQELWLGQNRIKVVNLCGLKCIKKISFQSNRLTSMTGFEGCVALEELYLSHNGIAKMEGLSSLVNLRVLDVSSNKITSVDDIVNLTKLEDLWLNDNQIASLEGIAEAVSGSKEKLTTIYLKNNPCAKTPNYTGILREIFPNIQQIDSDIFS

SEQ ID NO: 7820 - DNA, 993 bp, Zea mays
  CDS (1)..(993)
atggcctccggcgaaggtgtagttgatcagctgtacgaggcggctggcggcgaggcagtggccaagatagagggggaggccaaggtggaggcggaggccaagatggagacggaggagccggtgctgtacctcgacctgacgagctaccagctgcacgatctaagcgaggtggagatcccacccacgctggaggaggtcgacctcaccgccaaccgcctctcttctgttgatcctcgcatcggccaactcccccatctccgcaagctctcattccgccagaacctcctcgacgatgacgccgtcgcgccgctcacgtcctgggaggctattgccgggttgaaggagttcgtcattagagataacaaacttacaaggattcctgatgctggcatattcaaggatcttctggtgttcgatgtatctttcaatgagatatcttctttgactggtctgtccaaggtttccatcaaattgaaggaactttatgtttcaaaaaatgaagttgcaaagatggaagagcttgaacatttccatgcgctggaaattcttgaacttggtagcaacagattacgggtaatggaaaatcttgaaaccttgacaaatctacaagaactgtggttgggaagaaatcgaattcgagctgtcaacttgtgtggtttgaagctaattaagaaaataagtttgcaaagcaacagactgacttcaatgcatgggtttcaggaatgtgctgcattagaggagttatacctcagccataatggaatccaaaagatggaaggcctctctactttgcataacctccgcattttggatgtttcagctaacaagctaacgactatagaaaatatcgaaaccttaaccaggctggaggacctgtggttgaatgacaaccaaataccatctctagagggtatagagacagctttggctggttcgcgggagaagttgacgacaatctatctcgaacgaaatccctgtgtaagtatttcataa

SEQ ID NO: 7821 - protein, 330 aa, Zea mays
MASGEGVVDQLYEAAGGEAVAKIEGEAKVEAEAKMETEEPVLYLDLTSYQLHDLSEVEIPPTLEEVDLTANRLSSVDPRIGQLPHLRKLSFRQNLLDDDAVAPLTSWEAIAGLKEFVIRDNKLTRIPDAGIFKDLLVFDVSFNEISSLTGLSKVSIKLKELYVSKNEVAKMEELEHFHALEILELGSNRLRVMENLETLTNLQELWLGRNRIRAVNLCGLKLIKKISLQSNRLTSMHGFQECAALEELYLSHNGIQKMEGLSTLHNLRILDVSANKLTTIENIETLTRLEDLWLNDNQIPSLEGIETALAGSREKLTTIYLERNPCVSIS

SEQ ID NO: 7822 - DNA, 27 bp, Artificial sequence
  primer
atggataagaattcagttaacaaagat

SEQ ID NO: 7823 - DNA, 25 bp, Artificial sequence
  primer
tcagcctcttatatatgtcgcatca

SEQ ID NO: 7824 - protein, 297 aa, Artificial sequence
  consensus sequence
  Variant (2)..(21): Xaa in position 2 to 21 is any amino acid
  Variant (22)..(25): Xaa in position 22 to 25 is any or no amino acid
  Variant (27)..(27): Xaa in position 27 is any amino acid
  Variant (32)..(32): Xaa in position 32 is any amino acid
  Variant (34)..(42): Xaa in position 34 to 42 is any amino acid
  Variant (43)..(49): Xaa in position 43 to 49 is any or no amino acid
  Variant (51)..(52): Xaa in position 51 to 52 is any amino acid
  Variant (54)..(56): Xaa in position 54 to 56 is any amino acid
  Variant (59)..(71): Xaa in position 59 to 71 is any amino acid
  Variant (72)..(74): Xaa in position 72 to 74 is any or no amino acid
  Variant (76)..(78): Xaa in position 76 to 78 is any amino acid
  Variant (80)..(80): Xaa in position 80 is any amino acid
  Variant (84)..(84): Xaa in position 84 is any amino acid
  Variant (86)..(96): Xaa in position 86 to 96 is any amino acid
  Variant (97)..(97): Xaa in position 97 is any or no amino acid
  Variant (99)..(100): Xaa in position 99 to 100 is any amino acid
  Variant (103)..(105): Xaa in position 103 to 105 is any amino acid
  Variant (107)..(110): Xaa in position 107 to 110 is any amino acid
  Variant (112)..(119): Xaa in position 112 to 119 is any amino acid
  Variant (120)..(122): Xaa in position 120 to 122 is any or no amino acid
  Variant (124)..(125): Xaa in position 124 to 125 is any amino acid
  Variant (130)..(130): Xaa in position 130 is any amino acid
  Variant (132)..(138): Xaa in position 132 to 138 is any amino acid
  Variant (139)..(140): Xaa in position 139 to 140 is any or no amino acid
  Variant (142)..(143): Xaa in position 142 to 143 is any amino acid
  Variant (145)..(146): Xaa in position 145 to 146 is any amino acid
  Variant (148)..(148): Xaa in position 148 is any amino acid
  Variant (154)..(154): Xaa in position 154 is any amino acid
  Variant (156)..(156): Xaa in position 156 is any amino acid
  Variant (158)..(161): Xaa in position 158 to 161 is any amino acid
  Variant (162)..(162): Xaa in position 162 is any or no amino acid
  Variant (164)..(165): Xaa in position 164 to 165 is any amino acid
  Variant (167)..(172): Xaa in position 167 to 172 is any amino acid
  Variant (174)..(174): Xaa in position 174 is any amino acid
  Variant (179)..(190): Xaa in position 179 to 190 is any amino acid
  Variant (191)..(191): Xaa in position 191 is any or no amino acid
  Variant (197)..(197): Xaa in position 197 is any amino acid
  Variant (201)..(205): Xaa in position 201 to 205 is any amino acid
  Variant (209)..(211): Xaa in position 209 to 211 is any amino acid
  Variant (212)..(213): Xaa in position 212 to 213 is any or no amino acid
  Variant (215)..(216): Xaa in position 215 to 216 is any amino acid
  Variant (219)..(221): Xaa in position 219 to 221 is any amino acid
  Variant (223)..(232): Xaa in position 223 to 232 is any amino acid
  Variant (234)..(235): Xaa in position 234 to 235 is any amino acid
  Variant (237)..(239): Xaa in position 237 to 239 is any amino acid
  Variant (241)..(243): Xaa in position 241 to 243 is any amino acid
  Variant (245)..(261): Xaa in position 245 to 261 is any amino acid
  Variant (262)..(262): Xaa in position 262 is any or no amino acid
  Variant (264)..(264): Xaa in position 264 is any amino acid
  Variant (266)..(266): Xaa in position 266 is any amino acid
  Variant (268)..(268): Xaa in position 268 is any amino acid
  Variant (270)..(270): Xaa in position 270 is any amino acid
  Variant (273)..(277): Xaa in position 273 to 277 is any amino acid
  Variant (278)..(290): Xaa in position 278 to 290 is any or no amino acid
  Variant (292)..(295): Xaa in position 292 to 295 is any amino acid
LXXXXXXXXXXXXXXXXXXXXXXXXLXLRQNXIXXXXXXXXXXXXXXXXLXXLXXXDNXXXXXXXXXXXXXXXXLXXXDXSFNXIXXXXXXXXXXXXLXXLYXXXNXXXXIXXXXXXXXXXXLXXLELGXNXXXXXXXXXLXXLXXLXELWLGXNXIXXXXXLXXLXXXXXXSXQSNRXXXXXXXXXXXXXLEELYXSHNXXXXXEGLXXXXXLXXLDXXXNXXXXXXXXXXLXXLXXXWXXXNXXXXXXXXXXXXXXXXXXLXTXYXEXNPXXXXXXXXXXXXXXXXXXPXXXXID

SEQ ID NO: 7825 - protein, 43 aa, Artificial sequence
  protein pattern
  Variant (2)..(7): Xaa in position 2 to 7 is any amino acid
  Variant (9)..(9): Xaa in position 9 is Phe, Ile or Leu
  Variant (13)..(13): Xaa in position 13 is Lys or Arg
  Variant (14)..(14): Xaa in position 14 is Ile or Leu
  Variant (15)..(16): Xaa in position 15 to 16 is any amino acid
  Variant (17)..(17): Xaa in position 17 is Phe, Ile, Leu or Met
  Variant (18)..(18): Xaa in position 18 is any amino acid
  Variant (19)..(19): Xaa in position 19 is Gly, Asn or Pro
  Variant (20)..(20): Xaa in position 20 is Phe or Leu
  Variant (21)..(24): Xaa in position 21 to 24 is any amino acid
  Variant (25)..(25): Xaa in position 25 is Ala, Asn, Ser or Thr
  Variant (30)..(30): Xaa in position 30 is His or Tyr
  Variant (31)..(31): Xaa in position 31 is Ile, Leu or Val
  Variant (32)..(32): Xaa in position 32 is Ser or Thr
  Variant (35)..(35): Xaa in position 35 is any amino acid
  Variant (36)..(36): Xaa in position 36 is Ile or Leu
  Variant (37)..(37): Xaa in position 37 is Ala, Glu, Gln, Ser or Thr
  Variant (38)..(38): Xaa in position 38 is any amino acid
  Variant (39)..(39): Xaa in position 39 is Ile, Leu or Met
  Variant (40)..(40): Xaa in position 40 is Ala, Glu or Ser
  Variant (41)..(41): Xaa in position 41 is Gly or Asn
  Variant (43)..(43): Xaa in position 43 is Asp, Glu or Ser
LXXXXXXSXQSNXXXXXXXXXXXXXLEELXXXHNXXXXXXXLX

SEQ ID NO: 7826 - protein, 37 aa, Artificial sequence
  protein pattern
  Variant (2)..(3): Xaa in position 2 to 3 is any amino acid
  Variant (5)..(5): Xaa in position 5 is Asp or Glu
  Variant (7)..(7): Xaa in position 7 is any or no amino acid
  Variant (9)..(9): Xaa in position 9 is any or no amino acid
  Variant (11)..(11): Xaa in position 11 is any amino acid
  Variant (12)..(12): Xaa in position 12 is Ile or Leu
  Variant (13)..(13): Xaa in position 13 is Lys or Arg
  Variant (14)..(14): Xaa in position 14 is any amino acid
  Variant (15)..(15): Xaa in position 15 is Ile or Met
  Variant (16)..(16): Xaa in position 16 is Glu, Lys or Arg
  Variant (18)..(18): Xaa in position 18 is Ile, Leu, Met or Val
  Variant (19)..(19): Xaa in position 19 is Asp, Glu, Asn, Gln or Ser
  Variant (20)..(20): Xaa in position 20 is any amino acid
  Variant (21)..(21): Xaa in position 21 is Phe or Leu
  Variant (22)..(23): Xaa in position 22 to 23 is any amino acid
  Variant (25)..(26): Xaa in position 25 to 26 is any amino acid
  Variant (28)..(28): Xaa in position 28 is Phe, Trp or Tyr
  Variant (29)..(29): Xaa in position 29 is Phe or Leu
  Variant (30)..(30): Xaa in position 30 is Gly or Val
  Variant (31)..(31): Xaa in position 31 is any amino acid
  Variant (33)..(33): Xaa in position 33 is any amino acid
  Variant (35)..(36): Xaa in position 35 to 36 is any amino acid
  Variant (37)..(37): Xaa in position 37 is Ile or Val
LXXLXLXSXNXXXXXXNXXXXXXLXXLXXXXNXIXXX

SEQ ID NO: 7827 - protein, 33 aa, Artificial sequence
  protein pattern
  Variant (2)..(2): Xaa in position 2 is any amino acid
  Variant (3)..(3): Xaa in position 3 is Thr or Val
  Variant (6)..(6): Xaa in position 6 is Phe, Ile or Val
  Variant (7)..(7): Xaa in position 7 is Gly, Ser or Thr
  Variant (8)..(8): Xaa in position 8 is Ala, Gly, Asn or Ser
  Variant (10)..(10): Xaa in position 10 is any amino acid
  Variant (11)..(11): Xaa in position 11 is Ile, Leu or Val
  Variant (12)..(13): Xaa in position 12 to 13 is any amino acid
  Variant (14)..(14): Xaa in position 14 is Ile, Leu or Val
  Variant (15)..(15): Xaa in position 15 is Asp, Glu or Lys
  Variant (16)..(16): Xaa in position 16 is any amino acid
  Variant (17)..(17): Xaa in position 17 is Ile, Leu or Val
  Variant (18)..(19): Xaa in position 18 to 19 is any amino acid
  Variant (21)..(22): Xaa in position 21 to 22 is any amino acid
  Variant (24)..(24): Xaa in position 24 is Glu or Thr
  Variant (25)..(25): Xaa in position 25 is Asp or Glu
  Variant (26)..(26): Xaa in position 26 is Phe, Ile or Leu
  Variant (28)..(28): Xaa in position 28 is any amino acid
  Variant (29)..(30): Xaa in position 29 to 30 is any or no amino acid
  Variant (32)..(32): Xaa in position 32 is any amino acid
  Variant (33)..(33): Xaa in position 33 is Ile, Leu or Val
LXXLDXXXNXXXXXXXXXXLXXLXXXWXXXNXX

SEQ ID NO: 7828 - protein, 10 aa, Artificial sequence
  protein pattern
  Variant (2)..(2): Xaa in position 2 is any amino acid
  Variant (4)..(4): Xaa in position 4 is Ile or Val
  Variant (6)..(6): Xaa in position 6 is Phe or Leu
  Variant (8)..(8): Xaa in position 8 is any amino acid
  Variant (10)..(10): Xaa in position 10 is Leu or Pro
LXTXYXEXNX

SEQ ID NO: 7829 - DNA, 945 bp, Saccharomyces cerevisiae
  CDS (1)..(945)
atgacagccagtttaactaccaagttcttgaacaatacctatgaaaacccatttatgaatgcatccggtgttcattgcatgactacacaagaattagatgaattagcaaactctaaagctggcgcattcattacaaagagtgctacaaccttagaaagagaaggtaaccctgaaccacgttacatttctgtccctctaggcagtatcaactccatgggtttaccaaacgaaggtatcgactactatttgtcctatgtattaaaccgtcaaaagaattatcctgatgcacctgctattttcttctcagttgctggtatgagcattgatgaaaatttaaatttgttgaggaaaatccaagatagcgaattcaacggtattaccgagttaaacttgtcttgtcctaatgtgcctgggaaaccacaagttgcttatgactttgacttgacaaaggaaaccttggaaaaggtttttgcctttttcaaaaaacctcttggtgtcaagttgcctccttattttgattttgcccattttgatatcatggcaaaaatattgaacgagttcccattagcttatgtcaactctatcaatagtataggaaatggtcttttcattgatgtggagaaggagagtgtagtagtgaagccaaagaatggtttcgggggtattggaggtgaatatgttaagccaaccgcgctcgccaatgttcgtgcattttacactcgtttgagacctgaaatcaaagttatcggtacaggtggaattaagtccggtaaggatgcatttgaacatcttctatgtggtgcctctatgctacagattggtacagaattacaaaaagagggcgtcaagatttttgaacgtatcgaaaaagaattaaaagacataatggaagctaagggttatacatccatagatcagttccgtgggaagttgaacagcatttaa

SEQ ID NO: 7830 - protein, 314 aa, Saccharomyces cerevisiae
MTASLTTKFLNNTYENPFMNASGVHCMTTQELDELANSKAGAFITKSATTLEREGNPEPRYISVPLGSINSMGLPNEGIDYYLSYVLNRQKNYPDAPAIFFSVAGMSIDENLNLLRKIQDSEFNGITELNLSCPNVPGKPQVAYDFDLTKETLEKVFAFFKKPLGVKLPPYFDFAHFDIMAKILNEFPLAYVNSINSIGNGLFIDVEKESVVVKPKNGFGGIGGEYVKPTALANVRAFYTRLRPEIKVIGTGGIKSGKDAFEHLLCGASMLQIGTELQKEGVKIFERIEKELKDIMEAKGYTSIDQFRGKLNSI

SEQ ID NO: 7831 - DNA, 1245 bp, Oryza sativa (japonica cultivar-group)
  CDS (1)..(1245)
atggagtcgctgactctccgggcatcgccgtcgacggccgcgccgttgcgccgcgtccccgggcggcggcacgcggcggtgtccgtccgcgcctccgccggcgccggcgagccggacctctccgtgcgcgtgaacgggctgaagatgcccaacccgttcgtgatcgggtcggggcccccgggcaccaactacaccgtcatgaagcgcgcgttcgacgaggggtggggcggcgtcatcgccaaaaccgtatccttggatgctgagaaagttatcaacgtaacccctcgctatgcccggctcagggcggaccccaatggatctactaagagtcctatcatcggatggcagaacattgaacttatcagtgatcggcctctagaaactatgctgaatgaattcaagcaactgaagaaagagtatcctgacaggatactcattggctcaataatggaggagtacaacaaagctgcatggcatgagcttattgaacgcgttgaagagagcggagtggatgctcttgagattaatttctcatgcccacatggcatgccagagcgaaaaatgggtgctgccgtgggacaagactgtgacttgttagaggaggtctgcggttggataaatgagaaggctacagtgcctgtttgggcaaagatgactcctaacattacagatattacaaagcctgcaagaatttctcttaagtcaggatgtgaaggagtttctgctattaacacaatcatgagtgtgatgggaattaacctcaaaactttgcgaccagaaccttgtgtggagggttattccacgcctggaggctattctgcgagagccgtgcaccctatagcacttgcgaaagtcatgcagatagcaaggatgatgaaagaagaatttgctgatggacagtcactctctgctattggaggcgtggagactggcaatgatgctgctgagtttattctacttggcgcagatacagtacaggtatgtacgggcgtaatgatgcatggttatggccttgtaaagaagctttgtgcagagctgcaggattttatgagacaacacaacttttcctcaatagaagatttccggggggcctctctcccgtatttcaccacacacaccgatttggtacatcggcaaagggaggcgatcaaccagaggaaggctattaggaagggcctggaatcagacaaggactggaccggtgatggattcgtcaaggagacagaaagcatggtgtccaactga

SEQ ID NO: 7832 - protein, 414 aa, Oryza sativa (japonica cultivar-group)
MESLTLRASPSTAAPLRRVPGRRHAAVSVRASAGAGEPDLSVRVNGLKMPNPFVIGSGPPGTNYTVMKRAFDEGWGGVIAKTVSLDAEKVINVTPRYARLRADPNGSTKSPIIGWQNIELISDRPLETMLNEFKQLKKEYPDRILIGSIMEEYNKAAWHELIERVEESGVDALEINFSCPHGMPERKMGAAVGQDCDLLEEVCGWINEKATVPVWAKMTPNITDITKPARISLKSGCEGVSAINTIMSVMGINLKTLRPEPCVEGYSTPGGYSARAVHPIALAKVMQIARMMKEEFADGQSLSAIGGVETGNDAAEFILLGADTVQVCTGVMMHGYGLVKKLCAELQDFMRQHNFSSIEDFRGASLPYFTTHTDLVHRQREAINQRKAIRKGLESDKDWTGDGFVKETESMVSN

SEQ ID NO: 7833 - DNA, 1314 bp, Mesorhizobium loti MAFF303099
  CDS (1)..(1314): transl_table=11
atggcagacctccgcaacaatttcgtcggcatcaaatcgccaaatccgttctggctggcttcggcgccgccgaccgacaaagcctacaatgtcatccgcgccttcaaggcaggctggggtggcgtggtgtggaagacgctgggcgaggaaggcccgccggtcgtcaacgtcaacggcccgcgctatggcgcgatctggggcgccgaccggcgcctgcttggcctcaacaacatcgagctgatcaccgaccgcgacctgcagaccaatctgcgcgagatgaagcaggtcaagatggactggcccgaccgcgcgctgatcgcctcgatcatggtgccttgcgaagaggcaagctggaaagccatcctgccgctggtcgaggagaccggcgccgacggcatcgagctcaatttcggctgcccgcatggcatgtcggaacgcggcatgggggcggccgtcggccaggtgccggaatatatcgaaatggtggtgcgctggtgcaagcagtatacgcgcatgcccgtcatcaccaagctgacgcccaacatcaccgacatccgcaagcccgcgcgtgccgcgcatgccggcggcaccgacgcggtgtcgctgatcaacaccatcaattcgatcactggtgtcgacctcgacagtttcgcgccgatgccgaccatcgatggcaagggctcgcatggcggctattgcggcccggcggtgaagccgatcgccatgaacatggtggctgaaatcgcgcgcgatccagagacacgcggcctgccgatctcgggcattggcggcatcaccacctggcgcgacgccgccgaattcctggcgctcggcgccggcaatgtgcaggtctgcacggcggcgatgacctacggcttcaagatcgtgcaggagatgatcgcgggtctcgaaaactggatggacgagaagggccaccgctcgctcgacgacattatcggccgcgccacgcccaacgtcaccgactggcagtatctcaacctcaactatgtcgccaaggcgcatatcgaccaggacgcttgcatcaaatgcggccgctgccacatcgcctgcgaggacacttcgcaccaggcgatcaccagcatggtcgatggcgtgaggcatttcgaggtgatcgaggccgaatgcgtcggctgcaatctgtgcgtcaatgtctgcccggtcgagaactgcatcaccatggagccgctggccgccggcgtcatggaccagcgcaccggcaagccggtgtcgccgatctacgccaactggacgacgcatccgaacaacccgatggccaaggtggccgcggagtag

SEQ ID NO: 7834 - protein, 437 aa, Mesorhizobium loti MAFF303099
MADLRNNFVGIKSPNPFWLASAPPTDKAYNVIRAFKAGWGGVVWKTLGEEGPPVVNVNGPRYGAIWGADRRLLGLNNIELITDRDLQTNLREMKQVKMDWPDRALIASIMVPCEEASWKAILPLVEETGADGIELNFGCPHGMSERGMGAAVGQVPEYIEMVVRWCKQYTRMPVITKLTPNITDIRKPARAAHAGGTDAVSLINTINSITGVDLDSFAPMPTIDGKGSHGGYCGPAVKPIAMNMVAEIARDPETRGLPISGIGGITTWRDAAEFLALGAGNVQVCTAAMTYGFKIVQEMIAGLENWMDEKGHRSLDDIIGRATPNVTDWQYLNLNYVAKAHIDQDACIKCGRCHIACEDTSHQAITSMVDGVRHFEVIEAECVGCNLCVNVCPVENCITMEPLAAGVMDQRTGKPVSPIYANWTTHPNNPMAKVAAE

SEQ ID NO: 7835 - DNA, 1281 bp, Arabidopsis thaliana
  CDS (1)..(1281)
atggcttccatgagtttcgccttgaatcgcttctctggactctcctctaaaaccaccttatcagctgacttcgatccatcctctcgccggagttttctaccgccgactagagttggacttaagatctcttccgccgccgaatcggagcctgatctcagtgtcactgtaaatggcctgaaaatgcccaatcctttcgtgatcgggtcgggtccaccgggtaccaactacaccgtcatgaagagagcctttgatgaaggttggggggccgtcatcgccaaaaccgtatctttagatgcatccaaagttatcaacgtgacacctagatatgctcggctacgaaccggatccaatggctcagccaaaacagatgtaattgggtggcagaacatagaactcatcagtgacagacctcttgaaaccatgctcaaagagtttgagcggttgaaaaaagagtatcctgatcggattctgattgcttcagtcatggaggaatataacaaaactgcttgggaagagcttatcgaccgtgttgagcaaactggtgttgatgctttagaaatcaacttctcgtgtcctcatggtatgccagagcgcagaatgggtgccgctgttggacaagattgtgcgcttctcgacgaggtttgcggatggattaatgctaaagctacagttcctgtatgggctaagatgactcctaatattactgacataactgagcctgctagggtgtcactaaaatccggatgtgaaggaattgcagcgatcaatacaatcatgagtgtaatgggaattgatatgaagacgttgcgtcctgagccatgcgttgaaggttactccactccagggggatactcttataaggccgttcgcccaattgcactggcaaaagttatgaacattgccaaaatgatgaaatctgagtttagtgaggatcgctcgctttcgggtattggaggagttgaaactggctatgatgccgctgaattcattctccttggatcaaatactgtacaggtatgcaccggtgtgatgatgcacggctatggtcatgtgaaaaccctttgcgctgagctgaaagatttcatgaaacaacacaacttctctacaatagaagagttcagagggcattcgctgcagtactttacaacacacacagatttagttaagagacagaaagaagcagttgagcagagaaaagctgagaagagaggcttgaaatctgataaagattggaccggggatgggttcgtgaaggagactgagagtatggtttctaactaa

SEQ ID NO: 7836 - protein, 426 aa, Arabidopsis thaliana
MASMSFALNRFSGLSSKTTLSADFDPSSRRSFLPPTRVGLKISSAAESEPDLSVTVNGLKMPNPFVIGSGPPGTNYTVMKRAFDEGWGAVIAKTVSLDASKVINVTPRYARLRTGSNGSAKTDVIGWQNIELISDRPLETMLKEFERLKKEYPDRILIASVMEEYNKTAWEELIDRVEQTGVDALEINFSCPHGMPERRMGAAVGQDCALLDEVCGWINAKATVPVWAKMTPNITDITEPARVSLKSGCEGIAAINTIMSVMGIDMKTLRPEPCVEGYSTPGGYSYKAVRPIALAKVMNIAKMMKSEFSEDRSLSGIGGVETGYDAAEFILLGSNTVQVCTGVMMHGYGHVKTLCAELKDFMKQHNFSTIEEFRGHSLQYFTTHTDLVKRQKEAVEQRKAEKRGLKSDKDWTGDGFVKETESMVSN

SEQ ID NO: 7837 - DNA, 936 bp, Streptococcus pyogenes M1 GAS
  CDS (1)..(936): transl_table=11
atggtttctactgctacacaaattggtcatttctcttttgataactgtttgatgaatgctgctggtgtttactgcatgacaaaagaagagcttatggaggttgaaaagtctcaagccgcttcctttgtcaccaaaacagggacgcttgaagttcgtccaggtaatccagaacctcgctacgcagatactcgtcttggttctatcaattcaatgggactccctaataatggttttcgctactacttagactttgtcagtgatcttgccaaaaccgggcaacataaacctcactttctctccgttgtcgggctatctcctactgaaaccgaaaccattttaaaagccatcatggcttcagattatgagggtctagtggaactaaacctttcttgccctaacgttccaggaaaaccacagattgcttatgattttgaaaccactgatcaacttctagagaacatctttacctattacactaaacctcttggtatcaaattacctccttattttgacattgtgcattttgatcaagcggctgcgattttcaataaataccccctttcctttgttaactgtgtcaattctatcggaaatgggctggtcattaaggatgaacaagtcctcatcaagcctaaaaatggctttggtggtataggtggagattacatcaaacctactgctctagccaatgtccatgcgttttacaaacgcttaaaaccttctatccacattattggtacagggggagttaaaacaggacgcgatgcctttgaacatattctttgtggcgccagcatggtccaaattgggacagcccttcatcaagaagggccagctatctttgaacgggtcactaaggaacttaaaacgattatggtagaaaaaggctaccaaagcttagacgattttcgtgggaacttacgttacaaagattaa

SEQ ID NO: 7838 - protein, 311 aa, Streptococcus pyogenes M1 GAS
MVSTATQIGHFSFDNCLMNAAGVYCMTKEELMEVEKSQAASFVTKTGTLEVRPGNPEPRYADTRLGSINSMGLPNNGFRYYLDFVSDLAKTGQHKPHFLSVVGLSPTETETILKAIMASDYEGLVELNLSCPNVPGKPQIAYDFETTDQLLENIFTYYTKPLGIKLPPYFDIVHFDQAAAIFNKYPLSFVNCVNSIGNGLVIKDEQVLIKPKNGFGGIGGDYIKPTALANVHAFYKRLKPSIHIIGTGGVKTGRDAFEHILCGASMVQIGTALHQEGPAIFERVTKELKTIMVEKGYQSLDDFRGNLRYKD

SEQ ID NO: 7839 - DNA, 939 bp, Streptococcus pneumoniae TIGR4
  CDS (1)..(939): transl_table=11
atgactacaaatcgattacaagtttctctacctggtttggatttgaaaaatccgattattccagcatcaggctgttttggctttggacaagagtatgccaagtactatgatttagaccttttaggttctattatgatcaaggcgacaacccttgaaccacgttttgggaatccaactccaagagtggcagagacgcctgctggtatgctcaatgcaattggcttgcaaaatcctggtttagaggttgttttggctgaaaagctaccttggctggaaagagaatatccaaatcttcctattattgccaatgtagctggtttttcaaaacaagagtatgcagctgtttctcatgggatttccaaggcaactaatgtaaaagctatcgagctcaatatttcttgtcccaatgttgaccactgtaatcatggacttttgattggtcaagatccagatttggcttatgatgtggtgaaagcagctgtggaagcctcagaagtgccagtttatgtcaaattaaccccgagtgtgaccgatatcgttactgtcgcaaaagctgcagaagatgcgggagcaagtggcttgaccatgatcaatactctggttggaatgcgctttgacctcaaaactagaaaaccaatcttggccaatggaacaggtggaatgtctggtccagcagtctttccagtagccctcaaactcatccgccaagttgcccaaacaacagacctgcctatcattggaatgggaggagtggattcggctgaagctgccctagaaatgtatctggctggggcatctgctatcggagttggaacagctaactttaccaatccttatgcctgccctgacatcatcgaaaatttaccaaaagtcatggataaatacggtattagcagtctggaagaactccgtcaggaagtaaaagagtctctgaggtaa

SEQ ID NO: 7840 - protein, 312 aa, Streptococcus pneumoniae TIGR4
MTTNRLQVSLPGLDLKNPIIPASGCFGFGQEYAKYYDLDLLGSIMIKATTLEPRFGNPTPRVAETPAGMLNAIGLQNPGLEVVLAEKLPWLEREYPNLPIIANVAGFSKQEYAAVSHGISKATNVKAIELNISCPNVDHCNHGLLIGQDPDLAYDVVKAAVEASEVPVYVKLTPSVTDIVTVAKAAEDAGASGLTMINTLVGMRFDLKTRKPILANGTGGMSGPAVFPVALKLIRQVAQTTDLPIIGMGGVDSAEAALEMYLAGASAIGVGTANFTNPYACPDIIENLPKVMDKYGISSLEELRQEVKESLR

SEQ ID NO: 7841 - DNA, 1311 bp, Brucella melitensis 16M
  CDS (1)..(1311): transl_table=11
atggctgatctttcaacgaatttcctcggcatcaaatcacccaatccgttctggctcgcctcggccccgccgaccgacaaggcctataatgtcgagcgcgctttcaaggcaggctggggcggcgtagtctggaaaacgctcggcgcggaaggcccgccggtggtcaacgtaaacggcccgcgctatggcgcgatccacggcgcggaccggcggcttctcggcctcaacaatatagaactcatcaccgaccggccgctggagataaacctgcgcgagatgaaagaggtgaaaatgcgctggccggaccgcgcattgatcgcctcgatcatggtgccctgcgaggaggaggcatggaaggcgatcctgccgctggtggaggaaaccggcgcggacgggatcgaactcaatttcggctgcccgcacggcatgagcgagcgcggcatgggggcagcggttggtcaggtgccggaatatgtcggcatggtcgtcaaatggtgcaagcaatacagccgtatgccggttatcaccaagctgacgcccaatatcaccgatatccgcaagcctgcccgtgcggcttttgccaatggcacggatgctttgtcactcatcaatacgatcaattccatcgtgtctgtcgatctcgacacgatgtcgcccgtgccttccatcgacgggcgcggcagccatggcggctattgcggcccggcggtcaagccgattgcgctcaacatggtggcggagattgcccgcgacgcggaaacggcgggtctgccgatttcaggcattggcggcatcaccacctggcaggatgcggctgagtttatcgcgcttggctgcggcacggtgcaggtctgcaccgccgcgatgacctatggcttcaaggtcgtgcaggagatgatcgacggtctttccgactggatggacagcaagggctatcagacactcgacgacttccagggctgcgccgtttcccatgtgaccgactggcaatatctcaacctcaactatgtcaccaaggcccgcatcaatcaggacctctgcatccaatgcggccgctgccacattgcctgtgaggacacctcgcatcaggccatcacggccatggtgaatggcgcgcgtcatttcgaggtgatcgacgaggaatgcgtcggctgcaatctctgtgtcaatgtctgcccggtggagaactgcatcaccatggagcagatttccggcgtagacccgcgcacgaaggcgcccatcatgcccgcttacgccaactggaccacgcatccgaacaatccggcggccatgaaggaggccgccgaataa

SEQ ID NO: 7842 - protein, 436 aa, Brucella melitensis 16M
MADLSTNFLGIKSPNPFWLASAPPTDKAYNVERAFKAGWGGVVWKTLGAEGPPVVNVNGPRYGAIHGADRRLLGLNNIELITDRPLEINLREMKEVKMRWPDRALIASIMVPCEEEAWKAILPLVEETGADGIELNFGCPHGMSERGMGAAVGQVPEYVGMVVKWCKQYSRMPVITKLTPNITDIRKPARAAFANGTDALSLINTINSIVSVDLDTMSPVPSIDGRGSHGGYCGPAVKPIALNMVAEIARDAETAGLPISGIGGITTWQDAAEFIALGCGTVQVCTAAMTYGFKVVQEMIDGLSDWMDSKGYQTLDDFQGCAVSHVTDWQYLNLNYVTKARINQDLCIQCGRCHIACEDTSHQAITAMVNGARHFEVIDEECVGCNLCVNVCPVENCITMEQISGVDPRTKAPIMPAYANWTTHPNNPAAMKEAAE

SEQ ID NO: 7843 - DNA, 900 bp, Clostridium perfringens str. 13
  CDS (1)..(900): transl_table=11
atgttaaaaacagttataaatggagtagattttaaaaaccctgttatagcagcatcaggtactttcggctttggagctgagtataataacttctatgatgtgggagaattaggaggaataagttcaaaaggactaactcttaatagtagagaaggtaatgaaggaataagaatatatgaaactcctcaaggaataatgaattcagtaggacttcaaaatccaggtgtagagaaatttatagaagtagaactccctaaaatgttagaactaggaacaaatataatagcaaatgtagggggagctactatagaggattatgaaaaagcagtatctcttttaaataaagaaaagatagacatgatagagttaaatatatcttgtcctaatgtaaaatctggtggaatggcctttggtatacaatcagatgtggcatatgaggtggtttctaaggttagaaaaatatgtgataaacctttaatggtaaaattatcaccaaatgctgaaaatatatgcaatatggcatatagatgtgcagaggcaggagcagattcaatctccctaataaatacattaaaaggaatggcaatagatataaaaaatagaaagccagtatttaataatgtgtatgcaggactttctggcccagctgtaaaacctatagcacttagaatggttcatgaagtagctaaaactgtagacattccagtaataggattaggcggaatttctacagcagaagatgccatagaatttatgatggcaggagcatcagctatacaaataggtacaataaactttgtaaatcctaaagcaggtatagaaataataaaaggcttggaagacttttgcaaaaaagaaggattaaaaaatattaatgaaattgtaggatgcataaagtaa

SEQ ID NO: 7844 - protein, 299 aa, Clostridium perfringens str. 13
MLKTVINGVDFKNPVIAASGTFGFGAEYNNFYDVGELGGISSKGLTLNSREGNEGIRIYETPQGIMNSVGLQNPGVEKFIEVELPKMLELGTNIIANVGGATIEDYEKAVSLLNKEKIDMIELNISCPNVKSGGMAFGIQSDVAYEVVSKVRKICDKPLMVKLSPNAENICNMAYRCAEAGADSISLINTLKGMAIDIKNRKPVFNNVYAGLSGPAVKPIALRMVHEVAKTVDIPVIGLGGISTAEDAIEFMMAGASAIQIGTINFVNPKAGIEIIKGLEDFCKKEGLKNINEIVGCIK

SEQ ID NO: 7845 - DNA, 936 bp, Streptococcus pyogenes MGAS8232
  CDS (1)..(936): transl_table=11
atggtttctactgctacacaaattggtcatttctcttttgataactgtttgatgaatgctgctggtgtttactgcatgacaaaagaagagcttatggaggttgaaaagtctcaagccgcttcctttgtcaccaaaacagggacgcttgaagttcgtccaggtaatccagaacctcgctatgcagatactcgtcttggttctatcaattcaatgggactccctaataatggttttcgctactacttagactttgtcagtgatcttgccaaaaccgggcaacataaacctcattttctctccgttgtcgggctatctcctactgaaaccgaaaccattttaaaagccatcatggcttcagattatgagggtctagtggaactaaacctttcttgcccgaacgttccaggaaaaccacagattgcttatgattttgaaaccactgatcaacttctagagaacatctttacctattacactaaacctcttggtatcaaattacctccttattttgacattgtgcattttgatcaagcggctgcgattttcaataaataccccctttcctttgttaactgtgtcaattctatcggaaatgggctggtcattgaggatgaacaagtcctcatcaagcctaaaaatggctttggtggtataggtggagattacatcaaacctactgctctagccaatgtccatgcgttttacaaacgcttaaaaccttctatccacattattggtacagggggagttaaaacaggacgcgatgcctttgaacatattctttgtggcgccagcatggtccaaattggaacagtccttcatcaagaaggaccggctatctttgagcgggtgaccaaggaattaaaaacgattatggtagaaaaaggctaccaacgtttagcagattttcgtgggaacttacgttacaaagattaa

SEQ ID NO: 7846 - protein, 311 aa, Streptococcus pyogenes MGAS8232
MVSTATQIGHFSFDNCLMNAAGVYCMTKEELMEVEKSQAASFVTKTGTLEVRPGNPEPRYADTRLGSINSMGLPNNGFRYYLDFVSDLAKTGQHKPHFLSVVGLSPTETETILKAIMASDYEGLVELNLSCPNVPGKPQIAYDFETTDQLLENIFTYYTKPLGIKLPPYFDIVHFDQAAAIFNKYPLSFVNCVNSIGNGLVIEDEQVLIKPKNGFGGIGGDYIKPTALANVHAFYKRLKPSIHIIGTGGVKTGRDAFEHILCGASMVQIGTVLHQEGPAIFERVTKELKTIMVEKGYQRLADFRGNLRYKD

SEQ ID NO: 7847 - DNA, 957 bp, Methanopyrus kandleri AV19
  CDS (1)..(957): transl_table=11
gtgagaccggtggaggtcctagggaagcgctgggcccacccgatcgcctgcgcttccggggctctcgccgcccatcggccgggcatggaaaatgccgttctacgcggtgcggcggctattttcacgaagacggtcactgaatcaccgcgcgagggccatccaggaccggtattcgtggattacctcgacgagggatacgcgctcaacgctatgggtttaccgaaccccggcccggacaggatggtggtggaaatcgaagagttccgggacgaattcgacgtaccggtatacgcgagcgtggcggccgacggtccggagggtttcaagaggttggcacgcgcgttctccggcgtagcggacggattggaactgaacgtctcgtgccctcacgcgggcaaggggtacggggcggaactaggctccgatccggaggccgtggccgaaatcaccgaggccgccgtccgggcgttcgacggaccggtgtccgtgaaattgactcccaacgtggaccgcgaaaccttgctcgaggtggctgcggcggccatcgatgcgggagcggaggcactcaccgccgtgaacacgctgggacctggccttaggatcgacctgaggaccgccagccccgtcctaggagccggggtaggtggactgtcgggccccgcgctcaaacccatcgcgctccgcgtcgtggcggacttagcgctggagttcggggaggaagtggagatcataggagtcggtgggatccggaacggggaagacgtcgtcgagttcctgttcgccggtgccaaggcggtgcaggtcgccacggcggctcgagagaaagacttcggagatatcgcgatggaaacctcccacattctcaaggaactcggatacgatggacccgaagaggcgatcggagctgcccttcctgagtaccgggagaggctgcgccgattggggtggtgtcagtga

SEQ ID NO: 7848 - protein, 318 aa, Methanopyrus kandleri AV19
MRPVEVLGKRWAHPIACASGALAAHRPGMENAVLRGAAAIFTKTVTESPREGHPGPVFVDYLDEGYALNAMGLPNPGPDRMVVEIEEFRDEFDVPVYASVAADGPEGFKRLARAFSGVADGLELNVSCPHAGKGYGAELGSDPEAVAEITEAAVRAFDGPVSVKLTPNVDRETLLEVAAAAIDAGAEALTAVNTLGPGLRIDLRTASPVLGAGVGGLSGPALKPIALRVVADLALEFGEEVEIIGVGGIRNGEDVVEFLFAGAKAVQVATAAREKDFGDIAMETSHILKELGYDGPEEAIGAALPEYRERLRRLGWCQ

SEQ ID NO: 7849 - DNA, 972 bp, Bifidobacterium longum NCC2705
  CDS (1)..(972): transl_table=11
atgagcgcaaacaaccagtccgcgcagggcggcgacaaccacatcaacctgtacgagccccacgtgtggaagcaccacaccaaggtggccggtctggaatggaagaatccggtcggcaccgcctccggcaccttccagtacgccgccgtccgctggttctacgacgtcagccagctcggcgccgtatgcaccaagggcgcctcgcccgtaccgtgggaaggcaatccctcgccgcgcaccgccgaatcgccggccgcgaacatcaacgccgtgggcctgcagaatcccggcatcgaccattacttggccgaggacctgcccaagctcaaggccgcgggcgcgttcgtcatctccaatgtcgccggacattgcgatgacgattacgcggcggtcgtggaaaagctcgccgactccgacgcggacatgctggaaattaacgtcagctgcccgaacgtttccgccggcggcatgagcgtgggcaccgacccggtggccctcgccaatcttatggaccggctgcgcccgatgaccgacaagccgatgatcgtcaaactcacgccgaacgtcaccgacatcaccgtgccggcgcgcgcggccgtggaacatggcgccgacgcgttgagcatgatcaacacgctcaaaggcatgcgcattaacattcgcaccggcaagccgatcatcgccaacgtcaccggcggcgtatccggcccggccgtgctgccggtcggcctggcagccgtctatcgggtgcgcaccgcactgccggagattccgatcatcggcctcggcggcatcgacagcggcgagaaggcgctcgaatacctgtacgccggcgcgaacgccgtcgaagtgggtgcggccgcgctcttcgacccggtggccccgctgcgcgtcgcccgcgaactcgacgacctgttggacagccgtcccgaactcgctgctaaactggccgcaggacagacttggaggtaa

SEQ ID NO: 7850 - protein, 323 aa, Bifidobacterium longum NCC2705
MSANNQSAQGGDNHINLYEPHVWKHHTKVAGLEWKNPVGTASGTFQYAAVRWFYDVSQLGAVCTKGASPVPWEGNPSPRTAESPAANINAVGLQNPGIDHYLAEDLPKLKAAGAFVISNVAGHCDDDYAAVVEKLADSDADMLEINVSCPNVSAGGMSVGTDPVALANLMDRLRPMTDKPMIVKLTPNVTDITVPARAAVEHGADALSMINTLKGMRINIRTGKPIIANVTGGVSGPAVLPVGLAAVYRVRTALPEIPIIGLGGIDSGEKALEYLYAGANAVEVGAAALFDPVAPLRVARELDDLLDSRPELAAKLAAGQTWR

SEQ ID NO: 7851 - DNA, 936 bp, Streptococcus mutans UA159
  CDS (1)..(936): transl_table=11
atggtttcaactcatacaacaattggctcttttgactttgataattgtctcatgaatgctgcaggggtttattgcatgacacgtgaagaattagcagctattgatcattcggaagcaggttcttttgttaccaagactggtacgctagaagaacgtgcaggaaaccctcaaccccgctatgctgacacaaaattaggctctattaattcaatgggcctgcctaatctaggtattaactattatttagactatgtcacagaattgcaaaaacagcccgatagcaaaaatcactttttatccctagttggcatgtcgccagaagaaacccataccattcttaagatggttgaagccagcaaatatcaaggtttggtggaactcaatctttcctgtccaaatgttcccggtaaaccacaaatcgcctatgattttgaaacaacggaccaaatcctttcagaagttttcacttacttcactaaaccactaggtatcaagttaccaccttattttgacattgtacattttgatcaagcagctgctattttcaataaataccctctgacatttgttaattgtattaattctattggaaacggcctagttattgaagatgaaacggtcgtcattaaaccaaaaaatggctttggaggtattggtggcgattacgtcaaaccaacagcgctagccaatgttcatgctttttacaagcgcctcaacccttccatccaaattatcggaaccggcggtgtcaaaacaggtcgcgatgctttcgaacatattctctgtggcgccagcatggttcaaatcgggacagctcttcatcaagaaggtcctcaaattttcaaacgtattactaaagagttaaaagccatcatgacggaaaaaggttatgaaaccttggaagactttcgtggtaagctgaatgctatggcttaa

SEQ ID NO: 7852 - protein, 311 aa, Streptococcus mutans UA159
MVSTHTTIGSFDFDNCLMNAAGVYCMTREELAAIDHSEAGSFVTKTGTLEERAGNPQPRYADTKLGSINSMGLPNLGINYYLDYVTELQKQPDSKNHFLSLVGMSPEETHTILKMVEASKYQGLVELNLSCPNVPGKPQIAYDFETTDQILSEVFTYFTKPLGIKLPPYFDIVHFDQAAAIFNKYPLTFVNCINSIGNGLVIEDETVVIKPKNGFGGIGGDYVKPTALANVHAFYKRLNPSIQIIGTGGVKTGRDAFEHILCGASMVQIGTALHQEGPQIFKRITKELKAIMTEKGYETLEDFRGKLNAMA

SEQ ID NO: 7853 - DNA, 930 bp, Streptococcus mutans UA159
  CDS (1)..(930): transl_table=11
atgacaaatagacttgctcttaaattgccgggcttggatttgaaaaatcctatcattccagcctcaggctgttttggctttggtcaagaatatgctaaatattatgacttaaataaattgggttctatcatgattaaggcaacgacccagcagccgcgctttggaaatcccacagcacgtgttgcagaaaccccttcaggaatgctcaatgccattggtctgcaaaatccgggtgttgatgctgtcattgctcaaaaattgccttggctggcagagcattacccagatttaccaattattgccaatgttgctggtttttccaatgaagaatatgcttatgtgtctgaaaaaatctcacaggcaccaaatgtcaaggctattgagcttaatatttcctgtcctaacgttgaccacgggaatcatggcctgcttattggacaggtgccagaactaacttatgctgcagttaaagctgctgttgaggcttctcaggtacccgtttatgttaagctgacacctagtgttgccgatattacaactgttgctaaggcagttgaagctgctggagcgactggctttaccatgatcaacactttggttggtatgcgttttgatttaaagactaaaaaacctatcattgccaatggtacaggtggtatgagtggtccagcagtctttccagtagctctcaaattaattcatcaagtggctcagtcgtctcagttgccaatcattggtatgggtggtgttgattcagctgaagccgccttagaaatgatgatagctggtgcctcggcgattgctgttgggacagctaattttacagacccctttgcctgtcctaatatcattgaagacttacctaaggttatggataaatatggtattgaaacgcttgaacaattcagaaaggatgttagaaatgcgtga

SEQ ID NO: 7854 - protein, 309 aa, Streptococcus mutans UA159
MTNRLALKLPGLDLKNPIIPASGCFGFGQEYAKYYDLNKLGSIMIKATTQQPRFGNPTARVAETPSGMLNAIGLQNPGVDAVIAQKLPWLAEHYPDLPIIANVAGFSNEEYAYVSEKISQAPNVKAIELNISCPNVDHGNHGLLIGQVPELTYAAVKAAVEASQVPVYVKLTPSVADITTVAKAVEAAGATGFTMINTLVGMRFDLKTKKPIIANGTGGMSGPAVFPVALKLIHQVAQSSQLPIIGMGGVDSAEAALEMMIAGASAIAVGTANFTDPFACPNIIEDLPKVMDKYGIETLEQFRKDVRNA

SEQ ID NO: 7855 - DNA, 933 bp, Streptococcus agalactiae NEM316
  CDS (1)..(933): transl_table=11
atggtatcgctaaaaacggaaattgctggttttagttttgacaattgtttgatgaatgcagcgggtatttattgtatgactaaggaagagttattagctattgaaaattctgaagctggttcctttgttacaaaaacaggtacccttgaagctagagagggaaaccctcaaccacgttatgcagatactgactggggatcaattaattctatgggactccctaataaaggtattgactattatcttgatttcgtgactgaattacaagatcaagacaatagcaaaaatcacgttttatcattagtaggtttatcaccagaagagacacatattattcttaaaaaggttgaaaacagtagttacaatggcctaatagagttaaatttatcgtgcccaaatgttcctggaaaacctcaaattgcttatgattttgaaatgactgacctcatcctttcagaaatctttagctattatcaaaagccattgggcatcaaattaccaccttactttgatatcgttcactttgatcaagcagctacaatttttaacaaatatcctttagcttttattaactgtgttaattctatcggaaatggacttgttattgatgatgaaactgtcgttataaagcctaaaaatggctttggaggtatcggtggggattttatcaagcctaccgccttagctaacgtccatgctttctacaaacgtttaaatccttcaattaaaattatcggaacaggtggtgttaaaaacggccgtgatgcctttgaacacattctatgtggagctagtatggtccaaatcggaaccgctttacaaaaagaaggaccagaaatttttcagcgtgtaagcagagaattaaaagaaataatggctgataaaggctatcaatcattggaggattttcgaggacaacttaattacctttaa

SEQ ID NO: 7856 - protein, 310 aa, Streptococcus agalactiae NEM316
MVSLKTEIAGFSFDNCLMNAAGIYCMTKEELLAIENSEAGSFVTKTGTLEAREGNPQPRYADTDWGSINSMGLPNKGIDYYLDFVTELQDQDNSKNHVLSLVGLSPEETHIILKKVENSSYNGLIELNLSCPNVPGKPQIAYDFEMTDLILSEIFSYYQKPLGIKLPPYFDIVHFDQAATIFNKYPLAFINCVNSIGNGLVIDDETVVIKPKNGFGGIGGDFIKPTALANVHAFYKRLNPSIKIIGTGGVKNGRDAFEHILCGASMVQIGTALQKEGPEIFQRVSRELKEIMADKGYQSLEDFRGQLNYL

SEQ ID NO: 7857 - DNA, 921 bp, Mycoplasma penetrans HF-2
  CDS (1)..(921): transl_table=4
atgaaaaataataaccgtttaaaaataaatttaccaggatttgaattaaaaaatcccattatgcctgcatctggttgttttggttttggaaaagaatttagtgaactatatgatctttcaagattaggggcaatcataataaaagcagcaacaaaaaatgaaaaatttggaaaccctactcctagagttgcagaaactagtagtggaatgttaaatgccattggtttacaaaatccaggagtagatcacatcataaaccatgagttaaaagaactggaaaaatatgatgtacctattattgcaaatgtagcaggagatgatattgatgattatgtttatgttgctaaaagaattagtcaagcaaaaaatgtagtagcacttgaattaaatatctcttgcccaaatgttaaaaatggtggaattcaatttgggacagattgtaatgttgcttacaatttaacaaaaaaagtaaaaaaagtgagtagcaaaccagtttatgttaaactatctcctaatgttagtgatatagttggaatggctaaagcaattgaagaagcaaaagctgatggtttaagtttaataaacacattaataggaatggcattagatcctaaatctggtaaacctattttagcaaataaaactggaggattatcaggtccagctattaaaccagttgctataagaatgatttatcaagtttctcaagctgttaatattcctattattggaatgggtggaatcagtaatgttcaagatgtaatagattttataagtgcaggtgcatctgcagttgcaataggaacagcaaatttcattaatccttatatttgtgtagaaattattgatcaattagaaagtaaattagatgaattaaatgtaaatcatatatgagatttaaaaggtaggagttatagataa

SEQ ID NO: 7858 - protein, 306 aa, Mycoplasma penetrans HF-2
MKNNNRLKINLPGFELKNPIMPASGCFGFGKEFSELYDLSRLGAIIIKAATKNEKFGNPTPRVAETSSGMLNAIGLQNPGVDHIINHELKELEKYDVPIIANVAGDDIDDYVYVAKRISQAKNVVALELNISCPNVKNGGIQFGTDCNVAYNLTKKVKKVSSKPVYVKLSPNVSDIVGMAKAIEEAKADGLSLINTLIGMALDPKSGKPILANKTGGLSGPAIKPVAIRMIYQVSQAVNIPIIGMGGISNVQDVIDFISAGASAVAIGTANFINPYICVEIIDQLESKLDELNVNHIWDLKGRSYR

SEQ ID NO: 7859 - DNA, 906 bp, Clostridium tetani E88
  CDS (1)..(906): transl_table=11
gtgagtagattagaagttgactttgcaggagtaaaatttaaaaatcctgtggtattagcatctggaacttgtggttttggaagagaatatagtgaaatatttgatatagaaaagttaggtgggctgtcttctaaaggacttacactaaatccaagagcaggaaatgatggaataagggtatgggaaacagacagtggaatgatgaatagtgttggacttgaaaatccaggggtaaaagcctttatagaaaaggatttacattggataaatagtttgaatattgtgaatatagttaatctaggcggacattctatggatgattatttacaggcagtggagctattaaataaagaaaaaatagacttattagaattaaatatatcttgtccaaacgtaaaacagggtggaatgaattttggtgttaagacagattttgcaagggaagttgtaagaaaaataagagaagtttgtaaacataaattagttgtaaaactttctccaaatgctgaagatatagtgggaatagctaaagtttgtgaagaagaaggggcaaatggaatatcccttgtaaatacttttttaggacttgctatagacataaacaaaagaaaatctgtatttaataatggctatgctggactttcaggtcctgccataaaacctatagctttaagaatggtaaatcaagtagctaaagaattaactatacctgttatgggacttggaggaatctctacatggcaggatgctatagaatttataatggctggtgctactactgttcaagttggtacggcatcctttatgaaacctgatatttcaatagacataatacaaggtatggaaaaatacatgatagataacaatattcaaagtttagatgaaataagagggattataaaatag

SEQ ID NO: 7860 - protein, 301 aa, Clostridium tetani E88
MSRLEVDFAGVKFKNPVVLASGTCGFGREYSEIFDIEKLGGLSSKGLTLNPRAGNDGIRVWETDSGMMNSVGLENPGVKAFIEKDLHWINSLNIVNIVNLGGHSMDDYLQAVELLNKEKIDLLELNISCPNVKQGGMNFGVKTDFAREVVRKIREVCKHKLVVKLSPNAEDIVGIAKVCEEEGANGISLVNTFLGLAIDINKRKSVFNNGYAGLSGPAIKPIALRMVNQVAKELTIPVMGLGGISTWQDAIEFIMAGATTVQVGTASFMKPDISIDIIQGMEKYMIDNNIQSLDEIRGIIK

SEQ ID NO: 7861 - DNA, 915 bp, Clostridium tetani E88
  CDS (1)..(915): transl_table=11
gtgatgaattggaggaataaaatgaaggtgaacatttgtggagtggagtttaaaaatccagttattgcagcttcgggaacctttggatttggtgaagaatatggggcgttttatgatgtatcaaaactaggtggaatatgtacaaagggattgacaataaatccaaaggaaggtaatgagggtataagaatttatgagacaagaggaggcataataaatagcataggattacaaaatccaggtatagattattttataaatcgtgaacttaaaaagatgaataaaatagatactaacataatagcaaacgtagggggaggaagtatagaggattatttaggggcaatagataaattaaacaaaacagatatagatcttatagagcttaatatatcctgtcctaacgtaaaagaagggggcatggcttttggaataaagtcaaaagtagcttatgatgtggtatctagagtgaaaaaaatatgcaaaaagcctttaattgtaaaattatctcctaatgctgaagatatagtagatatggcagtaaaatgctgtgaaggtggagcagaagctatatccttagttaatacgtttaaagctatggcagtagatataaaaagcagaaaatcagtttttaacaatataactgctggattatcaggagtagcaataaagcccattgcattaagaatggtgtatgaagtatgtaaaaatgtaaatgtgccagtaataggcttaggaggaataaataattggcaagatgctatagagtttataatggtaggtgcaacagctattcaagtggggacggcaaattttataaatccttatagttcaattaaaatagtacatggaatagaaagttatatgaaaaaagagggaattaaagatttatcagaaataaaaggaataatataa

SEQ ID NO: 7862 - protein, 304 aa, Clostridium tetani E88
MMNWRNKMKVNICGVEFKNPVIAASGTFGFGEEYGAFYDVSKLGGICTKGLTINPKEGNEGIRIYETRGGIINSIGLQNPGIDYFINRELKKMNKIDTNIIANVGGGSIEDYLGAIDKLNKTDIDLIELNISCPNVKEGGMAFGIKSKVAYDVVSRVKKICKKPLIVKLSPNAEDIVDMAVKCCEGGAEAISLVNTFKAMAVDIKSRKSVFNNITAGLSGVAIKPIALRMVYEVCKNVNVPVIGLGGINNWQDAIEFIMVGATAIQVGTANFINPYSSIKIVHGIESYMKKEGIKDLSEIKGII

SEQ ID NO: 7863 - DNA, 936 bp, Streptococcus pyogenes SSI-1
  CDS (1)..(936): transl_table=11
atggtttctactgctacacaaattggtcatttctcttttgataactgtttgatgaatgctgctggtgtttactgcatgacaaaagaagagcttatggaggttgaaaagtctcaagccgcttcctttgtcaccaaaacagggacgcttgaagttcgtccaggtaatccagaacctcgctacgcagatactcgtcttggttctatcaattcaatgggactccctaataatggttttcgctactacttagactttgtcagtgatcttgccaaaaccgggcaacataaacctcattttctctccgttgtcgggctatctcctactgaaaccgaaaccattctaaaagtcatcatggcttcagattatgagggtctagtggaactaaacctttcttgcccgaacgttccaggaaaaccacagattgcttatgattttgaaaccactgatcaacttctagagaacatctttacctattacactaaacctcttggtatcaaattacctccttattttgacattgtgcattttgatcaagcggctgcgattttcaataaataccccctttcctttgttaactgtgtcaattctatcggaaatgggctggtcattgaggatgagcaagtcctcataaagcctaaaaatggctttggtggtataggtggagattacatcaaacctactgctctagccaatgtccatgcgttttacaaacgcttaaaaccttctatccacattattggtacagggggaattaaaacaggacgcgatgcctttgaacatattctttgtggcgccagcatggtccaaattgggacagcccttcatcaagaagggccagctatctttgaacgggtcactaaggaactaaaaacgattatggtagaaaaaggctatcaaagcttagacgattttcgtgggaacttacgttacaaagattaa

SEQ ID NO: 7864 - protein, 311 aa, Streptococcus pyogenes SSI-1
MVSTATQIGHFSFDNCLMNAAGVYCMTKEELMEVEKSQAASFVTKTGTLEVRPGNPEPRYADTRLGSINSMGLPNNGFRYYLDFVSDLAKTGQHKPHFLSVVGLSPTETETILKVIMASDYEGLVELNLSCPNVPGKPQIAYDFETTDQLLENIFTYYTKPLGIKLPPYFDIVHFDQAAAIFNKYPLSFVNCVNSIGNGLVIEDEQVLIKPKNGFGGIGGDYIKPTALANVHAFYKRLKPSIHIIGTGGIKTGRDAFEHILCGASMVQIGTALHQEGPAIFERVTKELKTIMVEKGYQSLDDFRGNLRYKD

SEQ ID NO: 7865 - DNA, 912 bp, Bacteroides thetaiotaomicron VPI-5482
  CDS (1)..(912): transl_table=11
atggcagatttaagtgtaaacattggtgaattgcagatgaagaacccggtgatgactgcatctggtacatttggatatggtgaagagttctcggatttcattgatatagcgcgaataggcggtattattgtaaaaggtactactcttcacaaacgtgaaggtaacccatatcctcgtatggcagagactccttccggtatgctaaatgctgtaggactgcaaaataagggggttgactactttgtggaacagatatatcctcgtataaaagacattcaaacgaatatgattgtaaacgtgtcggggtctgctattgaggattatgtgaaaactgcagagatcattaatgaacttgacaaaattcctgctatagaactaaatatctcgtgccccaatgtaaagcaaggaggtatggcttttggtgtgtcagcaaaaggtgcttctgaagtagtaaaagcggtacgtgcagcttacaaaaagacacttatcgttaaactctctccgaacgttactgatatcacagaaattgcccgtgcagcagaagaaagtggtgcggatagtgtatcattaatcaatacattgctaggaatggctattgatgcggaacgtaaacgtcccattctgtcaacagtgacaggaggaatgtccggtgctgctgtgaaaccgattgccttgcgtatggtttggcaagttgcaaaggcggtaaatattcctgtcataggattgggaggtattatgaactggaaagatgctgttgagtttatgcttgccggtgcttctgcgatccagattggtacggcaaattttatagatccggctgttacaatcaaagttgaagatggtataaataattacttggaaagacacggatgtaagtcagtaaaagaaattattggtgcgcttgaggtataa

SEQ ID NO: 7866 - protein, 303 aa, Bacteroides thetaiotaomicron VPI-5482
MADLSVNIGELQMKNPVMTASGTFGYGEEFSDFIDIARIGGIIVKGTTLHKREGNPYPRMAETPSGMLNAVGLQNKGVDYFVEQIYPRIKDIQTNMIVNVSGSAIEDYVKTAEIINELDKIPAIELNISCPNVKQGGMAFGVSAKGASEVVKAVRAAYKKTLIVKLSPNVTDITEIARAAEESGADSVSLINTLLGMAIDAERKRPILSTVTGGMSGAAVKPIALRMVWQVAKAVNIPVIGLGGIMNWKDAVEFMLAGASAIQIGTANFIDPAVTIKVEDGINNYLERHGCKSVKEIIGALEV

SEQ ID NO: 7867 - DNA, 918 bp, Rhodopirellula baltica SH 1
  CDS (1)..(918): transl_table=11
atgaccaccacgcaaactgatctgcaaacgaaactcggtcgcctgacgctccccaacccaattttggtggcatcaggaacgttcgggtacgctcgcgagatggaaggcattgttgaccttcctcgtctcggcggcattctgcccaaaaccatcaccgccgaaccacgcatcggcaacgcaccctggagaaccgtcgaaacctcggctggtttgctcaacgcgattgggctcgacaacgatggggtggacgccttcctcgaacaccacctgccgtacttggctggtctcggaactcccatcatcgtcagcgttgctgggcgaacggtcgaggacttcaccgaactcgctcgccgagtcggtcagtgcgatggcgtgtcagcgattgaattgaatctgtcctgccccaacgtcagcggcggaatcgactttggcaccaacgccgaatcatgccgcgaagtcgtcgcctccgcacgcaatgcctgcgacgtgccgatcctggccaagctcacacccaacgtgactcgcatcgctgacatcgctcaaggtgcagcagacggaggcgctgacgcggtttgtttgatcaacacagtcctcggcatggcggtcgactggaagaaacgtcgtccgatcctcggcaacggcatgggcggactcagcggccccgcgatcaagccgatcgccttgcgatgcgtgcatcaagtccgccaagccgtcgacattccgatcatcggaatcggtggcgtcgccaacattgacgacgtgatgcagttccttgtcacgggagcctccgccgtgcaaattggcaccgccaactactacgaccccacggtctccatgcggctgatcgaccaactccccgccgctctcgaggaactcaacgccacaaacctctccgacatcgtcggcaccctcgcataa

SEQ ID NO: 7868 - protein, 305 aa, Rhodopirellula baltica SH 1
MTTTQTDLQTKLGRLTLPNPILVASGTFGYAREMEGIVDLPRLGGILPKTITAEPRIGNAPWRTVETSAGLLNAIGLDNDGVDAFLEHHLPYLAGLGTPIIVSVAGRTVEDFTELARRVGQCDGVSAIELNLSCPNVSGGIDFGTNAESCREVVASARNACDVPILAKLTPNVTRIADIAQGAADGGADAVCLINTVLGMAVDWKKRRPILGNGMGGLSGPAIKPIALRCVHQVRQAVDIPIIGIGGVANIDDVMQFLVTGASAVQIGTANYYDPTVSMRLIDQLPAALEELNATNLSDIVGTLA

SEQ ID NO: 7869 - DNA, 951 bp, Chromobacterium violaceum ATCC 12472
  CDS (1)..(951): transl_table=11
atgtcccacgaccacgccatcgatctgtccgtcacctggctgggccagaccatgccgggctgcctgtacaatgcctccggcgtctggtgccgcgaggaggacgaactggaggtgctgctcgcctccgacgccgccgcggtgatcagcaagagcgccacgctggcgccgcgcgacggcaatcccgagccgcgctattgccgcaccgccatgggcagcatcaattccatgggcctgcccaaccgcggcttcgactattacctggactacgcgcgccgctatcgctacggcagcggcaagccgttgttcctgtccctgtccggcctgtcgctggacgacaattgcgcgatgctgcgccgtctggccgaggagggcttgccggcggtaccggagatcaatctgtcctgccccaacgtgccgggcaagccgcagttgggctacgacttcgccgccaccgccgaggcgctgggcgctttcgacgccgcctattccggcctgtacggcgtcaagctgccgccttacttcgatcccgcccatttcgccgcgatggcggagatattgaaccgccatccgcgcctggccttcgtcacctgcatcaactcgataggcaacggcctggtggtggacatcgacagcgaggcggtggtgatcaagcccaaggacggcctgggcggcctgggcggcgactacgtgttgccgaccgcgctggccaatgtgcgggagttttaccggctgctgccgggcaaggacgtggtcggctgcggcggggtgaagagcggccgcgaggctttcatgcacatcctggccggcgcgcgcgcggtgcaggtgggcacctgcctgtatcacgaggggccgggcgccttcgcccgcatcgccggcgagctggcggcgctgatgcgggtcaagggttaccgccgcctggacgatttccgcggcaggctgcgcaccctgtag

SEQ ID NO: 7870 - protein, 316 aa, Chromobacterium violaceum ATCC 12472
MSHDHAIDLSVTWLGQTMPGCLYNASGVWCREEDELEVLLASDAAAVISKSATLAPRDGNPEPRYCRTAMGSINSMGLPNRGFDYYLDYARRYRYGSGKPLFLSLSGLSLDDNCAMLRRLAEEGLPAVPEINLSCPNVPGKPQLGYDFAATAEALGAFDAAYSGLYGVKLPPYFDPAHFAAMAEILNRHPRLAFVTCINSIGNGLVVDIDSEAVVIKPKDGLGGLGGDYVLPTALANVREFYRLLPGKDVVGCGGVKSGREAFMHILAGARAVQVGTCLYHEGPGAFARIAGELAALMRVKGYRRLDDFRGRLRTL

SEQ ID NO: 7871 - DNA, 918 bp, Geobacter sulfurreducens PCA
  CDS (1)..(918): transl_table=11
atgcagaaacctgacctttccgttgagattgctggcatcacgctgagaaacccggtcatgaccgcctcgggcaccttcggctacggcgaggagttctcggagtacgtgaacctggaggcgatcggcgccatcatcaccaaagggctgtccttgaagcccaaggccggcaatccgaccccgcgtatcgtcgaaaccaccggtggaatgctgaacgccatcggtctgcaaaatgtgggcattgatgcctttgtcgagaaaaaggtaccgtttctccgcacggttgccacgccggtgatcgttaattttttcggaaacaccctcgaagaatatgccgaactcgccgagcgcctggacctgatacccgaagtggctgccgtggagatcaatatttcctgcccgaacgtcaaacatggcgggatcgttttcggtacagaccccaaggccgcctattcggtggtaaaggcagtgcgggaggccaccatcaagccggtgatcgtcaagctgtcgcccaatgtgaccgatattgtggagatggcctgggcctgtgccgatgcggaagccgacgccctttccctcattaataccctcaccggcatggccattgatctggacaagcgccgtccaatcctggccaacgtgaccggcggcctctccggaccggcggtgaagccgatcgcgctacgcatggtctggcaggttgccagggcggtgaagattccggttatcggcatagggggcatcatgaccggcatcgatgctctggagttcatgcttgccggcgcaacggccgtgcaggttggcaccgccaacttcctggatccgggcgccgcgggccggattgctgcggaaatggagcgatatctggcggataacggtatcgccgatgttaaggagatgatcggcgccctggaggtctag

SEQ ID NO: 7872 - protein, 305 aa, Geobacter sulfurreducens PCA
MQKPDLSVEIAGITLRNPVMTASGTFGYGEEFSEYVNLEAIGAIITKGLSLKPKAGNPTPRIVETTGGMLNAIGLQNVGIDAFVEKKVPFLRTVATPVIVNFFGNTLEEYAELAERLDLIPEVAAVEINISCPNVKHGGIVFGTDPKAAYSVVKAVREATIKPVIVKLSPNVTDIVEMAWACADAEADALSLINTLTGMAIDLDKRRPILANVTGGLSGPAVKPIALRMVWQVARAVKIPVIGIGGIMTGIDALEFMLAGATAVQVGTANFLDPGAAGRIAAEMERYLADNGIADVKEMIGALEV

SEQ ID NO: 7873 - DNA, 924 bp, Lactobacillus johnsonii NCC 533
  CDS (1)..(924): transl_table=11
atgattaatacacacgtaaaattaccaggattagatttaaaaaatccaattatgccagcaagtggtacctttggttttggtgatgtaccagcagccaagaaatttaatttaaatgatttgggagcaatggtaataaagacaacaactcctcatagtacaacaggtaatccgcagccccaaatagctgttttaaatactggagttttgaattcagttggattaactaatcccggcgttgatgcggtaatcaaagataagttaactcctttgcgtagtgaatatcctaacttgccaattatggctagcgttggtggagaagacgaagcaggatatcttgaagtagctaagaagctatctgattctggactagtcaatgccttagagattaatgtttcttgtccgaatgtgaatcagggcggaatgagctttggcgttcatcctgatgtagtggaagaattgactaaaaaaattaagtcactcgttaaaattccaatttatgtaaaattaactcctaatgtcactgatattacgcagattgcgaaagcagctgaaaatggtggcgcagatggattgtcattgatcaatactcttttgggaatggagattgatgttgaaactagaaagcctgttttggggcacaatattggtggtctttctggtgaagccgtaaaaccaattgctattagaatggttcaccaagttcgagaaagtacaactttaccaattattgggatgggtggaatcagttccgctaaagatgtaattgaatttattctagctggtgctaatgcagttgctgttggaactgcgcattttaaggatagtctcgcttcaaagcatattgctgatgacttaccaaaggaattagaaaagttagggattacagatattaatcaattggtgaataaagtcaattttaattaa

SEQ ID NO: 7874 - protein, 307 aa, Lactobacillus johnsonii NCC 533
MINTHVKLPGLDLKNPIMPASGTFGFGDVPAAKKFNLNDLGAMVIKTTTPHSTTGNPQPQIAVLNTGVLNSVGLTNPGVDAVIKDKLTPLRSEYPNLPIMASVGGEDEAGYLEVAKKLSDSGLVNALEINVSCPNVNQGGMSFGVHPDVVEELTKKIKSLVKIPIYVKLTPNVTDITQIAKAAENGGADGLSLINTLLGMEIDVETRKPVLGHNIGGLSGEAVKPIAIRMVHQVRESTTLPIIGMGGISSAKDVIEFILAGANAVAVGTAHFKDSLASKHIADDLPKELEKLGITDINQLVNKVNFN

SEQ ID NO: 7875 - DNA, 2400 bp, Ustilago maydis 521
  CDS (1)..(2400)
atgcttgcctctcgtagcattcgcgcctttgctgcgccgatgcgcacttctgctattgcaactcggagcttgcagacagctcccacgcgacctcgttcgttgctcgcctcgccaacaatgtcctcgtcgcctttggtagccggcgctgtaccggcacaagctggtcgtcgcaacctgtttactcgagcaccaccaacacctctggcgcgcaccaagcagctcatctaccttgtgtttgccatcgcagctggtacgcttggcattgcctactatgcagactctcgttcggctatccatcgctggatcgcagttccagctctgaaagcattcctcgacccggaatcggcacagaagctggctgtcaagatgctcgagaccggacttgcaccacgtgatcttgttgacgacgatgctgtgctagaaacggaactgttcggcagaaaactctccaacccgatcggtcttgcagctggattcgacaagcaggcagaggcgatcgatggactgcttgaccttggcttcggattcatcgagatcggcagtgtcaccccagaaccacagcctgggaacccacagcctcgctacttccgcctgatcgaggacaacgcctgcatcaaccgtttcggcttcaactcggaaggtcacaatgtcatcctcagccgtctgagggaccgcatccgacgatggctgcttcactcgtcgagcgtcgccaacttgcaagatgcgctgctggcttcgcccgactcggccagcgtcaacgctagacagctgattgctacgcaccctaaaagcacatcggcgtttgtcgacgccaccgacctgcctcgaagcttgcgaccggccaagatgctcggtatcaacctgggcaagaacaagacgagcaacgaagagagtgtcgacgactacgtcaaaggtgtcgagcgtttgggtccgtacgccgatatgatcatcgtcaatgtcagcagtcccaacacgcctggtctgcgtcgtttgcagcgtcgaggcgtgctcgaagatttactcacccaggtggtcagggcgcgcgatggcatggtcgagtcgcatctacgcttctcagacaaaaaagtggcagtgcctctgctcgtcaagatcgcaccggacctgagcgaggaggagcttcacgacgttgccgatgccgcactcaagagcggtattgatggattggtgatcagcaacaccaccatctctcgacctgcctcgcttcgatcgtcggaacacgtgcgcgagacgggtggtctgtcgggcgctcctgtcaagcccctggcgctaaaggctctgaccacggtccacaagcgcttgcagggtaagctgcccatcatcggatgcggcggtatcagcaacggtcaggacgcgctcgactacgccaaggctggtgccagcgcgattgagctgtacacgtctttcggctaccaaggtgtcggtctgccgcgccgcttgaaagacgagctggtagaactgctgaaagccgaaggcaaaacatggcagcaggtggtgggaagcggtctggacctgaccaagatctcgatcgcaactcccaatgccgagacgcccacagggctgcacccgggcagcgatgccgcattccagaagagcgttgccggcgtcaagctcgaactcaatggattgcgtaacaagctcggtctgaacccgacgttgaccaaagagaacctgcgcagcttccttccgagcagggagtcggatgcgagctactacgacctcatcgagaaagctcattcggcactaggcctggaatttgcagccggtgaaaactccaacgtatcagcgcctagctccaccgctccctcttcgcagcctctcccaaccgcaggtgagagacacgtgcaaaccgccaaccagctgttgcaagaccctcaagtgcccaccgttacagttgtgaccaacgacaagaccaaaaaggtctttggtgaaacgacgtccggcaaagtgctcgaggccaacgagaatgccgcgaaccgcgatttcgccaagatcgacaagattcaatcgtgtctaatttgctctttggaaagcctgcgtatgagtgctgccgctgccgctgctgccgctgctgctgctgcattgtgctgtggtggaggagcgggtttgtgtgacgggttgatgttgttgtcaatgagctgcgagaagagtttcaacgtgatcgggtgcatcgggccgagcggactggaagcgatgagtcgtgagcgtagctgctcaggtgcgaggagctttatctgcattttcaactacgcgcagggctccttcggattcagcttcgactacgcctctgccatttgcgtgcttgcgatcggcgtgcctccaatcgatcgaggcgcagcatcgcactacctctctttgcaacggatcgcaagcatagtctag

SEQ ID NO: 7876 - protein, 799 aa, Ustilago maydis 521
MLASRSIRAFAAPMRTSAIATRSLQTAPTRPRSLLASPTMSSSPLVAGAVPAQAGRRNLFTRAPPTPLARTKQLIYLVFAIAAGTLGIAYYADSRSAIHRWIAVPALKAFLDPESAQKLAVKMLETGLAPRDLVDDDAVLETELFGRKLSNPIGLAAGFDKQAEAIDGLLDLGFGFIEIGSVTPEPQPGNPQPRYFRLIEDNACINRFGFNSEGHNVILSRLRDRIRRWLLHSSSVANLQDALLASPDSASVNARQLIATHPKSTSAFVDATDLPRSLRPAKMLGINLGKNKTSNEESVDDYVKGVERLGPYADMIIVNVSSPNTPGLRRLQRRGVLEDLLTQVVRARDGMVESHLRFSDKKVAVPLLVKIAPDLSEEELHDVADAALKSGIDGLVISNTTISRPASLRSSEHVRETGGLSGAPVKPLALKALTTVHKRLQGKLPIIGCGGISNGQDALDYAKAGASAIELYTSFGYQGVGLPRRLKDELVELLKAEGKTWQQVVGSGLDLTKISIATPNAETPTGLHPGSDAAFQKSVAGVKLELNGLRNKLGLNPTLTKENLRSFLPSRESDASYYDLIEKAHSALGLEFAAGENSNVSAPSSTAPSSQPLPTAGERHVQTANQLLQDPQVPTVTVVTNDKTKKVFGETTSGKVLEANENAANRDFAKIDKIQSCLICSLESLRMSAAAAAAAAAAAALCCGGGAGLCDGLMLLSMSCEKSFNVIGCIGPSGLEAMSRERSCSGARSFICIFNYAQGSFGFSFDYASAICVLAIGVPPIDRGAASHYLSLQRIASIV

SEQ ID NO: 7877 - DNA, 1776 bp, Cryptococcus neoformans var. neoformans B-3501A
  CDS (1)..(1776)
atgccccgcccgctgcccctccccgccctcagggccgcgctcccccgcccacaccccctccccctccgccgtctcgcctccaccgcgccgcccccgcgccgccactacctctccaccgccctcctcctcggcggcagcgtcctcctcgtcgcgtactactatgactccaggtctctcctgcacgagcacgtcgccatgccgcttatgcgcctcgtcgcagaccccgaacagggccacaagctcgccgtcagggtcctcgcatgggacaagtgggcccggccgagagacatgggtgtcgacggcgccgagctgcaagcagagcttttcggcatgcatctgaaaaatcctgtcggcatcgcggccggctttgacaaggacgccgaggccatcgatggtctctttgacctcggtttcggttatgttgaagtcggaagtgtcactcccgaaccccagcccggtaaccccaaacctcggtttttccgtctcgaagaggacgatgcctgcatcaaccgatatggattcaactctcttggacacggccacgccctcgcccgacttcgtctccgtctcgccaagtttgctcaggatcatccttccctcttcccgtcccctctgcctgcaaacctcgtcccacccgcgggtttgccgaggtcattgagagccggacagctgcttgcagtcaacttgggcaagaacaaggccagtgaccctgattcaaacgacgactacattcgaggcgtcaggacgctgggaccttttgcggacgtggtcgtgatcaacgtgtcaagcccgaataccccaggcttgcgcgctctccagggcaagcagcagctcgagcgattgttgaacgatgtcgtcgaagaaaggaacaagatcgcccagggaaccggactgcccaagattgcagtcaaagtcgcgtcagacttgagcgaggacgagctggcagatgtggcgagtgcggtgagaagtagtggtgtcgaaggcgtcattgttagcaacactaccatccgaagaaaagagctcaatcttgtttccggcaaccaagaccagatcggcggtctctccggcaagcccctcttcccttacgctctcaatgctctcaagactctgcgcccgcttctccctccgtctgtccccatcatcggctgtggcggtatctcctccggctccgacgccctcaccatggccaacgccggtgcttccatcgtccaagtctacacctctttcggcttccgcggtgtaggtaccccccgtttgatcaaggatgagattacagagcacctcaagggtgaatcatggaagactcacgtaggccgcgactgggcgtcttcaggtcaaccgatgggatgggacgagaaccgtctcaagcaagaaagccaagcgcttgtcgacgaggccaacgggctggcagagctcttgcgacagtctaatgacaaggcagagacggccaagctcatcgaggacgcggagagggcgttgggtatagtgaaagaaaaggatggggcagcgagtgccgcaacggtagtcgatgaaacgatgccgtccctgcctccacaggcggcagtcccttcacaaggcggcgggtttgggattgagggcgtcggtgcgccatctataggagaggcactgatcgctgagcccgtgccgcaagtcgatcttgcacccattgtagtattggaggaaaagaagaacaatgttgacgacaggagggagcatggggaaagggacaatgagtggaagcaggcagtcaaggctgggccaaagaggttagtctag

SEQ ID NO: 7878 - protein, 591 aa, Cryptococcus neoformans var. neoformans B-3501A
MPRPLPLPALRAALPRPHPLPLRRLASTAPPPRRHYLSTALLLGGSVLLVAYYYDSRSLLHEHVAMPLMRLVADPEQGHKLAVRVLAWDKWARPRDMGVDGAELQAELFGMHLKNPVGIAAGFDKDAEAIDGLFDLGFGYVEVGSVTPEPQPGNPKPRFFRLEEDDACINRYGFNSLGHGHALARLRLRLAKFAQDHPSLFPSPLPANLVPPAGLPRSLRAGQLLAVNLGKNKASDPDSNDDYIRGVRTLGPFADVVVINVSSPNTPGLRALQGKQQLERLLNDVVEERNKIAQGTGLPKIAVKVASDLSEDELADVASAVRSSGVEGVIVSNTTIRRKELNLVSGNQDQIGGLSGKPLFPYALNALKTLRPLLPPSVPIIGCGGISSGSDALTMANAGASIVQVYTSFGFRGVGTPRLIKDEITEHLKGESWKTHVGRDWASSGQPMGWDENRLKQESQALVDEANGLAELLRQSNDKAETAKLIEDAERALGIVKEKDGAASAATVVDETMPSLPPQAAVPSQGGGFGIEGVGAPSIGEALIAEPVPQVDLAPIVVLEEKKNNVDDRREHGERDNEWKQAVKAGPKRLV

SEQ ID NO: 7879 - DNA, 924 bp, Clostridium thermocellum ATCC 27405
  CDS (1)..(924): transl_table=11
atgactgagaaaagtattgatttaagtgttgatattgcaggtttgaggctttcaaatcctgttatagcagcttccggtactttcggatttggcagggagtttgttgattacgtggatttaaataaaattggcggaatatcggtaaaaggacttactctggaaaaaaggcaggggaacaggcctccgaggattgccgagactccggccggtattcttaacagtgtggggcttcaaaatccgggcgttagagcctttatagaaaatgaaattccttttttgagaaagtataatacaaaaataattgccaatattgcgggcaatactatagaggattactgcaagatggcagaacttttgtcagatgcggatattgacgcaatagaacttaatgtttcctgtcccaatgtaaagaagggatgtgttgcttttgggaattctcctgcaggaataagcgagattacgagcaaagtgaaaaaatactgcaaaaagccgcttattgttaagcttactcccaatgttaccgatattaaagaaatagctgtcgccgccgaagcagccggagccgatgctctttcccttataaacacgattctcgggatggccattgacatacacagaaaaaggccgatacttgccaacaatgtggggggactttcgggacctgcggtaaagcccattgcagtgaggatggtttatgaagtttgcagtgttgtcaaaatacccgttattggaatgggcggaatatcaagcggtgaggatgcggtggaattcatgctggcaggtgcaagcgcagtgatggtggggacggccaattttataaatcctgcggcatgcattgatgttgtggaaggaataaaaaattaccttaaaatgtataatcacggcagtgtttatgaaataataggaaagttacagctcaactga

SEQ ID NO: 7880 - protein, 307 aa, Clostridium thermocellum ATCC 27405
MTEKSIDLSVDIAGLRLSNPVIAASGTFGFGREFVDYVDLNKIGGISVKGLTLEKRQGNRPPRIAETPAGILNSVGLQNPGVRAFIENEIPFLRKYNTKIIANIAGNTIEDYCKMAELLSDADIDAIELNVSCPNVKKGCVAFGNSPAGISEITSKVKKYCKKPLIVKLTPNVTDIKEIAVAAEAAGADALSLINTILGMAIDIHRKRPILANNVGGLSGPAVKPIAVRMVYEVCSVVKIPVIGMGGISSGEDAVEFMLAGASAVMVGTANFINPAACIDVVEGIKNYLKMYNHGSVYEIIGKLQLN

SEQ ID NO: 7881 - DNA, 903 bp, Clostridium difficile 630
  CDS (1)..(903): transl_table=11
atgggtaatttaagtgtgaaatttggaagtgtagaatttaaaaatccagtaataatggcgtctggaacttttggatttggaaaagaatataatgagatttatgatatacaaaaacttggtggtataagtagcaagggtcttactttaaataaaaaacctggtaacaatggtatgagagttcatgagacatcatccggtatgatgaatagtgttgggcttgaaaaccctggagttcaaggatttatagactatgaattacctttttttagtaaactagacttagtcagaatagctaatgttggaggtgggacattagaagactacttattaggggttcaaatgttaaatgacaagcctatagacattattgaattaaatatatcttgcccaaatgtcaaagctggtggaatggcttttggtataaaaaatgaagtggcaagagaagttgttcgtgaggtaagaaacataacgaaactgcctttagtaataaaattatcacccaatgcagaagatattgtaggaatggcaaaagtttgtgaagaagaaggtgctgatggagtttcattagttaatacttttaaagcaatggcaattgatataaaaaatagaagaccagtatttgaaaatgtatatgctgggttatctggaccagctataaaacctatagctttgagaatggtacatgaagtgtgtaaaaatgtaaatatacctgtaatggggatgggcggaataactaaagccacagatgctatagagtttataatggcaggagctacttgtatccaagttggaactgcaaattttattaatcctagaataggtattgaaataatagatggaattaatgaatttatggatagagaaggaataaaaagtttagacgaaataagaggaattatataa

SEQ ID NO: 7882 - protein, 300 aa, Clostridium difficile 630
MGNLSVKFGSVEFKNPVIMASGTFGFGKEYNEIYDIQKLGGISSKGLTLNKKPGNNGMRVHETSSGMMNSVGLENPGVQGFIDYELPFFSKLDLVRIANVGGGTLEDYLLGVQMLNDKPIDIIELNISCPNVKAGGMAFGIKNEVAREVVREVRNITKLPLVIKLSPNAEDIVGMAKVCEEEGADGVSLVNTFKAMAIDIKNRRPVFENVYAGLSGPAIKPIALRMVHEVCKNVNIPVMGMGGITKATDAIEFIMAGATCIQVGTANFINPRIGIEIIDGINEFMDREGIKSLDEIRGII

SEQ ID NO: 7883 - DNA, 1308 bp, Burkholderia vietnamiensis G4
  CDS (1)..(1308): transl_table=11
atggccgaccttcgctgcacgatcgcaggcatcacttcaccgaatcctttctggctggcgtccgctccgccgaccgacaaggcgtacaacgtcaaccgcgcattcgaggccggctggggcggcgtcgtgtggaagacgctcgggctcgacccgcacgtcgtcaacgtcagctcgcgctacggcgcggtgcagtggaacggccagcgcatcgccgggctgaacaacatcgagctgatcaccgatcgcccgctcgacgtgaacctcgcggagatcgcgcaggtgaagcgcgactggccggaccgcgcgctgatcgtctcgttgatggtgccgtgcaacgagcgtgactggaaatggattctgccgctcgtcgaggatacgggcgccgacgcggtcgagctgaacttcggctgtccgcacgggatgagcgaacgcggaatgggcgcggccgtcggccaggtgcccgaatacgtcgagatggtcacgcgctgggtcaaggagggcacgaagctgccgtgcctcgtgaagctcacgccgaacatcagcgacatccggatgggctcgcgcgcggcatacaagggcggcgcggacggcgtgtcgctgatcaacacgatcaactcgatcgtcgcggtggacctcgaccagatggcgccgatgccgaccgtcgacggcaaggggacgcacggcggctattgcggcccggccgtgaagccgatcgcgctgaacatggtcgccgagatcgcccgcgatccgcagacgccgaacttgccgatctccggcatcggcgggatctcgtcgtggcgcgacgcggcggagttcatcgtgctgggcgccggcagtgtgcaggtgtgcaccgcggcgatgcattacggattccggatcgtgtcggacctcgtcgacggtctgtcgaactggatggacgacaagggctacgcgacgctcgacgacgtgcgcggccgcgcggtgccgaacgtgaccgactggaaatacctgaacctcaagtacgacatcaaggcgcgcatcgaccaggaccgctgcatccagtgcgggctgtgccatatcgcatgcgaggacacgtcgcaccaggcgatcaccgcgacgaaggacggcgtacggcatttcgaagtggtggatgcgcagtgcgtcgggtgcaatctttgcatgcatgtgtgcccggtcgagcagtgcatcacgatggagcgggtcgatgcgggcgactatgcgaactggaccacgcatccgaacaacccggcgcgggccgacgcgggcgcgagcccggcgcagcccgcgcaacccgcgaaggcagcatga

SEQ ID NO: 7884 - protein, 435 aa, Burkholderia vietnamiensis G4
MADLRCTIAGITSPNPFWLASAPPTDKAYNVNRAFEAGWGGVVWKTLGLDPHVVNVSSRYGAVQWNGQRIAGLNNIELITDRPLDVNLAEIAQVKRDWPDRALIVSLMVPCNERDWKWILPLVEDTGADAVELNFGCPHGMSERGMGAAVGQVPEYVEMVTRWVKEGTKLPCLVKLTPNISDIRMGSRAAYKGGADGVSLINTINSIVAVDLDQMAPMPTVDGKGTHGGYCGPAVKPIALNMVAEIARDPQTPNLPISGIGGISSWRDAAEFIVLGAGSVQVCTAAMHYGFRIVSDLVDGLSNWMDDKGYATLDDVRGRAVPNVTDWKYLNLKYDIKARIDQDRCIQCGLCHIACEDTSHQAITATKDGVRHFEVVDAQCVGCNLCMHVCPVEQCITMERVDAGDYANWTTHPNNPARADAGASPAQPAQPAKAA

SEQ ID NO: 7885 - DNA, 936 bp, Streptococcus pyogenes str. Manfredo
  CDS (1)..(936): transl_table=11
atggtttctactgctacacaaattggtcatttctcttttgataactgcttgatgaatgctgctggtgtttactgcatgacaaaagaagagcttatagaggttgaaaagtctcaagccgcttcctttgtcaccaaaacagggacgcttgaagttcgtccaggtaatccagaacctcgctatgcagatactcgtcttggttctatcaattcaatgggactccctaataatggttttcgctactacttagactttgtcagtgatcttgccaaaaccgggcaacataaacctcattttctctccgttgtcgggctatctcctactgaaaccgaaaccattttaaaagccatcatggcttcagattatgagggtctagtggagctaaacctttcttgcccgaacgttccaggaaaaccacagattgcttatgattttgaaaccactaatcaacttctagagaacctctttacctattacactaaacctcttggtatcaaattacctccttattttgacattgtgcattttgatcaagcggctgcgattttcaataaataccccctttcctttgttaactgtgtcaattctatcggaaatgggctggtcattgaggatgaacaagtcctcatcaagcctaaaaatggctttggtggtataggtggagattacatcaaacctactgctctagccaatgtccatgcgttttacaaacgcttaaaaccttctatccacattattggtacagggggagttaaaacaggacgcgatgcctttgaacatattctttgtggcgccagcatggtccaaattggaacagcccttcatcaagaagggccagctatctttgagcgggtgaccaaggaattaaaaacgattatggtagaaaaaggctaccaaagcttaaacgattttcgtgggaacttacgttacaaagattaa

SEQ ID NO: 7886 - protein, 311 aa, Streptococcus pyogenes str. Manfredo
MVSTATQIGHFSFDNCLMNAAGVYCMTKEELIEVEKSQAASFVTKTGTLEVRPGNPEPRYADTRLGSINSMGLPNNGFRYYLDFVSDLAKTGQHKPHFLSVVGLSPTETETILKAIMASDYEGLVELNLSCPNVPGKPQIAYDFETTNQLLENLFTYYTKPLGIKLPPYFDIVHFDQAAAIFNKYPLSFVNCVNSIGNGLVIEDEQVLIKPKNGFGGIGGDYIKPTALANVHAFYKRLKPSIHIIGTGGVKTGRDAFEHILCGASMVQIGTALHQEGPAIFERVTKELKTIMVEKGYQSLNDFRGNLRYKD

SEQ ID NO: 7887 - DNA, 948 bp, Streptococcus pyogenes MGAS10394
  CDS (1)..(948): transl_table=11
atggaggaaataatggtttctactgctacacaaattggtcatttctcttttgataactgtttgatgaatgctgctggtgtttactgcatgacaaaagaagagcttatggaggttgaaaagtctcaagccgcttcctttgtcaccaaaacagggacgcttgaagttcgtccaggtaatccagaacctcgctacgcagatactcgtcttggttctatcaattcaatgggactccctaataatggttttcgctactacttagactttgtcagtgatcttgccaaaaccgggcaacataaacctcactttctctccgttgtcgggctatctcctactgaaaccgaaaccattttaaaagccatcatggcttcagattatgagggtctagtggaactaaacctttcttgccctaacgttccaggaaaaccacagattgcttatgattttgaaaccactgatcaacttctagagaacatctttacctattacactaaacctcttggtatcaaattacctccttattttgacattgtgcattttgatcaagcggctgcgattttcaataaataccccctttcctttgttaactgtgtcaattctatcggaaatgggctggtcattaaggatgaacaagtcctcatcaagcctaaaaatggctttggtggtataggtggagattacatcaaacctactgctctagccaatgtccatgcgttttacaaacgcttaaaaccttctatccacattattggtacagggggagttaaaacaggacgcgatgcctttgaacatattctttgtggcgccagcatggtccaaattgggacagcccttcatcaagaagggccagctatctttgaacgggtcactaaggaacttaaaacgattatggtagaaaaaggctaccaaagcttagacgattttcgtgggaacttacgttacaaagattaa

SEQ ID NO: 7888 - protein, 315 aa, Streptococcus pyogenes MGAS10394
MEEIMVSTATQIGHFSFDNCLMNAAGVYCMTKEELMEVEKSQAASFVTKTGTLEVRPGNPEPRYADTRLGSINSMGLPNNGFRYYLDFVSDLAKTGQHKPHFLSVVGLSPTETETILKAIMASDYEGLVELNLSCPNVPGKPQIAYDFETTDQLLENIFTYYTKPLGIKLPPYFDIVHFDQAAAIFNKYPLSFVNCVNSIGNGLVIKDEQVLIKPKNGFGGIGGDYIKPTALANVHAFYKRLKPSIHIIGTGGVKTGRDAFEHILCGASMVQIGTALHQEGPAIFERVTKELKTIMVEKGYQSLDDFRGNLRYKD

SEQ ID NO: 7889 - DNA, 990 bp, Desulfotalea psychrophila LSv54
  CDS (1)..(990): transl_table=11
gtggttatgattgacctgtcaacgagttatttggggcttgatttaaagtgtcccttagttgtaggaagttgtggtttaacaaattctgtaaaaaagattagggagatcgccgaggctggtgccggtgccgttgttttgaaatctctctttgaagagcagattgtggcagaactgggtcataatctggaatcctatgaggcggggtacccggatgcggtggattatattcgggagtatactcgtgatgccaccgttgaaaaatatcttgatcttgtctccgcggcaaaaaaagcggtggatattcccgtaatagcttccctgaactgtgtttctgcaaacgagtggacctcctttgctacccaaatcgaaaaggcaggggccgatgccattgagttgaacatatccctgctcccctccgacccgcgaatgagcggggctgaggctgagaaaaaatatacagaaattattgataaggtggcctccaccgtttctgtccccctctctctcaaaatgagccagttttcttctggtcttgcccaccttttgactcaccttggatggaaacaaaacattaatggttttgttcttttcaatcggtactatcgtccagatattgatattgataaaatgaccattacttcggctgatatttttagcaatccaagtgaaatgcatgagtctttgcgctgggttgctcttctttctgaccgaattgaaaaagatttcgttgcctccacggggatctatgatggagcggcccttatcaagcaactgcttgccggggcaacagcggctcagattgtctctgccctctacaaaaatggaatcccttatattggtgtattactcgaagaactgaagcagtggatggaagagaaatctttttcccgtgtagatgattttcgaggtaagcttagctatagcaacattgaaaatccggctgtttttgagcgtacccagtttatgaaatattatggcggagtttcttaa

SEQ ID NO: 7890 - protein, 329 aa, Desulfotalea psychrophila LSv54
MVMIDLSTSYLGLDLKCPLVVGSCGLTNSVKKIREIAEAGAGAVVLKSLFEEQIVAELGHNLESYEAGYPDAVDYIREYTRDATVEKYLDLVSAAKKAVDIPVIASLNCVSANEWTSFATQIEKAGADAIELNISLLPSDPRMSGAEAEKKYTEIIDKVASTVSVPLSLKMSQFSSGLAHLLTHLGWKQNINGFVLFNRYYRPDIDIDKMTITSADIFSNPSEMHESLRWVALLSDRIEKDFVASTGIYDGAALIKQLLAGATAAQIVSALYKNGIPYIGVLLEELKQWMEEKSFSRVDDFRGKLSYSNIENPAVFERTQFMKYYGGVS

SEQ ID NO: 7891 - DNA, 930 bp, Desulfotalea psychrophila LSv54
  CDS (1)..(930): transl_table=11
atggaaaaaataagtgaaggtgcagatcttcgagttgacattggctccttagagctgcaaaatcccattatgactgcttcgggtaccttcggctatgctcgggagttcagccagctggttaagctgcaaaagttgggtgccgtggtggtcaaggggatctctcttcggccccgtcccggtaaccctccgcctcgtattgtcgaaacgtccagtggcatgctcaatgccattggtctgcagaatgttggggtggataggtttatcagcgaaaagatgccctaccttcaggagcaggggctaccggcagtggtcaatatcctcggggattctctggaggagtatcgcgatatcgcccagaagttgcgtggggttaagggtattgccgctatcgaggtgaatatttcctgccccaatgtgaaaaagggcggggtggcctttggcaccaatccggagatggccgctcgggtaacaaggacggtcaaggatgcagccgatgtgccggtgatggtcaagctctctcctaatgtgacggatattactgaaatcgcccgggccgtagaggcgggtggtgccgatagtctctctatgattaatacccttatcggtatggggatagacataaagacacggagaccatcgcttgccaatatcatcggcggactttcgggccctgccataaaaccggtggccctgcgtatggtatatcaggtagccaaggttgtctccgtgcccataataggcattggcggtatctcttctcttgaggatgttattgaattcctcctggcaggagcatctgcggtgcagattggaacggctaattttgttgatcctgccataagcagtgatcttgttgagcagctggccgactatgtgcaggcagagggattgagctctgtccgtgaattgattggtgcccttgaggcctag

SEQ ID NO: 7892 - protein, 309 aa, Desulfotalea psychrophila LSv54
MEKISEGADLRVDIGSLELQNPIMTASGTFGYAREFSQLVKLQKLGAVVVKGISLRPRPGNPPPRIVETSSGMLNAIGLQNVGVDRFISEKMPYLQEQGLPAVVNILGDSLEEYRDIAQKLRGVKGIAAIEVNISCPNVKKGGVAFGTNPEMAARVTRTVKDAADVPVMVKLSPNVTDITEIARAVEAGGADSLSMINTLIGMGIDIKTRRPSLANIIGGLSGPAIKPVALRMVYQVAKVVSVPIIGIGGISSLEDVIEFLLAGASAVQIGTANFVDPAISSDLVEQLADYVQAEGLSSVRELIGALEA

SEQ ID NO: 7893 - DNA, 930 bp, Bacillus cereus E33L
  CDS (1)..(930): transl_table=11
atgaacagattgcaagttgaattaccaggattatcattaaaaaatccaattataccggcatctggatgctttggatttggtcgtgaatatgcacagttttacgatttaagtgtactaggatcaatcatgatcaaagcgacgacagaacaaccacgctatggaaatcctacgcctcgtgttgctgaaacaccgggcggtatgttaaatgcaatcgggcttcaaaatccaggattagaaaaagtaatgaattctgaattaccatggttagaacaatttgatcttccaatcattgcgaacgttgcaggctcacaagctgaagattacgtagcggttgcaaaggaaatttctaaagcgcctaatgttcatgcactagaattaaacatttcttgtcctaacgtaaaaacaggtggtatcgcctttggtacaaatcctgaaattgctgctgatttaacgaagcgagtaaaagaggtttctgaagtacctgtatacgtgaaattgtcaccgaacgtggcaaacattgtggagattgcaaaagcgattgaaaatgcaggtgcagatggtttaacgatgattaatacattgcttggtatgcgtctagatttaaaaacagctaaaccaattttagcaaaccgtacaggcggattatcaggtcctgcgattaagccagtagcaattcgtatggtacatgaagtaagccaagcggttaacattccaattatcggaatgggtggtattgaaacagcggaagatgtaatcgaattcttctacgctggcgcaagcgcagttgcagtaggtacagcgaactttatcgatccattcgtatgtccgacaattattgaagagttaccagcattactagatgaattaggatttgatcacatttcggaatgtcaaggaaggagctggaagcaaacatgtcacagtcgttaa

SEQ ID NO: 7894 - protein, 309 aa, Bacillus cereus E33L
MNRLQVELPGLSLKNPIIPASGCFGFGREYAQFYDLSVLGSIMIKATTEQPRYGNPTPRVAETPGGMLNAIGLQNPGLEKVMNSELPWLEQFDLPIIANVAGSQAEDYVAVAKEISKAPNVHALELNISCPNVKTGGIAFGTNPEIAADLTKRVKEVSEVPVYVKLSPNVANIVEIAKAIENAGADGLTMINTLLGMRLDLKTAKPILANRTGGLSGPAIKPVAIRMVHEVSQAVNIPIIGMGGIETAEDVIEFFYAGASAVAVGTANFIDPFVCPTIIEELPALLDELGFDHISECQGRSWKQTCHSR

SEQ ID NO: 7895 - DNA, 933 bp, Dehalococcoides ethenogenes 195
  CDS (1)..(933): transl_table=11
atggctgaacttaatttaaatgtagatatcgccccgtataatgcccgccagctcaggctggccaatccggttatagtggcttccgggacgtttggctatggtgatgagtacccccacctttttgaccgtaaccgtttgggtgccattgtctgcaaagccactaccctgaaaccgagggagggaaacccccagccccgcatagccgaaactccaaacggcatgcttaattccatcgggctgcaaaatatgggggtggaggcggttatccgggaaaaggcgccccagtggtacacctggggcgtgcctgtaatagtaaatattgcggctgaaagcattgaagattatgctgagcttgcccggcggctggataaagtgcccggtgtaagcggtatagaagtaaatatcagctgccccaacgttaagtgcggctgtatagagtttggttcttcacccgaatctgccgccagagtgactgatgcagtcaggaatgccaccactctgcccctgataataaaactgacccccaataccagcagcataaccgagctggccagggcagtggcggatgccggggcggatgctatttcgcttataaataccctgcggggtatgcgtatagatattaaaaaacggcgtcccatactgggtaatcataccggggggctttcaggaccggctataaaaccggtggctgtcagcatggtctatcaggtatccggtgcggtgaatgtgcctgttatcggcggcggcggtattatgaatgccgaagatgcgcttgaatttataatggccggggcaactgctgttcagataggcacagccaacttggtcaacccgcgtgcccccctagaggtgcttgaggggctggaagcttatgccagagccgaggggctgaaaaacatacgggaaatagtgggcatagccagaagctag

SEQ ID NO: 7896 - protein, 310 aa, Dehalococcoides ethenogenes 195
MAELNLNVDIAPYNARQLRLANPVIVASGTFGYGDEYPHLFDRNRLGAIVCKATTLKPREGNPQPRIAETPNGMLNSIGLQNMGVEAVIREKAPQWYTWGVPVIVNIAAESIEDYAELARRLDKVPGVSGIEVNISCPNVKCGCIEFGSSPESAARVTDAVRNATTLPLIIKLTPNTSSITELARAVADAGADAISLINTLRGMRIDIKKRRPILGNHTGGLSGPAIKPVAVSMVYQVSGAVNVPVIGGGGIMNAEDALEFIMAGATAVQIGTANLVNPRAPLEVLEGLEAYARAEGLKNIREIVGIARS

SEQ ID NO: 7897 - DNA, 993 bp, Thermobifida fusca YX
  CDS (1)..(993): transl_table=11
atgcccttggacgcggagacggtggcggagacagcggcgatgattcccgatctgcgggtcaggctgggggaactggagctggccaacccggtggtgaccgcggccggatgcgccggggccgggcgggagctggcgcggttcttcgacattgcgcggatcggcgcggtggtcaccaagtcggtcaccgtggagccgcgggccggctggcctgcgccgcgtatcgccgagaccccgagcggggtgctcagcacggttggcttgcaggggccaggcatcgacgtgttcgtgcagcgggacctgccgtggctgctctcccgcggggcgcgtgccgtggtgtcggtggccggggggagtgtcgacgagtacgtcacgctcgcccagcggctctccgaagctcccggggtcaccgcgatcgaagtgaacctgtccagcccggacttgagccgcgggggcgagcatttcaccgcggaccccgaggccgcagcccaggtggtggcggcggtgcgggagaccgcacggtccgacatcccggtgttcgcgaaactctccccggacgtcgccgacctggtggcgctcgccggcaagtgcgtggctgcgggcgccgacgggctggccctcgtcaacacggtgcggggcatggtcatcgacgtcgacacgatgcgtcccgccgtggccggggggatgggcggcctgtccggtcccgcgatccggccgatcgcggtcgcctgcgtctaccaggtgcatgccgcatacccggaggtgcccatcatcgggatgggcgggatcggcaccggccgggacgcgctggagttcctgctagccggggcgagcgcagtagcggtcgggaccgcgctcttccacgacccttcggcgtgcatgcgcgtgctgcgggaactggagcgggagctgatcgaccggggagtggagcgggtcgagtcgctgatcggggccgcccaccatgggatgggaggcctcggcgtggccgcgggatga

SEQ ID NO: 7898 - protein, 330 aa, Thermobifida fusca YX
MPLDAETVAETAAMIPDLRVRLGELELANPVVTAAGCAGAGRELARFFDIARIGAVVTKSVTVEPRAGWPAPRIAETPSGVLSTVGLQGPGIDVFVQRDLPWLLSRGARAVVSVAGGSVDEYVTLAQRLSEAPGVTAIEVNLSSPDLSRGGEHFTADPEAAAQVVAAVRETARSDIPVFAKLSPDVADLVALAGKCVAAGADGLALVNTVRGMVIDVDTMRPAVAGGMGGLSGPAIRPIAVACVYQVHAAYPEVPIIGMGGIGTGRDALEFLLAGASAVAVGTALFHDPSACMRVLRELERELIDRGVERVESLIGAAHHGMGGLGVAAG

SEQ ID NO: 7899 - DNA, 924 bp, Carboxydothermus hydrogenoformans Z-2901
  CDS (1)..(924): transl_table=11
atgaatttaaaagttaaaattggcgagcttactttaaaaaatccggtgatgccggcctcgggaacctttggttttggcttagaatttaaagatatttttgacttaaaaaacttgggagcgttagtggtaaagactattaccaaaaatccccggttggggaacagaccaccgcgggtttatgaagtatcctgcggaatgattaattcaattggactggccaatcccgggtgggattatttttgtgagaaaattttaccgcaaataaaggacttaaatgatattttaattttaaatattgccggggagagtgttgaagagtttcaatatttagctcgggaagctcaacggtttgacgaaataaaagccttagaattaaacgtatcttgtcccaatgtcagtaaaggtggcattgcttttgggaccgatttggaagctttaaaacaaattgtgtcttccgttagaaaaatatatagcaaaactttaatagtaaaactaactccaaatgttacagacataaccgtttacgctaaagctgcggaaaatgcgggagctgatgctttaaccctgattaatacttttaccggcatggtaattgatgtaaaaagcaaaaaaccaatattgggcaacaagcacggcggggtttcgggcccggcaattcgacccatggctgtaaagatggtttatgattgctttaaggcggtttctattccaattattggggtaggaggaatagacagcaaggaggcagccctggaatttttcctggccggagcaaccgccattcaggtcggcagccaaaattttgtcgaaccgggctttatgccgcggcttataagggaactgggagagtatttacaggaggaaaatattgaaagtattgctaaattaactggacttgcccatcggggggaagaaaatgtctga

SEQ ID NO: 7900 - protein, 307 aa, Carboxydothermus hydrogenoformans Z-2901
MNLKVKIGELTLKNPVMPASGTFGFGLEFKDIFDLKNLGALVVKTITKNPRLGNRPPRVYEVSCGMINSIGLANPGWDYFCEKILPQIKDLNDILILNIAGESVEEFQYLAREAQRFDEIKALELNVSCPNVSKGGIAFGTDLEALKQIVSSVRKIYSKTLIVKLTPNVTDITVYAKAAENAGADALTLINTFTGMVIDVKSKKPILGNKHGGVSGPAIRPMAVKMVYDCFKAVSIPIIGVGGIDSKEAALEFFLAGATAIQVGSQNFVEPGFMPRLIRELGEYLQEENIESIAKLTGLAHRGEENV

SEQ ID NO: 7901 - DNA, 918 bp, Geobacter metallireducens GS-15
  CDS (1)..(918): transl_table=11
atgaaaagaccagacctctctgtcgagatagcgggaatcaaactcaggaacccggtcatgaccgcttcggggactttcggctacggcgaagaatttgccgcgtacgtgaatctcgaaaagatcggcgccatcatcaccaagggactctctctgaagcccaaggccggcaacccgacgccacgcatccaggaaaccaccggcgggatgctgaacgctattggtctccagaatgtgggaatagatgcctttatcgagaaaaaggtgccgtttctccgcaccgtcaacacgcctgccatcgtcaactttttcggcaataccgtcgaggaatacgccgagctcgccgagcggctcgacaagattcccgaagtggccgggatggagatcaacatctcgtgtccgaatgtgaagcacggcggtatcgttttcggcaccgagcccaaggcggcatattcggtggtgaaggcggtacgggaggccaccatcaagccggtaattgtgaagctctcccccaacgtcaccgacatcgtggagatggcctgggcctgtgctgacgccgaggctgatgccctgtccctcatcaataccctgaccggcatggccatcgacctcaagtcccggcggcccatccttgccaacgtgaccggcggcctttcgggaccggcggtgaaaccggtggccctcaggatggtctggcaggtggctaaggcggtgaaaattccggtgatcggcatcggcggcatcatgtccgggaccgacgccctggagttcatgctggccggcgccacggccgttcaggtcgggaccgccaactttcttgacccggccgcttccgagcggattgcggcggaaatggagcagtatctggttaacaacggaattacggacgtgaaggagctaatcggcgcactgcaggtctga

SEQ ID NO: 7902 - protein, 305 aa, Geobacter metallireducens GS-15
MKRPDLSVEIAGIKLRNPVMTASGTFGYGEEFAAYVNLEKIGAIITKGLSLKPKAGNPTPRIQETTGGMLNAIGLQNVGIDAFIEKKVPFLRTVNTPAIVNFFGNTVEEYAELAERLDKIPEVAGMEINISCPNVKHGGIVFGTEPKAAYSVVKAVREATIKPVIVKLSPNVTDIVEMAWACADAEADALSLINTLTGMAIDLKSRRPILANVTGGLSGPAVKPVALRMVWQVAKAVKIPVIGIGGIMSGTDALEFMLAGATAVQVGTANFLDPAASERIAAEMEQYLVNNGITDVKELIGALQV

SEQ ID NO: 7903 - DNA, 927 bp, Desulfovibrio desulfuricans G20
  CDS (1)..(927): transl_table=11
gtggatttgcatgtcaccatacccagcggcctgcacggccttgagctgaaaaaccccgtcatgacggcctccggcacattcggctacggtgtcgaatttgccccttacggcgaccttgcccgtctgggcggcatagtggtcaaaggtctgtcgcttaaagcccgtgccggcaaccccatgccgcgcatcgccgaaaccgcatgcggcatgctgaacgccgtggggctgcagaactccggcgtcgaaaacttcatcacgcagaagctgccgcagctgccctggcaggaaacacccgtcatcgccaacctgtatgcctgcgaccctgacgaatttgccgaactggccggcatacttgccgccgaagaaggcattgccgccattgaagtgaacatctcgtgccccaacgtaagtgaagggggcatactcttcgggcaggatgcaagacaggccgcccgggtgaccggcgccgtaaaacgccgttccggcaccaagcccgtcatcgtcaaactgtcgcccaatgtcaccgacattgccgaaattgcccgtgcagtggaagacagcggggcggacatgctttcgtgcatcaacacgctgagcggcatggccgtggacatccgcagccgcaagcctctgctggccaatgtcatcggcggactttccggccctgccatcaaacccgtggccctgcgctgcgtatggcaggccgcccgctctgtcagcattccggtcatcggcatcggcggagccaccacggcagaagacatactggaattcatgctggtgggcgcacacgccgtacagataggcaccgccaacttcatgcgccccgactgcgccttccggctggtggatgaactgcagcagctggtggatacgctgggcatcaccagctgggatgacttcagaggctcgctggacatcagataa

SEQ ID NO: 7904 - protein, 308 aa, Desulfovibrio desulfuricans G20
MDLHVTIPSGLHGLELKNPVMTASGTFGYGVEFAPYGDLARLGGIVVKGLSLKARAGNPMPRIAETACGMLNAVGLQNSGVENFITQKLPQLPWQETPVIANLYACDPDEFAELAGILAAEEGIAAIEVNISCPNVSEGGILFGQDARQAARVTGAVKRRSGTKPVIVKLSPNVTDIAEIARAVEDSGADMLSCINTLSGMAVDIRSRKPLLANVIGGLSGPAIKPVALRCVWQAARSVSIPVIGIGGATTAEDILEFMLVGAHAVQIGTANFMRPDCAFRLVDELQQLVDTLGITSWDDFRGSLDIR

SEQ ID NO: 7905 - DNA, 1059 bp, Moorella thermoacetica ATCC 39073
  CDS (1)..(1059): transl_table=11
atggagcaggctgagaagaggcccggagtgaatcctaaagaagaagacgagaagttgggggccagaggtaagggacttgcaggaacaggctgcgccggttccgggctaaagtcacgatctactcctcaagagccggaaaccggtgccggggtcaacctggaggtacagcttggggacctgaccctgccgaaccccgtcatgccggcctccggtaccttcggctttggcgaggaatacgcaccttttctggacctcaaccgcctgggggccctggttgtgaagaccattaccctggagccgacccccggcaacccgccgccgcgtttaatggagactccctccggtttactcaactccatcgggctccagaacccgggcctggaggtttttctccgggagaaactgccttatttgcgccggtttactcccccgctgattgtaaatattgccggcaggacggtagaggaatacggcgagctggctgccaggctaagcgcggcggagggtattgccgccctggaggtcaacatctcctgccccaatgtccgggagggaggtattgtcttcggcacggtgccggaaatggccgcccgggtgacggcaacggtaaaagggcaaacccacctgccggtgatagttaaactgacgcccaatgtcaccgatattacggtcctggccagggcggtggaggacgccggggccgatgccctttccctgatcaatacccttcagggtatggccatcgacctggagacccgacggccggccctggccaatatcgtcgggggcctgagcggcccggccattaaaccggtggccctctgtgccgtctggcgggtggcccgggcggtaaagatcccggtaatcggcatgggcggtatcgtgaccgcccgggatgccctggagttcctcctggccggggccagggccgtggcggtaggcacagccggcctggtgaatccccgggctataatcgaagtgattgacgggattaaagcctacctgcaggaacagggtttgcaggatgtcaacgaactggtaggcgccttgcgaatttaa

SEQ ID NO: 7906 - protein, 352 aa, Moorella thermoacetica ATCC 39073
MEQAEKRPGVNPKEEDEKLGARGKGLAGTGCAGSGLKSRSTPQEPETGAGVNLEVQLGDLTLPNPVMPASGTFGFGEEYAPFLDLNRLGALVVKTITLEPTPGNPPPRLMETPSGLLNSIGLQNPGLEVFLREKLPYLRRFTPPLIVNIAGRTVEEYGELAARLSAAEGIAALEVNISCPNVREGGIVFGTVPEMAARVTATVKGQTHLPVIVKLTPNVTDITVLARAVEDAGADALSLINTLQGMAIDLETRRPALANIVGGLSGPAIKPVALCAVWRVARAVKIPVIGMGGIVTARDALEFLLAGARAVAVGTAGLVNPRAIIEVIDGIKAYLQEQGLQDVNELVGALRI

SEQ ID NO: 7907 - DNA, 903 bp, Methanococcoides burtonii DSM 6242
  CDS (1)..(903): transl_table=11
atggtaactattacaggtatagatttcaagaatccgaccatgctcgcatccggtataatgggaactaccggtgcatcccttctccgcattgcagaatgtggtgcaggcggggttgtgaccaaatcaattggaccggaacccaaggcaggtcatccgaatcccagcatgataaaacttgaatgcggtttcttgaatgctatgggtcttccaaatccttcctatactgaatttgataatgagataaagacagttcgatccggcactgatgtgccggtgatagcaagcatcttcggtggcaatgccgaggattttgtgaaagtagcagaaggccttgcagattccgaaccggctgctttcgagcttaatgtgagctgtcctcatgcggaaggttatggtgccaccataggaaccgatacctgtatggtggaatcaattacagccgctgtttgtgatgctgtggacgtgccggtgtgggtaaaacttactcccaacgtgaccgatatcaaagccatagggaaagcagcacaaaatggtggtgcggatgcggtggtggctatcaatactcttcgtggtatggccatcgatatcaattcgggttatcctatactgggcaaccgctttggagggctttccggcccggctgtaaaaccggttgcaataaaatgtgtctatgacctttatgaagccctcgacattcctgttataggagttggcggtgtttccacatgggaagatgcagtggaaatgatgatggcaggagcaagtgcagttcaaataggctcagcggtccatgaaagtgtggatatcttttcagatattgcatccggaatagagcttttccttcaggacaaaggatactcggatgtcggggatattattggtctttctcatgaggtgatctaa

SEQ ID NO: 7908 - protein, 300 aa, Methanococcoides burtonii DSM 6242
MVTITGIDFKNPTMLASGIMGTTGASLLRIAECGAGGVVTKSIGPEPKAGHPNPSMIKLECGFLNAMGLPNPSYTEFDNEIKTVRSGTDVPVIASIFGGNAEDFVKVAEGLADSEPAAFELNVSCPHAEGYGATIGTDTCMVESITAAVCDAVDVPVWVKLTPNVTDIKAIGKAAQNGGADAVVAINTLRGMAIDINSGYPILGNRFGGLSGPAVKPVAIKCVYDLYEALDIPVIGVGGVSTWEDAVEMMMAGASAVQIGSAVHESVDIFSDIASGIELFLQDKGYSDVGDIIGLSHEVI

SEQ ID NO: 7909 - DNA, 1305 bp, Silicibacter sp. TM1040
  CDS (1)..(1305): transl_table=11
atggctgatcttacaacagaattcctcggtatcaaatcgccgaatcctttctggctggcctccgcgccgcccaccgacaaagaatataacgtgcgccgcgcctttgaggcgggctggggcggtgtggtctggaagaccctcggcgccgaagggccaccggttgtcaacgtgaacgggccgcggtatggcgcgatctggggggcggaccgccgtcttctggggctcaacaacatcgaactgatcacggatcgcccgctggatgtgaacctcgaggagatgacccgcgtcaaaaaggactacccggatcgcgcgctgattgcgtcgatcatggtgccctgtgaagaggcggcttggaaagcgatcctgccgcgtgtggcggaaacaggatgtgacgggatcgagctcaactttggctgcccgcatgggatggccgagcgcggcatgggttctgctgtggggcaggttccggaatacattcagatggtcaccgaatggtgcaaacagtattatgacaagccggtgatcgtgaagctcacgcccaatatcaccgacattcgtcatccggcgcgggccgcgaaggccggcaatgccgatgctgtgtctctgatcaacaccatcaattcgatcacctcggtcaaccttgatgcaatgtcgcccgaaccgatgattggcggcaagggcacccatggcggctattgcggcccggcggtgaaaccgatcgccatgaatatggtggccgaaatttcccgcgatccgcaaaccgcaggtctgcctatttccgccattggcggcgtgacaacatggcgcgatgcggcggagttcatcgctcttggggctggcaatgtgcaggtttgcacggcggccatgacctatgggttcaaggtcgttgaagagatgatttcgggcctgtcggattggatggacgagaagggctattcctcgatcgaggacttccgtggcatggcggttccgaatgtgaccgactggcagtatctggacctcaactatgtgaccaaggccaagatctctcaggatgactgcatcaaatgcggacgttgctatgcggcctgcgaggatacctcgcatcaggcgattgagatgtcggcggatcggacctttaccgtgaaggacgacgaatgcgtggcgtgtaacctgtgcgtcaacgtctgtccggttgaaggctgtatcaccatggaagaggttgccgtgggcgccattgatgaacgcaccggcaaggtggtgagcggcgaatatggcaactggacccagcaccctaataatccgtctgcaacggctgcggaataa

SEQ ID NO: 7910 - protein, 434 aa, Silicibacter sp. TM1040
MADLTTEFLGIKSPNPFWLASAPPTDKEYNVRRAFEAGWGGVVWKTLGAEGPPVVNVNGPRYGAIWGADRRLLGLNNIELITDRPLDVNLEEMTRVKKDYPDRALIASIMVPCEEAAWKAILPRVAETGCDGIELNFGCPHGMAERGMGSAVGQVPEYIQMVTEWCKQYYDKPVIVKLTPNITDIRHPARAAKAGNADAVSLINTINSITSVNLDAMSPEPMIGGKGTHGGYCGPAVKPIAMNMVAEISRDPQTAGLPISAIGGVTTWRDAAEFIALGAGNVQVCTAAMTYGFKVVEEMISGLSDWMDEKGYSSIEDFRGMAVPNVTDWQYLDLNYVTKAKISQDDCIKCGRCYAACEDTSHQAIEMSADRTFTVKDDECVACNLCVNVCPVEGCITMEEVAVGAIDERTGKVVSGEYGNWTQHPNNPSATAAE

SEQ ID NO: 7911 - DNA, 1314 bp, Mesorhizobium sp. BNC1
  CDS (1)..(1314): transl_table=11
atggctgacatccgctccaacttcctcggcatcaaatcgccgaacccgttctggctcgcttctgccccgcccacggacaaggcctataatgtcgagcgtgccttcaaggccggctggggcggcgtggtgtggaagacgctgggcgaggaggggccgccggtcgtcaatgtgaacggcccgcgctacggcgccatctggggcgcggaccggcgcctgctcggctttaacaatatcgagctcatcaccgaccgcgatctctatttgaaccttaccgagatcaaacaggtgaagcggaactggccggaccgggcgcttatcgtctcgctcatggtgccctgcgaggaggaggcctggaaggccattttgccgctggtcgaggagacggaggccgacggcatcgagctcaatttcggctgcccgcatggcatgagcgagcgcggtatgggctccgcggtcggccaggtgccggaatatgtcgagatggtggtgcgctggtgcaagcagcacacgcgcatgcccgtcattaccaagctcacgcccaacataacggacattcgcaagcccgcgcgcgccgcccatgccggtggcacggacgcggtctcgctcatcaacaccatcaactcgatcacggcggtcgatctcgacagttttgcgccggagcccaccatcgacagcaagggcacacatggcggctattgcgggccggcggtgaagcccatcgcgctcaacatggtggccgagatcgcgcgcgatccggaaacgcgcgggctgcccatctctggcatcggcgggatcaccacatggcgcgacgccgcggagttcctggcgctgggcgccggaaccgtgcaggtgtgtaccgccgccatgacctatggcttcaagatcgtcgaggagatggtcgaggggctgaagaactggatggacgagaaggggcacgccacgctcgacgacattatcggccgcgctgtgccgaacgtgacggactggcagtacctcaacctcaactacatcaccaaggcgcgcatcgatcaggatctctgcataaagtgcgggcgctgccatatcgcctgcgaggacacatcgcatcaggcgattacgtcggtggtgaacggcgtgcgctacttcgaggtgaaggaggaggagtgcgtcggctgcaatctctgcgtcaatgtctgccccgtggagaactgcatcaccatggtgccgctggcagccggcgagatggaccggcggaccgggcaggtcgttcccggcgattacgccaactggaccacacacccgaacaatccaatggcgaaggtggcggcggaataa

SEQ ID NO: 7912 - protein, 437 aa, Mesorhizobium sp. BNC1
MADIRSNFLGIKSPNPFWLASAPPTDKAYNVERAFKAGWGGVVWKTLGEEGPPVVNVNGPRYGAIWGADRRLLGFNNIELITDRDLYLNLTEIKQVKRNWPDRALIVSLMVPCEEEAWKAILPLVEETEADGIELNFGCPHGMSERGMGSAVGQVPEYVEMVVRWCKQHTRMPVITKLTPNITDIRKPARAAHAGGTDAVSLINTINSITAVDLDSFAPEPTIDSKGTHGGYCGPAVKPIALNMVAEIARDPETRGLPISGIGGITTWRDAAEFLALGAGTVQVCTAAMTYGFKIVEEMVEGLKNWMDEKGHATLDDIIGRAVPNVTDWQYLNLNYITKARIDQDLCIKCGRCHIACEDTSHQAITSVVNGVRYFEVKEEECVGCNLCVNVCPVENCITMVPLAAGEMDRRTGQVVPGDYANWTTHPNNPMAKVAAE

SEQ ID NO: 7913 - DNA, 900 bp, Clostridium perfringens ATCC 13124
  CDS (1)..(900): transl_table=11
atgttaaaaacagttataaatggagtagattttaaaaaccctgttatagcagcatcaggtactttcggctttggagctgagtataatagcttctatgatgtgggagaattaggaggaataagttcaaaaggactaactcttaatagtagagaaggtaatgaaggaataagaatatatgaaactcctcaaggaataatgaattcagtaggacttcaaaatccaggaatagagaaatttatagaagtagaacttcctaaaatgttagaactaggaacaaatataatagcaaatgtagggggagctactatagaagattatgaaaaagcagtatctcttttaaataaagaaaagatagacatgatagagttaaatatatcttgtcctaatgtaaaatctggtggaatggcctttggaatacaatcagatgtagcatatgaagtggtttctaaggttagaaaaatatgtgataaacctttaatggtaaaattatcaccaaatgctgaaaatatatgcaatatggcatatagatgtgcagaggcaggagcagattcaatctctttaataaatacattaaaaggaatggcaatagatataaaaaatagaaagccagtatttaacaatgtgtatgcaggactttctggccccgctgtaaaacctatagcccttagaatggttcatgaagttgctaaaactgtagatattccagtaataggattaggaggaatttctacagcagaggatgccatagaatttatgatggcaggagcatcagctatacaaataggtacaataaactttgtaaatcctaaagcaggtatagaaataataaaaggattagaagacttttgcaaaaaagaaggattaaaaaatattaatgaaattgtaggatgcataaagtaa

SEQ ID NO: 7914 - protein, 299 aa, Clostridium perfringens ATCC 13124
MLKTVINGVDFKNPVIAASGTFGFGAEYNSFYDVGELGGISSKGLTLNSREGNEGIRIYETPQGIMNSVGLQNPGIEKFIEVELPKMLELGTNIIANVGGATIEDYEKAVSLLNKEKIDMIELNISCPNVKSGGMAFGIQSDVAYEVVSKVRKICDKPLMVKLSPNAENICNMAYRCAEAGADSISLINTLKGMAIDIKNRKPVFNNVYAGLSGPAVKPIALRMVHEVAKTVDIPVIGLGGISTAEDAIEFMMAGASAIQIGTINFVNPKAGIEIIKGLEDFCKKEGLKNINEIVGCIK

SEQ ID NO: 7915 - DNA, 1314 bp, Rhizobium leguminosarum bv. viciae 3841
  CDS (1)..(1314): transl_table=11
atggctgatctccgtaataatttcgtcggcatcaaatccccgaacccgttctggctggcgtctgcgccgccgaccgacaaggcctacaatgtcgagcgcgccttcaaggccggctggggcggcgtggtctggaagacgctgggcgaggaaggcccgcccgtcgtcaacgtcaacggcccgcgctacggcgcgatctggggcgccgaccgccgcctgctcggtctgaacaatatcgagctcatcaccgaccgcgacctctataccaacctgcgggaaatgaagcaggtgaagatgaactggccggaccgggcactgatcgcctcgatcatggttccctgcgaggaagaggcctggaaggctatcctgcccttggtcgaagagaccggcgccgacggcatcgaactcaatttcggctgtccgcacggcatgtccgagcgcggcatgggttccgcggtcggccaggtgcctgagtatatcgagatggtcgtgcgctggtgcaagcagtacacccgcatgcccgtcatcaccaagctgacgcccaacatcaccgatgtccgccgtcccgcccgcgccgccaaggccggcggcaccgatgccgtctcgctgatcaacacgatcaattcgatcgtctccgtcgatctcgacaacttcgcccccaacccgacggtcggcggcaagggcagccatggcggttattgcggcccggcggtgaagccgatcgcactcaacatggtggccgagatcgcccgcgatcccgaaacctacggcctgccgatctcgggtatcggcggcatcaccacctggcgcgacgctgccgaattccttgtccttggcgccggcaacgtccaggtctgcacagcggcgatgacctacggcttcaagatcgtccaggagatgatcactggcctctcagactggatggacgaaaagggccatcgcagcctcgaagatatcaccggccgcgccgtccccaacgttaccgactggcaatatctgaacctcaactacatcgccaaggcaaagatcgatcaggacgcctgcatcaaatgcggccgctgctacattgcctgcgaggacacctcgcaccaggcgatcaccaacttcgtcgacggcgttcgccatttcgaggtgatggacgaggaatgcgtcggctgcaatctctgcgtcagcgtctgcccggtcgagaactgcatcaccatggagcagcttcccgccggcgccctcgacaaacgcaccggccgcgtcgtcgacccgaactacgccaattggacgacgcacccgaacaacccgatggcgcgccaggcggcggagtaa

SEQ ID NO: 7916 - protein, 437 aa, Rhizobium leguminosarum bv. viciae 3841
MADLRNNFVGIKSPNPFWLASAPPTDKAYNVERAFKAGWGGVVWKTLGEEGPPVVNVNGPRYGAIWGADRRLLGLNNIELITDRDLYTNLREMKQVKMNWPDRALIASIMVPCEEEAWKAILPLVEETGADGIELNFGCPHGMSERGMGSAVGQVPEYIEMVVRWCKQYTRMPVITKLTPNITDVRRPARAAKAGGTDAVSLINTINSIVSVDLDNFAPNPTVGGKGSHGGYCGPAVKPIALNMVAEIARDPETYGLPISGIGGITTWRDAAEFLVLGAGNVQVCTAAMTYGFKIVQEMITGLSDWMDEKGHRSLEDITGRAVPNVTDWQYLNLNYIAKAKIDQDACIKCGRCYIACEDTSHQAITNFVDGVRHFEVMDEECVGCNLCVSVCPVENCITMEQLPAGALDKRTGRVVDPNYANWTTHPNNPMARQAAE

SEQ ID NO: 7917 - DNA, 939 bp, Oenococcus oeni PSU-1
  CDS (1)..(939): transl_table=11
atggactatacgacaaaaattgctaatcaggtttttcatcatttatttattaacgcagctggtgtatactgccaaacatttgaagagctggaacaaattcaaaatgctccctgtgctggggcagtcattaccaaatctgcaactgcaaaagagaggtcgggtaattctgagccccgctattttgaaaattctgtcgaacacaacacaataaattcgatgggtttgcctaatcttggaattgattattatttgaattatgttttaaaacacagtttgaaattgccgacgcttttctcgattgtcggtctttgtcaaaaagaaatcatcgataatttaaaaaaattacaagccagcgatttttccggcctgaccgaattaaatttgtcttatcccaacgtttccggaaagccgcaaattgcttatgattttgctgctacaagagaaattttagacaacgtttttgctttttattcaaagccgcttggcgttaaacttccaccctatttcgatattgcacattttgatcaaattgccgctatcttgaatgattatcccttggcttacgttaatgcgattaattcggttggtaatggacttgtaattgatccagaaacagatacggttatgattaaacccaaagatggttttggcggattaggtgggaaacaaatcaaagctactgctttggcaaatgttagggctttgcgccaacgcctccatccacagattaaaattatcgctaccggtggagtaactaatggtagaaacgtttatgatcatcttttatgcggagccgacctggtttcggttggttctcaattaggaatcgaaggaccgacggtattcgctcgattggaaaaggaacttgaagaaatttttgctgataaaggaattactgatttaagacaagtcaggggtaaactgaaattaattgcataa

SEQ ID NO: 7918 - protein, 312 aa, Oenococcus oeni PSU-1
MDYTTKIANQVFHHLFINAAGVYCQTFEELEQIQNAPCAGAVITKSATAKERSGNSEPRYFENSVEHNTINSMGLPNLGIDYYLNYVLKHSLKLPTLFSIVGLCQKEIIDNLKKLQASDFSGLTELNLSYPNVSGKPQIAYDFAATREILDNVFAFYSKPLGVKLPPYFDIAHFDQIAAILNDYPLAYVNAINSVGNGLVIDPETDTVMIKPKDGFGGLGGKQIKATALANVRALRQRLHPQIKIIATGGVTNGRNVYDHLLCGADLVSVGSQLGIEGPTVFARLEKELEEIFADKGITDLRQVRGKLKLIA

SEQ ID NO: 7919 - DNA, 939 bp, Leuconostoc mesenteroides subsp. mesenteroides ATCC 8293
  CDS (1)..(939): transl_table=11
atgaatttaactgctaacatcgctggtttcaacttcgaccatattttactcaacgctgcaggtgttgtgtgccagactagcgacgaattagatagtgttctagcatctgactatacgggcgcagttgttacgaaatcagcaactccaagccttcgcccgggtaacgtctcacctcgatatcatgaattgaccaatggcttaggcacgattaattcaatgggcttaccaaatgaaggctttgactattacatggattatgttacccaaaaacaaacagacaagccgatctttttctcagttgctggtttatcaaagcaagagaacttagatatgttgcacaagatagaagaatcagaattcaatggtcttgttgaattaaatctatcttgtcctaatgtgcccggcaagcctcaaacagcttatgattccgaaacaactgaagaaattttaactgaagtattttcatttttcaccaagcctcttggcgttaagttaccaccctactttgatattgtgcattttgacaatattgcaaacattttaaataaatttccattagcctttgtcaatgctatcaactcaattggtaatggccttgtgattgatgaagaaactgacacagttgtgattaaaccgaaaggtggttttggtggtgtcggtggtcccattgtcaaagcaacagcgctagctaatgttagagcactacgtcagcggttaaacccaagtattaaaatggttggaactggtggtgttacttctggacgtgatgtttatgaacacgttttgtgtggcgctgacttagttgaagttggttcacaattagcaatcgaaggaacatctgtttttgaacgtttggaaaaagagttagcagctattttaacagaaaaaggctataattctcttgatgaagtccgtgggcagttgaaaataattgagtaa

SEQ ID NO: 7920 - protein, 312 aa, Leuconostoc mesenteroides subsp. mesenteroides ATCC 8293
MNLTANIAGFNFDHILLNAAGVVCQTSDELDSVLASDYTGAVVTKSATPSLRPGNVSPRYHELTNGLGTINSMGLPNEGFDYYMDYVTQKQTDKPIFFSVAGLSKQENLDMLHKIEESEFNGLVELNLSCPNVPGKPQTAYDSETTEEILTEVFSFFTKPLGVKLPPYFDIVHFDNIANILNKFPLAFVNAINSIGNGLVIDEETDTVVIKPKGGFGGVGGPIVKATALANVRALRQRLNPSIKMVGTGGVTSGRDVYEHVLCGADLVEVGSQLAIEGTSVFERLEKELAAILTEKGYNSLDEVRGQLKIIE

SEQ ID NO: 7921 - DNA, 915 bp, Solibacter usitatus Ellin6076
  CDS (1)..(915): transl_table=11
atgacgccgcaactggccaccaccatctgcggaatcgctctcaagaatccggtgttggccgccagcggcacgttcgcgtacggtgtggaattcgaaaagctcgttgatctcaacgcgctcgggggcttcgtggtcaagggcctgtcgcgcgagccgatcgaaggcaatccgccgccgcgcgtctttgagagcgaggccggcatgatcaactccgtcggcctgcagaacattggtgtgcgtgctttcgtcgccgagaaacttccggcgctcgccggcctgcgcaccgctgttttcgccaacgtctttggctactgcacagaggattacgtcgaagtcgtacgcgtcctcaacgatcatgcggggctcgccggatacgagctcaacgtatcctgccccaacacggcgcacggcggcatctacttctcgaacgatcccgtgctgctggccgaggtcgtcaccgcggccaagcgggtggctacccgccctctgatcgtcaagctctcccccaacgtgtccgccatcgagccgctcgcccgtgtagccgaggagagcggtgccgatgccctctcgctggtgaacaccgtgatcagcctggccatcgacgcgcgcacccgccggccgcgcatcggcgccggtttcggaggactctccgggccggcaatcaagcccatcgcgctccgcttcgtctatcaggcggcgcgcgcggtgcgcattccggtaatcggactcggcggcatcgcgactggcgaagatgccgccgaattcctgatcgccggtgcgagcgccgtcgaagtcggcaccgccacgttctgggatccccgcgccccccttcgcatcgccgaagaactcgggaaattcctcgaacgcgaaggcatccggaaggctaccgacttggtgggcacgctgaagttttag

SEQ ID NO: 7922 - protein, 304 aa, Solibacter usitatus Ellin6076
MTPQLATTICGIALKNPVLAASGTFAYGVEFEKLVDLNALGGFVVKGLSREPIEGNPPPRVFESEAGMINSVGLQNIGVRAFVAEKLPALAGLRTAVFANVFGYCTEDYVEVVRVLNDHAGLAGYELNVSCPNTAHGGIYFSNDPVLLAEVVTAAKRVATRPLIVKLSPNVSAIEPLARVAEESGADALSLVNTVISLAIDARTRRPRIGAGFGGLSGPAIKPIALRFVYQAARAVRIPVIGLGGIATGEDAAEFLIAGASAVEVGTATFWDPRAPLRIAEELGKFLEREGIRKATDLVGTLKF

SEQ ID NO: 7923 - DNA, 939 bp, Magnetococcus sp. MC-1
  CDS (1)..(939): transl_table=11
gtgaccagccagagccccatcgctgttgaagttgccggtattgccatgcgtacccccctggtgctgctctcgggctgcgttgcctttggcgaggagctgctcaccctggaagggtttgactttaaggccatcggtgccatctgcctaaagggcaccactttagagcccaaacggggcaaccccccgcaccgactggccgaaaccccttgtggcatgctcaacgcgatcggcctgcaaaaccccggcgcccgcgccgtggtggatgagattttaccccgcctctgcgcgcagatcgacaccccattgatcgccaacatctctggctccaccaccgagcagtatggcgaaatagcgcgtatctttgatcaaagcccggtggccgccatcgaaattaatatctcctgccccaatgtcaaagagggcggtattgcctttggttctgatcctgatatggccgccgccgtggtggaagaggtgcgccgagccaccaccaaacccatcatcaccaagctctcccccaacgtcaccgacattaccacagtggccaaacgggccattgaggccggtagtgatgcgctgtcggtcatcaacaccctgatgggtatggccatcgacctcaaaaagcgccgtcccgtgctaggcaacctacaagggggactctctggccctgcggttaagccggtggccctgctcaaggtgtggcagacctatcaactggcccgtcagcaccagatccccatcatcggccaagggggtatcgcctcggctgacgatgtgcttgaattttttctggtcggggcctccgccaccggcctctgcaccagcctgtttaaagatcccctgctccccatgcgcatcgcccaagccctgcaccagggtgttgccgaacagggggtcacaaacattgcccagctcacaggcacccttaaaaccgcatga

SEQ ID NO: 7924 - protein, 312 aa, Magnetococcus sp. MC-1
MTSQSPIAVEVAGIAMRTPLVLLSGCVAFGEELLTLEGFDFKAIGAICLKGTTLEPKRGNPPHRLAETPCGMLNAIGLQNPGARAVVDEILPRLCAQIDTPLIANISGSTTEQYGEIARIFDQSPVAAIEINISCPNVKEGGIAFGSDPDMAAAVVEEVRRATTKPIITKLSPNVTDITTVAKRAIEAGSDALSVINTLMGMAIDLKKRRPVLGNLQGGLSGPAVKPVALLKVWQTYQLARQHQIPIIGQGGIASADDVLEFFLVGASATGLCTSLFKDPLLPMRIAQALHQGVAEQGVTNIAQLTGTLKTA

SEQ ID NO: 7925 - DNA, 987 bp, Bifidobacterium longum DJO10A
  CDS (1)..(987): transl_table=11
atgggggaagtgacgatgagcgcaaacaaccagtccgcgcagggcggcgacaaccacatcaacctgtacgagccccacgtgtggaagcaccacaccaaggtggccggtctggaatggaagaatccggtcggcaccgcctccggcaccttccagtacgccgccgtccgctggttctacgacgtcagccagctcggcgccgtatgcaccaagggcgcctcgcccgtaccgtgggaaggcaatccctcgccgcgcaccgccgaatcgccggccgcgaacatcaacgccgtgggcctgcagaatcccggcatcgaccattacttggccgaggacctgcccaagctcaaggccgcgggcgcgttcgtcatctccaatgtcgccggacattgcgatgacgattacgcggcggtcgtggaaaagctcgccgactccgacgcggacatgctggaaatcaacgtcagctgcccgaacgtttccgccggcggcatgagcgtgggcaccgacccggtggccctcgccaatcttatggaccggctgcgcccgatgaccgacaagccgatgatcgtcaaactcacgccgaacgtcaccgacatcaccgtgccggcgcgcgcggccgtggaacatggcgccgacgcgttgagcatgatcaacacgctcaaaggcatgcgcattaacattcgcaccggcaagccgatcatcgccaacgtcaccggcggcgtatccggcccggccgtgctgccggtcggcctggcagccgtctatcgggtgcgcaccgcactgccggagattccgatcatcggcctcggcggcatcgacagcggcgagaaggcgctcgaatacctgtacgccggcgcgaacgccgtcgaagtgggtgcggccgcgctcttcgacccggtggccccgctgcgcgtcgcccgcgaactcgacgacctgttggacagccgtcccgaactcgctgctaaactggccgcaggacagacttggaggtaa

SEQ ID NO: 7926 - protein, 328 aa, Bifidobacterium longum DJO10A
MGEVTMSANNQSAQGGDNHINLYEPHVWKHHTKVAGLEWKNPVGTASGTFQYAAVRWFYDVSQLGAVCTKGASPVPWEGNPSPRTAESPAANINAVGLQNPGIDHYLAEDLPKLKAAGAFVISNVAGHCDDDYAAVVEKLADSDADMLEINVSCPNVSAGGMSVGTDPVALANLMDRLRPMTDKPMIVKLTPNVTDITVPARAAVEHGADALSMINTLKGMRINIRTGKPIIANVTGGVSGPAVLPVGLAAVYRVRTALPEIPIIGLGGIDSGEKALEYLYAGANAVEVGAAALFDPVAPLRVARELDDLLDSRPELAAKLAAGQTWR

SEQ ID NO: 7927 - DNA, 975 bp, Prosthecochloris aestuarii DSM 271
  CDS (1)..(975): transl_table=11
gtgcttcaccgaaacacaacactccggaattttaccgctccacgtatgacacaggaatcacgacacaccgcagtcgctctgggaagagggctcgaactgcgttcaccggtccttctcgcctcgggaacagtctcctacggcgaagaactctcgaaactcaccgacctcagccgcatcggaggccttgtcaccaaagcaatctctcccgaaccgcgtatcggcaacaggccccagcgaatcgctgaaaccccctgcggcatggtcaacgccatcggactggccaatgttggcctcgaacgctttgtagcagaaaaactccctttcctgcaaaacctcgatacagcagtcatcgtcaacgtggccggaaaatccatcgacgattacgttcaggttgtgcagcgtattgatgaatacgacggcatcgatggctacgaaatcaacctctcctgcccgaacgtcaagggagaatgcatgatcatgggcgtcagcagcacagcaaccttcgaaatcatctcgaagctgcgttcgatcaccaatcgccacctcatggtcaaactcaccccgaacgtcacctctatcagcgccatcgcgctggccgccgaagaagcaggcgcagactccgtctccctgatcaacacactggtcggaatggctgtggaccacaaaacaagaaaaccactcctcaccaacatcacgggaggcctgtccggccccgccatcaagcccgttgctcttgccaaagtctgggaagtctataacgccgtcaacatccctatcgtcggcatgggaggcatttccaacgtcgaagacgccatggaattcctcgtcaccggcgccagagcgatccagatcggcaccatgaacttcgtctaccccgacattggccaaaccatcgccgacaagctcgaagagtacttctcaagcccggaacagatgacactggaagagtatagcggaagcttgattgtggcgtaa

SEQ ID NO: 7928 - protein, 324 aa, Prosthecochloris aestuarii DSM 271
MLHRNTTLRNFTAPRMTQESRHTAVALGRGLELRSPVLLASGTVSYGEELSKLTDLSRIGGLVTKAISPEPRIGNRPQRIAETPCGMVNAIGLANVGLERFVAEKLPFLQNLDTAVIVNVAGKSIDDYVQVVQRIDEYDGIDGYEINLSCPNVKGECMIMGVSSTATFEIISKLRSITNRHLMVKLTPNVTSISAIALAAEEAGADSVSLINTLVGMAVDHKTRKPLLTNITGGLSGPAIKPVALAKVWEVYNAVNIPIVGMGGISNVEDAMEFLVTGARAIQIGTMNFVYPDIGQTIADKLEEYFSSPEQMTLEEYSGSLIVA

SEQ ID NO: 7929 - DNA, 1056 bp, Xylella fastidiosa Dixon
  CDS (1)..(1056): transl_table=11
atgtattcccttttccgtcccctcctgttcacctgcgacacagagcgtgcccatgacatcagcctgcgcaccttagatatcgcctaccacagtggagcattacctctactgacacgtcacacacgaccgttacccaccacagccttcggtctgaactttcccaaccctgttggcttagccgccggactggacaaaaacgggactcacattgacgctctattcgccttaggctttggctttattgaaatcggtaccaccaccccacgtccacaagcggggaatcccaagcctcgccttttccgcctgacgcaacaacaagcagtgattaaccgcatggggtttaacaacctaggtgtagatgcgctggtacgtaacgttgcaggcgcgcggcgacgcaacggcccgcttgggatcaacattggcaagaacaaagacacccctaacgaacaggccagtaacgactatcggtattgtctggaacgggtctatgcactggcagactatgtcactatcaatctctcctcaccaaatactgctggtctacgagcgctgcaagaggaacagacattgcgtcgcttgatcggagaattacgtgaaacacaagaaacgctggcagcgaaacacggccggcacgtaccgatgctcatcaagatggcaccagatctcagtgacagcgacattgatgcagcagcacgtgtactcaacgagatgagcgtagacggagtgatcgccaccaataccaccgtgacgcgcccgctcctaagacaacatccgctggcaagcgaagcgggggggctgtccggtgcacccctactgggacagtccaccttggtgctacgtcggctacgtacccacttacctgaaactattgatctcatcggcgtgggcggcatctgttgcggtgccgatgccggcgccaaaatggctgccggtgccagcctagtacagtgctacaccggattgatattcaaaggcccacagttggttggagaatgcgtggaagccattcgccgccgcctcgaagcctccagtagcggaagggaaaacactcaatga

SEQ ID NO: 7930 - protein, 351 aa, Xylella fastidiosa Dixon
MYSLFRPLLFTCDTERAHDISLRTLDIAYHSGALPLLTRHTRPLPTTAFGLNFPNPVGLAAGLDKNGTHIDALFALGFGFIEIGTTTPRPQAGNPKPRLFRLTQQQAVINRMGFNNLGVDALVRNVAGARRRNGPLGINIGKNKDTPNEQASNDYRYCLERVYALADYVTINLSSPNTAGLRALQEEQTLRRLIGELRETQETLAAKHGRHVPMLIKMAPDLSDSDIDAAARVLNEMSVDGVIATNTTVTRPLLRQHPLASEAGGLSGAPLLGQSTLVLRRLRTHLPETIDLIGVGGICCGADAGAKMAAGASLVQCYTGLIFKGPQLVGECVEAIRRRLEASSSGRENTQ

SEQ ID NO: 7931 - DNA, 1056 bp, Xylella fastidiosa Ann-1
  CDS (1)..(1056): transl_table=11
atgtattcccttttccgtcccctcctgttcacctgcgacacagagcgtgcccatgacatcagcctgcgcaccttagatatcgcctaccacagtggagcattacctctactgacacgtcacacacgaccgttacccaccacagccttcggtctgaactttcccaaccctgttggcttagccgccggactggacaaaaacgggactcacattgacgctctattcgccttaggctttggctttattgaaatcggtaccaccaccccacgtccacaagcggggaatcccaagcctcgccttttccgcctgacgcaacaacaagcagtgattaaccgcatggggtttaacaacctaggtgtagatgcgctggtacgtaacgttgcaggcgcgcggcgacgcaacggcccgcttgggatcaacattggcaagaacaaagacacccctaacgaacaggccagtaacgactatcggtattgtctggaacgggtctatgcactggcagactatgtcactatcaatctctcctcaccaaatactgctggtctacgagcgctgcaagaggaacagacattgcgtcgcttgatcggagaattacgtgaaacacaagaaacgctggcagcgaaacacggccggcacgtacccatgctcatcaagatggcaccagatctcagtgacagcgacattgatgcagcagcacgtgtactcaacgagatgagcgtagacggagtgatcgccaccaataccaccgtgacgcgcccgcttctaagacaacatccgctggcaagcgaagcgggggggctgtccggtgcacccctcctgggacagtccaccttggtgctacgtcggctacgtacccacttacctgaaactattgatctcatcggcgtgggcggcatctgttgcggtgccgatgccggcgccaaaatggctgctggtgccagcctagtacagtgctacaccggattgatattcaaaggcccacagttgattggagaatgcgtggaagccattcgccgccgcctcgaagcctccagtagcggaagggaaaacactcaatga

SEQ ID NO: 7932 - protein, 351 aa, Xylella fastidiosa Ann-1
MYSLFRPLLFTCDTERAHDISLRTLDIAYHSGALPLLTRHTRPLPTTAFGLNFPNPVGLAAGLDKNGTHIDALFALGFGFIEIGTTTPRPQAGNPKPRLFRLTQQQAVINRMGFNNLGVDALVRNVAGARRRNGPLGINIGKNKDTPNEQASNDYRYCLERVYALADYVTINLSSPNTAGLRALQEEQTLRRLIGELRETQETLAAKHGRHVPMLIKMAPDLSDSDIDAAARVLNEMSVDGVIATNTTVTRPLLRQHPLASEAGGLSGAPLLGQSTLVLRRLRTHLPETIDLIGVGGICCGADAGAKMAAGASLVQCYTGLIFKGPQLIGECVEAIRRRLEASSSGRENTQ

SEQ ID NO: 7933 - DNA, 1305 bp, Roseovarius nubinhibens ISM
  CDS (1)..(1305): transl_table=11
atggctgatctcacatccaatttcatcggcatcaaatcccccaacccgttctggctcgcctcggcgccgccaacggacaaggaatacaacgtgcggcgcgccttcgaggccggctggggcggcgtcgtgtggaaaaccctgggcgaggcaggcccaccggtggtcaatgtcaacggaccgcgctacggcgcgatctggggcgccgaccgccgcctgctcggcctcaacaatatcgagctgatcaccgaccgcccgctcgaggtcaatctcgaggaaatgacccgcgtcaagaaggactatcccgaccgcgcgctcatcgcctcgctgatggtgccggtgaacgaagaaagctggaagcgcattctcgaggcggtggccgggaccggctgtgacggggtcgagctcaactttggttgcccccatgggatgagcgaacgcggcatgggcagcgccgtgggccaggtgccggaatatgtcggacaggtcgcggaatggtgcaagacctataccgatctgccggtgatcgtgaaactcacgcccaatatcaccgacattcgcaaaccggcacaggcggcgaaacagagcggcgccgatgcggtgagcctgatcaacacgatcaactcgatcacctcggtcaatctcgacagtttctcgcccgaaccctcggtcgacggtcttggcgcccatggcggctattgcggcccggcagtcaagcccatcgcgctcaacatggtggccgagattgcccgcgatccggccaccgcaggcctgcccatctcgggcatcggcggcgtgaccacatggcgggacgcggccgagttcatggcgctcggtgcgggcaatgtgcaggtctgtaccgccgcgatgacctatgggttcaaggtggtgcaggagatgatcagcggcctcagccaatatatggatgagaaaggctttgcctcggtggacgagctggtcggccgcgccgtgccgcaggtggtcaactggcaggatctcaacctcaactacatcgccaaggcccgcatcgatcaggacgcctgcatcaaatgcggccgctgctatgctgcctgcgaggacacttcgcatcaggcgatctcgatgtcgcccgaccgggtctttgaggtgaaggatgacgaatgcgtcgcctgcaatctctgcgtcaatgtctgcccggtcgagggctgcatcacgatggagcagatggcccccggcaccgtcgatccgcgtaccggcaaggtggtggaaaaggactatgccaactggacgacccatcccaacaaccccggcagctgcgccgcagaataa

SEQ ID NO: 7934 - protein, 434 aa, Roseovarius nubinhibens ISM
MADLTSNFIGIKSPNPFWLASAPPTDKEYNVRRAFEAGWGGVVWKTLGEAGPPVVNVNGPRYGAIWGADRRLLGLNNIELITDRPLEVNLEEMTRVKKDYPDRALIASLMVPVNEESWKRILEAVAGTGCDGVELNFGCPHGMSERGMGSAVGQVPEYVGQVAEWCKTYTDLPVIVKLTPNITDIRKPAQAAKQSGADAVSLINTINSITSVNLDSFSPEPSVDGLGAHGGYCGPAVKPIALNMVAEIARDPATAGLPISGIGGVTTWRDAAEFMALGAGNVQVCTAAMTYGFKVVQEMISGLSQYMDEKGFASVDELVGRAVPQVVNWQDLNLNYIAKARIDQDACIKCGRCYAACEDTSHQAISMSPDRVFEVKDDECVACNLCVNVCPVEGCITMEQMAPGTVDPRTGKVVEKDYANWTTHPNNPGSCAAE

SEQ ID NO: 7935 - DNA, 1305 bp, Oceanicola batsensis HTCC2597
  CDS (1)..(1305): transl_table=11
atggccgacctgacgacagacttcctgggcatccgcagccccaacccgttttggctggcctcggccccgccgacggacaaggaatacaacgtccgccgcgccttcgacgcgggctggggcggcgtggtgtggaagacgctcggagaggaaggccctccggtcgtcaacgtgaacggtccgcgctatggcgcgatctggggggcggaccggcggctgctggggctcaacaacatcgagttgatcaccgacaggccgctgcagaccaacctcgacgagatgacgcgcgtcaagaaggactatcccgaccgcgcgctcatcgcctcgatcatggtgccctgcgacgaggagagctggaaggcgatcctgccgcgcgtggccgagaccggcgccgacgggatcgaactgaacttcggctgtccgcacgggatgagcgaacgcggcatggggtccgccgtggggcaggtgcccgagtacatccagatggtcaccgagtggtgcaagaaatactacgaccgccctgtgatcgtgaagctgacgcccaacatcaccgacatccgcaaaccggccgaggccgcgcgggccgggggcgcggacgcggtgtcgctgatcaacacgatcaactcgatcacccatgtcgacctcgacctgatggcgccggagccgacgatcgacggcaagggcagccatggcgggtactgcggcccggcggtcaagccgatcgccctgtcgatggtctcggaaatcgcgcgcaaccaggccacccacggtctgccgatcagcgggatcggcggcgtgaccacctggcgcgacgcggccgagttcatggtgctgggctgcggcaacgtccaggtctgcacggcggcgatgacctatggcttcaaggtggtgcaggagatgatctcgggcctgtcgcagtggatggacgagaagggctatacctccaccgaccagttcatcggccaggcggttccgaacgtgacggactggcagtacctgaacctcaactacgtgaccaaggcgcggatcgaccaggacctgtgcatcaagtgcggccgctgctatgcggcctgcgaggacacctcgcaccaggccatcggcatgaacgagggccgggtcttcgaggtgatcgacgaggaatgcgtggcctgcaatctctgcgtcaatgtctgcccggtcgaggactgcatcaccatggtgcagatggacaagggcgcggtggatccccggaccggtcgcgaagtcggcgactatgccaactggacgacccatccgaacaaccccggcgcggcgaaggcggcggagtag

SEQ ID NO: 7936 - protein, 434 aa, Oceanicola batsensis HTCC2597
MADLTTDFLGIRSPNPFWLASAPPTDKEYNVRRAFDAGWGGVVWKTLGEEGPPVVNVNGPRYGAIWGADRRLLGLNNIELITDRPLQTNLDEMTRVKKDYPDRALIASIMVPCDEESWKAILPRVAETGADGIELNFGCPHGMSERGMGSAVGQVPEYIQMVTEWCKKYYDRPVIVKLTPNITDIRKPAEAARAGGADAVSLINTINSITHVDLDLMAPEPTIDGKGSHGGYCGPAVKPIALSMVSEIARNQATHGLPISGIGGVTTWRDAAEFMVLGCGNVQVCTAAMTYGFKVVQEMISGLSQWMDEKGYTSTDQFIGQAVPNVTDWQYLNLNYVTKARIDQDLCIKCGRCYAACEDTSHQAIGMNEGRVFEVIDEECVACNLCVNVCPVEDCITMVQMDKGAVDPRTGREVGDYANWTTHPNNPGAAKAAE

SEQ ID NO: 7937 - DNA, 984 bp, delta proteobacterium MLMS-1
  CDS (1)..(984): transl_table=11
atgataaaagacttaccaaggatgaccccgacagccatgaacacaccgccaaaccacggctccagcggccagtcccccgatttaggggtgaagatagccagcctgaccctcgccaatccggtgatgagcgcttccggcacctttggctacgggcgggagtttgccgactacctggccgtggccgacctgggcgcggtagtggtcaagggaatctcactgctgccccgggccggcaaccccccacccagaatcgtcgaaaccccgtgcggcatgcttaacgccatcggcctggaaaatgtcggggtggagaagtttatcagcgacaaactgccctggttgcgccgggcgcaagccaccgtggtggtcaatatccttggtaacagcgtcgaagagtaccgcgaactggcccagaggctggacggggttgccgggcttggcgcccttgaggtcaatatctcctgccccaacgtcaaggaggggggggtggccttcggcaccgatccgcgcatggccgccagggtcacgcaagcggtacgggaggccagcgggctgccattgatcatcaagctatcacctaatgtcagtgacatagccaccatggcccgggcggcggccgagcatggcgccgatgccgtctcgttgatcaacaccctgttgggaatggccatcgatttggagaaccgccgtcccaagctgaccaacgtggtgggtgggctctccgggcccgccatcaaaccggtggccctgcgcatggtctggcaggtcgccggcagtgtcaagataccggtgatcgggattggcggcatcatgaacgccaccgacgctttggaatttatcgtggccggggccagcgcgatccaggtgggcaccgccaacctgatcaggccacgggccaccgccgaaatcatcaacggcattcaagattacctgacaagccggcaaatgggcagtatagaagaactgcggggctccctgcagctttaa

SEQ ID NO: 7938 - protein, 327 aa, delta proteobacterium MLMS-1
MIKDLPRMTPTAMNTPPNHGSSGQSPDLGVKIASLTLANPVMSASGTFGYGREFADYLAVADLGAVVVKGISLLPRAGNPPPRIVETPCGMLNAIGLENVGVEKFISDKLPWLRRAQATVVVNILGNSVEEYRELAQRLDGVAGLGALEVNISCPNVKEGGVAFGTDPRMAARVTQAVREASGLPLIIKLSPNVSDIATMARAAAEHGADAVSLINTLLGMAIDLENRRPKLTNVVGGLSGPAIKPVALRMVWQVAGSVKIPVIGIGGIMNATDALEFIVAGASAIQVGTANLIRPRATAEIINGIQDYLTSRQMGSIEELRGSLQL

SEQ ID NO: 7939 - DNA, 984 bp, delta proteobacterium MLMS-1
  CDS (1)..(984): transl_table=11
atgataaaagacttaccaaggatgaccccgacagccatgaacacaccgccaaaccacggctccaccgcccagtcccccgatttaggggtgaaaatagccagcctgaccctcgccaatccggtgatgagcgcttccggtacctttggctacgggcgggagtttgccgactacctggccgtggccgacctgggcgcggtggtggtcaaggggatctcactgctgccccgggccggcaaccccccacccagaatcgtggaaaccccgtgcggtatgcttaacgccatcggcctggaaaatgtcggggtggagaagtttatcagcgacaagctgccctggttgcgccaggcgcaagccaccgtggtggtcaatatccttggtaacagcgtcgaagagtaccgcgaactggcccagaggctggacggggttgccgggattggcgccatcgaggtcaatatctcctgccccaacgtcaaggagggaggcgtggccttcggcaccgatccgcgcatggccgccagggtcacgcaagcggtacgggaggccagcgggctgccattgatcatcaagctatcacctaatgtcagcgacatagccaccatggcccgggcggcggccgagcatggcgccgatgccgtctccttgatcaacaccctgttgggaatggccatcgatttggagagccgccgtcccaagctggccaacgtggtgggtgggctctccgggcccgccattaaaccggtggccttgcgcatggtctggcaggccgccggcagtgtcaagataccggtgatcgggattggcggcatcatgaacgccaccgacgctctggaatttatcgtggccggggccagcgcgatccaggtgggcaccgccaacctgatcaggccacgggccaccgccgaaatcatcaacggcattcaagattacctgacaagccggcaaatgggcagtatagaagaactgcggggctccctgcagctttaa

SEQ ID NO: 7940 - protein, 327 aa, delta proteobacterium MLMS-1
MIKDLPRMTPTAMNTPPNHGSTAQSPDLGVKIASLTLANPVMSASGTFGYGREFADYLAVADLGAVVVKGISLLPRAGNPPPRIVETPCGMLNAIGLENVGVEKFISDKLPWLRQAQATVVVNILGNSVEEYRELAQRLDGVAGIGAIEVNISCPNVKEGGVAFGTDPRMAARVTQAVREASGLPLIIKLSPNVSDIATMARAAAEHGADAVSLINTLLGMAIDLESRRPKLANVVGGLSGPAIKPVALRMVWQAAGSVKIPVIGIGGIMNATDALEFIVAGASAIQVGTANLIRPRATAEIINGIQDYLTSRQMGSIEELRGSLQL

SEQ ID NO: 7941 - DNA, 936 bp, Pseudomonas putida GB-1
  CDS (1)..(936): transl_table=11
atgatcgatctcagcgtacaagtgggcggactgcgcctgaaaaacccggtaatgccagcctcgggtaccttcgcagaggagctgatccacctgctggatttcaaccagcttggcgccttggtcaccaagaccatcacttcggataagcgaaccggaaacccgatgccacgcgtttgtgagctggcggacgggatgatgaacgcgatcggtatcccaagtaagggtgcagatctgttcatcgacaaggtcgttcccttctaccggaatttcgattcaccgctgatcgtgagcatctcggcgccaacggctcaaggcttcgccgagctggctgcccggctgagtgacgtgccgggtgtggcgggtatcgaagccaacatttcctgccccaacctggaagcccacggccagtcgtttggcatgcaggccgaaagtacacgtaatgttgtcgcactgatgcggcaggccacctccctccccctgtgggtcaaactgacccctaatgctggtgaagtcgtaccggttgccctggctgcgcaagactccggtgctgatgccgtagtggtcggtaacacgctgctcgggctctccatcgacatcgagcgtggtcgtgcaaggctcgggaatttcatgggtggtatctcaggtgccgctattcgaccgctgatggtgcgtctgacctatcagtgcgcccaggctctggaaatcccaatcattggttgcggtggtatttccacggccgatgatgccctggagttcatctatgccggtgcatcggctgttcaggtgggtacggccaccttccttcaccccaagaccatgaacacgatggtgggtgagttggcggccttctgtgagcgtaaaggtgtttcttctattagttcgctgatcggggctctggatgactcgcctgcagaacccttcggagccctgccatga

SEQ ID NO: 7942 - protein, 311 aa, Pseudomonas putida GB-1
MIDLSVQVGGLRLKNPVMPASGTFAEELIHLLDFNQLGALVTKTITSDKRTGNPMPRVCELADGMMNAIGIPSKGADLFIDKVVPFYRNFDSPLIVSISAPTAQGFAELAARLSDVPGVAGIEANISCPNLEAHGQSFGMQAESTRNVVALMRQATSLPLWVKLTPNAGEVVPVALAAQDSGADAVVVGNTLLGLSIDIERGRARLGNFMGGISGAAIRPLMVRLTYQCAQALEIPIIGCGGISTADDALEFIYAGASAVQVGTATFLHPKTMNTMVGELAAFCERKGVSSISSLIGALDDSPAEPFGALP

SEQ ID NO: 7943 - DNA, 1023 bp, Pseudomonas pseudoalcaligenes
  CDS (1)..(1023): transl_table=11
atgtactccctggcccgcgagctgctgttcaaactttccccggaaacctctcacgagctgtccatcgatctgatcggtgcaggtggccggctgcgtctcaatggtctgttgaccaaggcaccgaccagcctgccggtaaacgtgatgggcttgcagttcgccaatccggtcggcttggccgcggggctggacaagaacggtgatgccatcgatggcttcgctcagctcggtttcggtttcgtcgagatcggcaccgtgactccgcgtccgcagccgggtaaccccaaaccgcggctgttccgtctgccggaggccgaggcggtgatcaaccgcatggggttcaacaaccatggcgtcgatcatctgctggcgcgggtcagggctgcgaagttcaagggggtgctgggcatcaacatcggcaagaacttcgatacaccggtcgaacgtgcggtggatgactacctgacctgcctggacaaggtttacgcccacgcaagctatgtcaccgttaacgtcagctcgccaaataccccggggctgcgcagcctgcagttcggtgactcgctcaaggcgttgctcgaggcgttgcgtcgccgtcaggaggacctgacccaggagcacggcaaacgcgtaccgctggcgattaagatcgcacccgacatgagcgatgaggagaccgcgttggtcgcttctgcgctattgggcgcggatatggatgcggtgatcgccaccaacacaaccctcagccgtgaaggtgtggaggggctggctcatggtgacgaggcgggtggcttgtcgggcgcaccggtgcgtgacaagagcatgcgtatcgtcaaggtactggctggtgagttgtccggccgcctgccgatcattgcggtcggcggtatcaccgagggcaagcacgctgcggagaagatcgctgctggggcgagtctggtacagatctattcggggttcatctacaaggggccggcgctgattcgcgaagcggtggatgctattgccgcgttgcgcaaataa

SEQ ID NO: 7944 - protein, 340 aa, Pseudomonas pseudoalcaligenes
MYSLARELLFKLSPETSHELSIDLIGAGGRLRLNGLLTKAPTSLPVNVMGLQFANPVGLAAGLDKNGDAIDGFAQLGFGFVEIGTVTPRPQPGNPKPRLFRLPEAEAVINRMGFNNHGVDHLLARVRAAKFKGVLGINIGKNFDTPVERAVDDYLTCLDKVYAHASYVTVNVSSPNTPGLRSLQFGDSLKALLEALRRRQEDLTQEHGKRVPLAIKIAPDMSDEETALVASALLGADMDAVIATNTTLSREGVEGLAHGDEAGGLSGAPVRDKSMRIVKVLAGELSGRLPIIAVGGITEGKHAAEKIAAGASLVQIYSGFIYKGPALIREAVDAIAALRK

SEQ ID NO: 7945 - DNA, 1329 bp, Dekkera bruxellensis
  CDS (1)..(1329)
atgtctttcaacagcttccgttcgttgttccagcgttactctggtaaacagttcgcacagttcaccagaaatatgtcacaaactgcaaagaagcatttttcaaagcctgttgctcgtgcaggtttctctggaggtgctttgttagcccttggtattcttggtgtcggagcatactcattggatgcacgttctgcaataaacgagtatgtctggtgccctctcttcagatggtgcactactgctgagcagggacatcatttgggaattgctttgcttaagtacggaatctttccacgtgcttttggtgaccacgatgatccaattcttcgtgttgatctttttggaagaacattggctaatcctatcggtatggctgccggatttgacaagcaggctgaggccatggatgccctttacgatcttggctttggtattgttgaagtgggaactattacccctgagccccagtttggtaacccaaggccacgtttcttcagacttaacgctgatgaaaccgtgatcaacagatacggtttgaactctgatggtagactaactattctttccaggcttagagttcgtctagaaaagtatttgaagaagtctaatgcatgcaagaccaataactcgttcagagagggtaaatctttgtttgttaacattggtaagaacagaaatggtgacactatcgatgattatctagttggtgttgacacctttgctccttatgccgatgcccttgttcttaatgtctcttgcccaagtgctccaggtgttcgtgatctccaggaaaaggatgttcttttggagttgcttacaaaagttcgtgaggagagagataaggttggtgcaaatgtgattgatccagcaagaaaacctcctatcattgtcaaggttgctccagatctatccgaaaaagagattgcagacattgccgatgttgcaaagaaatctaagattgacggtatcctcatgtcaaacactactactgctagaccagcttctttgatcaccaagggacctgttgttcaggagaagggtggattgtctggacgtgcaatgagagatatttccttgaaggctttccgtactttgagaaaatacacaaaggactccgatttggttttgatcggatgtggtggtattttcacaggtaaggatgctattgcattcgccaaagctggtgcaagtgcaatcgagttgtacacttcgtttgcttacagaggaccaggaatcccagacaagatcaaagatgagattgttcaggaattgaaaaaagagggaaaaacctggatggaaattgtcggttcagatgacgagaagaattag

SEQ ID NO: 7946 - protein, 442 aa, Dekkera bruxellensis
MSFNSFRSLFQRYSGKQFAQFTRNMSQTAKKHFSKPVARAGFSGGALLALGILGVGAYSLDARSAINEYVWCPLFRWCTTAEQGHHLGIALLKYGIFPRAFGDHDDPILRVDLFGRTLANPIGMAAGFDKQAEAMDALYDLGFGIVEVGTITPEPQFGNPRPRFFRLNADETVINRYGLNSDGRLTILSRLRVRLEKYLKKSNACKTNNSFREGKSLFVNIGKNRNGDTIDDYLVGVDTFAPYADALVLNVSCPSAPGVRDLQEKDVLLELLTKVREERDKVGANVIDPARKPPIIVKVAPDLSEKEIADIADVAKKSKIDGILMSNTTTARPASLITKGPVVQEKGGLSGRAMRDISLKAFRTLRKYTKDSDLVLIGCGGIFTGKDAIAFAKAGASAIELYTSFAYRGPGIPDKIKDEIVQELKKEGKTWMEIVGSDDEKN

SEQ ID NO: 7947 - DNA, 1137 bp, Phaeosphaeria nodorum
  CDS (1)..(1137)
atgcctccaaatactgcatactcacacttcgcctcacaacactacaagatgaaggccctaactatctcgccgccccttctgaactcctcaaatccatggtgcacctcgctcgcccagcttcaagaactttatgactgtccacacactggagccgtcacgacgcggacatcgctcctcaagggattcccgcacaactcttctgtacatcaattcgccttcttcaaccctcgatccctttcggcgtccgagaccagccaggacaaaggaggcacgtcagaccagagcggcagcttgaatacgctggggtacagtccaacatcgatacgagaatatctagaatacatccgaaccattagcgatggacttaaggacctcaatgatggagagcatcgcaaaccgttcattatttcagtgaccggatcagaagaggatgtagtagagtgctacaagctcataagtgcccaccaaaaacacgttcaaatggcccttgccatggaagtcaatctctcctgcccgaatattgtagggaagccaccaccggcgtattcttcgacttccttgctgtcgtacttgacggctctcaaaggggaaattggcaagcaattaaaaccactacaacaatcgcatccacacgggggacatgttcatgtacccataggcataaagacaccgccatatacgtatcacgatcagttccaggcgatgatcgatgcgctgttggagagtgctaaagctgagccgaagcaccttccgtgccctgtgtcattcattaccgcgacaaacactttaggatcttcgctactactcacacctcaagttccggctgaaggcgatccggctcagtcaactttcgaggccaccatcaaatctgcaaacgaaacaggaatcggtggactagctggcacaccattgcatcctctagctttgggcaacgtctatacgatcagagggatgctgttccaacatgacaccctgtctggtatccaaattatcggggttggcggagtcgaggacgtacacggcttcgatcgaatgcgagcagtcggcgcggcagccgtaggcgtaggaacagcattgggcagaaaaggcgtcgacatcttcgccgaaatagcaaaagggccagagagcaagtcgtag

SEQ ID NO: 7948 - protein, 378 aa, Phaeosphaeria nodorum
MPPNTAYSHFASQHYKMKALTISPPLLNSSNPWCTSLAQLQELYDCPHTGAVTTRTSLLKGFPHNSSVHQFAFFNPRSLSASETSQDKGGTSDQSGSLNTLGYSPTSIREYLEYIRTISDGLKDLNDGEHRKPFIISVTGSEEDVVECYKLISAHQKHVQMALAMEVNLSCPNIVGKPPPAYSSTSLLSYLTALKGEIGKQLKPLQQSHPHGGHVHVPIGIKTPPYTYHDQFQAMIDALLESAKAEPKHLPCPVSFITATNTLGSSLLLTPQVPAEGDPAQSTFEATIKSANETGIGGLAGTPLHPLALGNVYTIRGMLFQHDTLSGIQIIGVGGVEDVHGFDRMRAVGAAAVGVGTALGRKGVDIFAEIAKGPESKS

SEQ ID NO: 7949 - DNA, 921 bp, Candidatus Kuenenia stuttgartiensis
  CDS (1)..(921): transl_table=11
atgacagaggtaacattatcaataaatttgtgtagtatgcgattgtcgaatccaacggtgctggcttcgggaatactgggaaccacaaagacattattaaaacgagtggcagaaagtggagccggtgcggtaacgattaaatccgtaagtaaggattcaagggaaggccatcataatccgacggttattacctacgaggcgggaatgttaaatgccgtaggatattcgaaccctggtgttgaggccgcacgtatcgaatattcgaaccttaatgaaataggcgttcctgtaattgccagtattattggaacctgtacggatgatttcattgaggttgcagaggggctgtcagcatccgggttttccgctatcgaaataccgctttcttgtcctcatactcctggttttggccttctgtccggacagggaactccaaaggctacctacgaaataacctatgcggtgagacgaaaaacaaatgtgcctatatttgtgaaaatatcaccaaacgtgcctgaaatcacctcaattgcaaaagcagcagaggatgcaggggcaaacggcattaccgccgtgaattcaatgggtcctggaatggtaattaatattgaatcaaagaaacctgtgttagggtttaaggtcgggggcgtcaccggggacgccttgcggccgattgccgtacgttgtgtgtatgacgtttaccaggcggtgaaaattccaattatcggagtagggggcatatccacaggaaggcacgcgatagagatgatgatggcaggggcttcggctgttggcattggaaccggcgtttacacaagaggaattaatgttttcagcaaggtgtgcgctgaaatgaagcagtggatgattgaaaacgggtataacactattaatgagcttgtaggtgttgcccatgattga

SEQ ID NO: 7950 - protein, 306 aa, Candidatus Kuenenia stuttgartiensis
MTEVTLSINLCSMRLSNPTVLASGILGTTKTLLKRVAESGAGAVTIKSVSKDSREGHHNPTVITYEAGMLNAVGYSNPGVEAARIEYSNLNEIGVPVIASIIGTCTDDFIEVAEGLSASGFSAIEIPLSCPHTPGFGLLSGQGTPKATYEITYAVRRKTNVPIFVKISPNVPEITSIAKAAEDAGANGITAVNSMGPGMVINIESKKPVLGFKVGGVTGDALRPIAVRCVYDVYQAVKIPIIGVGGISTGRHAIEMMMAGASAVGIGTGVYTRGINVFSKVCAEMKQWMIENGYNTINELVGVAHD

SEQ ID NO: 7951 - DNA, 936 bp, Lactococcus lactis subsp
  CDS (1)..(936)
atgctaaaaacaacttttgcaaatgcggaattcgctaatccattcatgaacgcttcaggagtccattgtatgacaactgaggatttagaagaattaaaagcctctcaagcaggggcctatatcaccaaaagttccacattagaaaaaagagaaggtaatccactcccacgttatgttgacttagaattaggctcaattaattctatgggcctgcctaacctagggtttgattactacttagattatgttttaaaaaatcaaaaagaaaaggctcaagaagcgccaatcttcttttccattgctggtatgagcgcagccgaaaatatcgctatgcttaagaaaattcaagaaagtaatttttcaggaattacagaattgaacctttcttgtccaaatgtccctgggaaaacacagcttgcttatgattttgaagccactgaaaaactcctaaaagaagtttttgccttcttcacaaagcctttaggtgtaaaacttcctccttattttgacctcgttcattttgatatcatggcagaaatcctcaatcaatttccgttgacttatgttaactcagtcaatagtattgggaatggactttttattgattcagaagcagaaagcgtagttattaagcctaaagacggttttggtggaattggtggagcatacatcaaaccaacagcgcttgcaaatgttcgtgctttctatactcgactcaaacctgaaattcaaatcattggaacaggtggtattgaaacaggacaagatgcctttgaacacctcttatgtggagctacaatgcttcaaattggtacagctttacacaaagaaggccctacaatttttgatagaatcattaaagaattagaagagattatggataaaaaaggttatcaatcaattgctgatttccatggaaaattaaaatcattataa

SEQ ID NO: 7952 - protein, 311 aa, Lactococcus lactis subsp
MLKTTFANAEFANPFMNASGVHCMTTEDLEELKASQAGAYITKSSTLEKREGNPLPRYVDLELGSINSMGLPNLGFDYYLDYVLKNQKEKAQEAPIFFSIAGMSAAENIAMLKKIQESNFSGITELNLSCPNVPGKTQLAYDFEATEKLLKEVFAFFTKPLGVKLPPYFDLVHFDIMAEILNQFPLTYVNSVNSIGNGLFIDSEAESVVIKPKDGFGGIGGAYIKPTALANVRAFYTRLKPEIQIIGTGGIETGQDAFEHLLCGATMLQIGTALHKEGPTIFDRIIKELEEIMDKKGYQSIADFHGKLKSL

SEQ ID NO: 7953 - DNA, 1845 bp, Enterococcus faecalis
  CDS (229)..(1197): transl_table=11
tttgtcggcatcggcaaagcgactgcttacgtggaagataaaaaggtctgcgaatgtgaattgacgtttattgtgggacgataagaatcaatcaattttggatacgttagtttccctaagaaaaggaataagtcacaatggcttattcctttttaaatttatataaataacactaacgcaaaaaaacatgctataatcataaaaagcttatgtgaaggtggtaagcttatgagtaaaacaatttacaggagggtttttcttttggatatttcagtagagttttcgggacataaattggcgaatgtgttaatgaacgcatcaggtattcattgtatgacaattaaggaaatggacgagttagcggcttctcaagcaggtgcttttgtcgctaagacggcaacacctaatcctcgtcagggcaatgaggaaccacggtattttgatacaccattaggaagtattaactcaatgggcttgcctaatttagggattgattattatttagattatcagattgcacgtcaaaaggaatttcctgaggagttacgctttttatctgtatctggtatgaattatgaggaaaatatcgctattttaaaaaaagtgcaagaaagtgaatacacaggagtgacagaatttaatttgtcttgtcccaatttgcctagtaaaccgcaaattgcttatgattttgaattaacagaaaagcttttaacagaagttttccaattttttactaaaccattaggtgtaaaattacccccattttttgatattgcacattttgacgcaatggctgaaattttaaataaattccctttagtttacgtgaatagtattaatagcatcggtaatggtttatatattgacagtgacaaggaagaagtggtcattaaaccaaaaggaggcttcggtggactgggcggcgaatatgtcaaaccaacagcgttagccaatgttcgtgcgtttgcgcaacgtttgaaaccagaaatcaaaattattggaacgggcggtattacatgtggaaaagatgtttttgagcatcttttatgtggtgcgacattagtacaagttggcacacaattgcatcaagaaggtccacaagtttttgcgcgtctagccaaagaattacaagaaatcatggcagcaaaaggttatgaaagtattgaagaatttcgtgggaaattgaaagagatgtaacaaaaaagaggtcgggacagaaccgtttagctccgagaaataagaagaaatttccgaaaattgctctttaatttttggagaatttcggcttatttccgaaggagttggttctgttcccgccgtttatcagtttttgagcgtggagcaaaaatccaaagtgatttttgtcccacgctcttttttgttatttcacagccttaacattttccataaaggcttccaaatattcaggttgtgttaattgttggttacaggtgtcgctatcatggcaaatgtaattgccttttttcgtgtaggttccgtcgccgcctgatttggtggtagctaggaacatagacacattcgtgattgtttgacagatggagcaaacacctttaacaatggtgggtgaaagggtgccgtggacgccgattaatttattttctcgataagctaagataaattttttctgagtcccagcgtcgttccaaccgacataggtattgttccgtaaatccatgttttcccactcaggaatctttaactttttcactttgcgaaagactttcgtgacttgtggtgttgaaggttccttaaagggcagcacggtttcttttaattcgtctaaatatttttcagcacgtgcgcgtgttaaacgacgatccatca

SEQ ID NO: 7954 - protein, 322 aa, Enterococcus faecalis
MSKTIYRRVFLLDISVEFSGHKLANVLMNASGIHCMTIKEMDELAASQAGAFVAKTATPNPRQGNEEPRYFDTPLGSINSMGLPNLGIDYYLDYQIARQKEFPEELRFLSVSGMNYEENIAILKKVQESEYTGVTEFNLSCPNLPSKPQIAYDFELTEKLLTEVFQFFTKPLGVKLPPFFDIAHFDAMAEILNKFPLVYVNSINSIGNGLYIDSDKEEVVIKPKGGFGGLGGEYVKPTALANVRAFAQRLKPEIKIIGTGGITCGKDVFEHLLCGATLVQVGTQLHQEGPQVFARLAKELQEIMAAKGYESIEEFRGKLKEM

SEQ ID NO: 7955 - DNA, 1290 bp, Solanum lycopersicum
  CDS (1)..(1290)
atggcgtctcttggattggctcaacgaatcagaattggacttgatgggaactcgggtgttgaaaacccggtgatgggtcgggctggtcggttaaatttcggtagaaaacgagttgggttcagaattatggcattagagggccaatcagtggagcccgatctaagtgtaactgttaacgggttgaaaatgcctaacccatttgttattgggtcgggtccaccagggaccaactatacagtgatgaagagagcctttgatgaaggctggggtggtgttatcgccaaaacggtgtctttggaagccgataaagtaaaaaatgtgacccctagatatgctaaactaagagcagatgcaaatggttctgccaaaggacaaattattgggtggcagaatattgagctcattagtgatcgacctctggaaacaatgctgaaagagtttaagcaattgaaagaagagtatccagataggatactaattgcttctatcatggaagaatataacaaagctgcttgggaggaacttatttacagatgtgaggaaactggaattgatgcctttgaaatcaacttctcgtgtccccatggtatgccagaacgtagaatgggtgctgctgttggtcaagattgtgatctcttggaggaggtttgtggatggatcaatgctgtagccacagttccagtttgggcaaagatgacccctaatatcaccgacattaccaagccggctagggtggctcttaaccaagggtgcgagggggtatctgctataaatacaatcatgagtgtaatgggaatcaatctcgacaccttgaggcccgagccttgtgttgagggctactctactcctggaggctactcatcaaaggcagtgcatccaattgcccttgcaaaagtaatgaacattgcacggatgatgaagtcagaattcggagataaggactattcactctctgctattgggggagttgagacaggtggtgatgctgctgagtttattcttctcggagcagatactgtacaggtttgtaccggtgtcatgatgcatggatatggtcttgtgaaaacgttgtgctctgagctgaaagatttcatgagaaagcacaacttttcatcaatagaagatttcaggggaacgtcacttgagtacttcacgacacacacagatttggtgagaaggcagcaagaagcaatacgtcaaaggaaagcagttaagaaaggtttacaatcagacaaagactggacaggagatggctttgtgcaagaaactgaaagcatggtttccaattag

SEQ ID NO: 7956 - protein, 429 aa, Solanum lycopersicum
MASLGLAQRIRIGLDGNSGVENPVMGRAGRLNFGRKRVGFRIMALEGQSVEPDLSVTVNGLKMPNPFVIGSGPPGTNYTVMKRAFDEGWGGVIAKTVSLEADKVKNVTPRYAKLRADANGSAKGQIIGWQNIELISDRPLETMLKEFKQLKEEYPDRILIASIMEEYNKAAWEELIYRCEETGIDAFEINFSCPHGMPERRMGAAVGQDCDLLEEVCGWINAVATVPVWAKMTPNITDITKPARVALNQGCEGVSAINTIMSVMGINLDTLRPEPCVEGYSTPGGYSSKAVHPIALAKVMNIARMMKSEFGDKDYSLSAIGGVETGGDAAEFILLGADTVQVCTGVMMHGYGLVKTLCSELKDFMRKHNFSSIEDFRGTSLEYFTTHTDLVRRQQEAIRQRKAVKKGLQSDKDWTGDGFVQETESMVSN

SEQ ID NO: 7957 - DNA, 1496 bp, Pyrus pyrifolia
  CDS (21)..(1295)
gtgacccaaattcttgatccatggcgtctatcagctttactcagatcggaggcaaaaacccagttgctgaattttccaggagacctcgtcctgaggtgcgtttaactcggccaagccgagtagggttcagggtgtttgcctccgagagcaaggcggagcctgatcttagtgttactgttaacgggttgcacatgcccaacccatttgttatcgggtcgggtccgccagggactaactatacggtgatgaagagggcctttgatgaaggctggggtgctgtgattgccaaaactgtatcactagaggcagacaaagtaaaaaatgtcactcctcgatatgctcggctacgagtagatggaaatggctcagccaaagggcaaattattgggtgggagaacatagaactgataagtgatcgacctcttgacattatgttgaaagaattcaagcaattaaagcaagagtatccagataggattctgattgcttcaattatggaggaatacaacaaagctggctgggaggaacttattgaccgtgtcgagcaaactggagttgatgctcttgaaatcaatttttcctgtcctcatggtatgccagagcgcaagatgggagctgcagttggtcaagactgtgcacttctggaagaagtttgtggctggatcaatgccaaagccacagttcctgtgtgggcaaagatgactcctaacattactgacatcacacagccagctagagtcgctctgagctcaggatgtgagggcgtgtcagctattaataccatcatgagtgtaatgggaatcaatctaactaccttacggcctgagccttgtgtggagggatactcaactcctgggggctattcggctaaagcagttcatccaattgcactggcaaaagtgatgaacattgcaaagttaatgaaatcagaatttggtgatacggattactcgctttctggtattgggggtgttgagtctggtggcgatgctgctgagtttattcttcttggagcaaatactgttcaggtatgcactggggtcatgatgcacggatatggtgttgtgaagaaactttgttccgagctgcaggattttatgaaacagcacaatttttcatccattgaagatttcaggggggcttccctcgaatactttacaacacatacagatttagtgagaagacaacaggaagcaatcaaacagaggaaagccatccgaaaaggattgcaatccgataaggactggacaggagacggcttcgtgaaagagaccgagagcatggtttccaactgagttggacaaccgaaccaattgaaataaggatgttctcaaatatttgaagaaatgagctgcactgcatgaacatctcagtcaaacatagtaaatatttgctgacaagtaaagaggcatggtatttgctgccaaagcagaagataagatgctttctgtcaccctttcgtttatgggcgtcaaagatgctttctttttatctgt

SEQ ID NO: 7958 - protein, 424 aa, Pyrus pyrifolia
MASISFTQIGGKNPVAEFSRRPRPEVRLTRPSRVGFRVFASESKAEPDLSVTVNGLHMPNPFVIGSGPPGTNYTVMKRAFDEGWGAVIAKTVSLEADKVKNVTPRYARLRVDGNGSAKGQIIGWENIELISDRPLDIMLKEFKQLKQEYPDRILIASIMEEYNKAGWEELIDRVEQTGVDALEINFSCPHGMPERKMGAAVGQDCALLEEVCGWINAKATVPVWAKMTPNITDITQPARVALSSGCEGVSAINTIMSVMGINLTTLRPEPCVEGYSTPGGYSAKAVHPIALAKVMNIAKLMKSEFGDTDYSLSGIGGVESGGDAAEFILLGANTVQVCTGVMMHGYGVVKKLCSELQDFMKQHNFSSIEDFRGASLEYFTTHTDLVRRQQEAIKQRKAIRKGLQSDKDWTGDGFVKETESMVSN

SEQ ID NO: 7959 - DNA, 948 bp, Kluyveromyces lactis
  CDS (1)..(948)
atgaaaccttccctgcaagtcgaattttgtggacatatttatgaaaacccgttgatgaacgcatcaggggtgtgctgtatgacaaccaatgaattagacgatatggcacgttcgagctcaggtgccttcatcaccaagagcgctacttctatggagagagacggcaatcctgaacctcgttatgtttcggtcccgttaggcagtatcaattcgatggggcttcctaacaaaggaattgattactatcttgattatgttttagatagacaggacaggttcccttcagagaacccaccttttatgtctgttgcagggatgagtattgatgagaacataaaattactccatagaatacaggacagtaattttagaggtatcactgaattgaatttatcctgcccgaacgttcctgggaagccccaggtggcatatgacttcgagttgactgatcaaatactaagcagtgtgtttgaatttttcacgaagccgctaggggtgaagcttccgccatactttgacttcgcacattttgatgctatggcatgtattttaaacaagtacccaattgcctatgtgaattgtataaatagtgttgggaatggactttatattgatgtggaaaaggaatctgtggtcatcaagccaaaagatgggtttggtggtatcggaggtgaatacattaaacctacagcgttggcaaacgtacgtgcattctacaatcgtctgaacggacgtattagaattattggaacaggtggtatcaaaaccggtcaagatgcttttgaacacctactatgtggagcgaccatgcttcagattggcactgagcttcaaaatgaagggactgaaattttcgaaagaatcaatgccgagctattgcagatcctcgaacaaaagggctatcaatctattgaagattttagaggcaagctgcgctccatctcatag

SEQ ID NO: 7960 - protein, 315 aa, Kluyveromyces lactis
MKPSLQVEFCGHIYENPLMNASGVCCMTTNELDDMARSSSGAFITKSATSMERDGNPEPRYVSVPLGSINSMGLPNKGIDYYLDYVLDRQDRFPSENPPFMSVAGMSIDENIKLLHRIQDSNFRGITELNLSCPNVPGKPQVAYDFELTDQILSSVFEFFTKPLGVKLPPYFDFAHFDAMACILNKYPIAYVNCINSVGNGLYIDVEKESVVIKPKDGFGGIGGEYIKPTALANVRAFYNRLNGRIRIIGTGGIKTGQDAFEHLLCGATMLQIGTELQNEGTEIFERINAELLQILEQKGYQSIEDFRGKLRSIS

SEQ ID NO: 7961 - DNA, 945 bp, Saccharomyces kluyveri
  CDS (1)..(945)
atgtctgcatccttagctatcaactttttgaatcacacttatgagaatccgtttatgaacgcatcgggtgttcattgtatgagcactaaagaattggatgagctaaaggattccagggctggtgccttcattacaaagagttctactacatcaaaaagggagggaaatccagagcctcgttacttctcagtcccattaggtagtattaactcgatgggtcttccaaatgagggttttgattactatttgaaatatgccttggagtatcaaaaaaatggttccacttcaacccctctatttttttctgttgcgggtatgagtgtcgaagaaaacttgaagatgttgcaaaagattcaagatagcgatttcaatggcattacagagttaaatctgtcttgtcctaatgtccctggtaagccacaagttgcatacgattttgaattaacaaaggaaattttgactaaagtcttcgaattctttaaaaaaccactgggcgttaaattacctccatattttgattttgctcatttcgacatcatggcaggtattttgaaccagcttccgttatcttacgttaactgtatcaacagtataggcaatggtctttacattaacgttgaaaccgaaagtgttgtagttaaaccaaaaaacgggtttggtggtattggtggtgagtacgttaaaccaactgcgctggccaatgtgagggcattttacactcgtttgaatccaaccatcaaaattatcggtacaggtgggatcaagacaggccaggatgcgtttgagcacttattatgtggtgctactatgctgcaggtgggaaccgaattgtacaaagagggtgtttccatctttgaccgcttagaaagggaattgaaagagcttatggataagaaaggctacacatcgatcgagcaatttcgtggtaagttaaacagtctgtag

SEQ ID NO: 7962 - protein, 314 aa, Saccharomyces kluyveri
MSASLAINFLNHTYENPFMNASGVHCMSTKELDELKDSRAGAFITKSSTTSKREGNPEPRYFSVPLGSINSMGLPNEGFDYYLKYALEYQKNGSTSTPLFFSVAGMSVEENLKMLQKIQDSDFNGITELNLSCPNVPGKPQVAYDFELTKEILTKVFEFFKKPLGVKLPPYFDFAHFDIMAGILNQLPLSYVNCINSIGNGLYINVETESVVVKPKNGFGGIGGEYVKPTALANVRAFYTRLNPTIKIIGTGGIKTGQDAFEHLLCGATMLQVGTELYKEGVSIFDRLERELKELMDKKGYTSIEQFRGKLNSL

SEQ ID NO: 7963 - DNA, 1338 bp, Kluyveromyces lactis
  CDS (1)..(1338)
atgaatagtgggttcccacgtattttgagcaagaaactttttacgctaaatcaatcgcagttctttgtcaagaatggcatggtcccattgaaagcaggcatttctggccctaagcttttgaagtacactgttgggatagccattggttcatttgcgggattctatttctccaattcgaggtctgctttccatgagtacgtcttgtgcccgatgttgagacttgtaacgccagatgctgaagatgggcataaattaggtatctggttcttgaagaatgggttggctccaagattatggttcgataacgatgataaggtattgaatgtgaacatttttggtaagaaattgaccaatccaattggttgtgctgccggtttggataaaaatggtgatgccatcgacggtatactttccggaggattcggttatatagagattggttctgtgactccattaccacaaccaggaaacccaagacctagattctttagattacctttggatgatgctgttatcaacagatacggtttcaattcatccggccatgacaccgttgtcaacacattacaatcccgtattaccagtttcatcaacagttacatgtttaaggacaattccgttgaaaacttgtccttatacaaagacaaattgttgggggtcaatttgggtaagaataagaccggtgatgaagtgcaagattatttgaaaggtgtagaaagctttcaaaagtacgcagatgttctagtaattaatgtgtcttctccaaataccccgggtttgagaagtttacaaaaagaatccatccttactgatctattgacccaagtcgttgccaagagagactcattggttacatctggtaatgcattaggtgctaagacacacaaacctcctgtattggttaaagttgccccagatttagtagaagaagagatcaaatctattgctgaagctgccaagaaatccaaagtcgatggtatcatcatttcaaacacaacgatccaaagacctactacattgataacagaggacagtgaccttgtttcccaagctggtgggttaagtggtaaaccactaaagccattagcattgaaagctcttaagaccatggcgaaatacaccaagggctcaggtctagtcctagtcggttgcggtggcatttcctctggtgcagacgcaattgagtttgcaaaggcaggcgcttcaatggtcgaactatataccgcatacgcttacaagggaccagggttaattgctaagatcaaagatgaaaccactgagctattgaaaaaggaaaacaagacgtggtccgaaatcattggagaagatatcaaataa

SEQ ID NO: 7964 - protein, 445 aa, Kluyveromyces lactis
MNSGFPRILSKKLFTLNQSQFFVKNGMVPLKAGISGPKLLKYTVGIAIGSFAGFYFSNSRSAFHEYVLCPMLRLVTPDAEDGHKLGIWFLKNGLAPRLWFDNDDKVLNVNIFGKKLTNPIGCAAGLDKNGDAIDGILSGGFGYIEIGSVTPLPQPGNPRPRFFRLPLDDAVINRYGFNSSGHDTVVNTLQSRITSFINSYMFKDNSVENLSLYKDKLLGVNLGKNKTGDEVQDYLKGVESFQKYADVLVINVSSPNTPGLRSLQKESILTDLLTQVVAKRDSLVTSGNALGAKTHKPPVLVKVAPDLVEEEIKSIAEAAKKSKVDGIIISNTTIQRPTTLITEDSDLVSQAGGLSGKPLKPLALKALKTMAKYTKGSGLVLVGCGGISSGADAIEFAKAGASMVELYTAYAYKGPGLIAKIKDETTELLKKENKTWSEIIGEDIK

SEQ ID NO: 7965 - DNA, 1464 bp, Kluyveromyces marxianus
  CDS (38)..(1378)
agtgtgtagttgcatgtccattggaaagacggtaagcatgaagtatagttttgtatccttattgcaaagaggttcaataggctctaagcaattcattttctttgcgaagaacgagatgtctccattgaaagccggtgttcccggtgcgaagttcttgaagtacaccgttggatttacgctgggtactcttgctgggttctatttgaccaattcgaggtctgcgattcacgaatatgtcagctgtcctacagtgaggttacttaccccggacgcagaagcggggcataaacttggtatttggctattgaagtatggtctagcaccacggttgtggttcgacaaagacgaggaattgttgcatgttaatgttttcgggaaaacgctaacaaaccctgttggttgtgctgctggtttggataaagacggtgaggctatcgacggtattttcgccggtgggttcgggtatgtggaaatcggatctgtgactccattgccacaacccggtaatcctaagcccaggttcttcagattgccaatggatgaagctgtcatcaacaggtatgggttcaattcttctggtcatgactctgtggtaaagaatctgcaaaatcgtgtgagcagattcattaacagttacttttgcaacgatattaacgccgtagataacctatctctataccagaacaagctactagggatcaatttggggaagaataagaacggtgacgaagtacaggactacttgaaaggtgttgaaaaattccagaaatatgcagatgtgctagtgattaacgtttcctctccaaacacacctggactcagaggcttgcagaaggaatcgattttaactaatcttttgagtcaggtggtcgccaagagagactctttagtctcttccgggaacgttttgggtgccaagacgcacagacctcctgttcttgtcaaggtggctccagatttggaagaagaggagattaaagccattgccgaagctgcaaagaaatccaaggtcgatggtatcattgtttccaacaccaccatccaaagacctgcgtccctaatcacagaagacaagaatctcgtcgctcaagctggtgggctaagcggtaaaccattgaaaccactctctttgaaagcactaaagaccatggcccattacaccaagggttccggtttggtgctagtaggttgcggtggtatttcctcaggtgcagacgcaattgagtttgcgaaggcaggtgccaccatggtcgagctctacacctgttatgcctacagaggtcctggtttgattgctcgtgtaaaggacgaaatcactgagcaattgaagagggaaaacaagacgtggtcccagatcattggagaagacgtcaaataagatatgactcgatgactttaatactcgactcaattttactgggctcgctcaactacatttttaaaaatagaataaaataaaacaag

SEQ ID NO: 7966 - protein, 446 aa, Kluyveromyces marxianus
MKYSFVSLLQRGSIGSKQFIFFAKNEMSPLKAGVPGAKFLKYTVGFTLGTLAGFYLTNSRSAIHEYVSCPTVRLLTPDAEAGHKLGIWLLKYGLAPRLWFDKDEELLHVNVFGKTLTNPVGCAAGLDKDGEAIDGIFAGGFGYVEIGSVTPLPQPGNPKPRFFRLPMDEAVINRYGFNSSGHDSVVKNLQNRVSRFINSYFCNDINAVDNLSLYQNKLLGINLGKNKNGDEVQDYLKGVEKFQKYADVLVINVSSPNTPGLRGLQKESILTNLLSQVVAKRDSLVSSGNVLGAKTHRPPVLVKVAPDLEEEEIKAIAEAAKKSKVDGIIVSNTTIQRPASLITEDKNLVAQAGGLSGKPLKPLSLKALKTMAHYTKGSGLVLVGCGGISSGADAIEFAKAGATMVELYTCYAYRGPGLIARVKDEITEQLKRENKTWSQIIGEDVK

SEQ ID NO: 7967 - DNA, 921 bp, Aquifex aeolicus
  CDS (1)..(921): transl_table=11
atggacctgagcgtggaactcttcggcatacgctttaagaatcccgtctgggttgcaagcgggacctttggctacggcgtggaagctgcggaaatctacgatatatcaaaactcggagcagtagtcacaaaaggtctctcactcaaggaaaggctcgggaacgaaaccccgagaattgtggaaaccccctgtggcatgctcaactccataggtcttcaaaatccgggagtggaaaagttcctaaaagagatttaccccaagataaaagacgtggacactcacttcatagctaacgtcttcggtgaaacggaagaggagtacgtggaagtttgtatggctctggaagatgctgacaagattgtggcttacgagctgaatgtttcctgtcccaacgtgaagaagggaggaatcctcttcggacacgaccctgtaatcctcggaaatctcgttgacagaataaaggcgaaaataaaaaaacccctccttgtaaaactctctccaaatgtgaccgacgttaccgagtttgcgaaggtatgtatagaaaacggagctgatggactcgttttgataaacacattaatgggaatgaagataaacatatggaagaggaaaccagaccttgccaccaaaacgggaggactatccggacctgcgatactgcccatagcggtgaggatgatttatcaggtttacgagaagttcggcgacagaattcccataataggagtgggagggataaccacatgggaagacgccatggaacacgtaatggcgggggcaagtgcagttcaggtgggaaccgcaaacttctacgagcccttagcacccttaaaggtcatagaagggattgaaaactttatgaaatctcagaatatcaaagacttcaaagaattaatcgggattgcccacagagtagaataa

SEQ ID NO: 7968 - protein, 306 aa, Aquifex aeolicus
MDLSVELFGIRFKNPVWVASGTFGYGVEAAEIYDISKLGAVVTKGLSLKERLGNETPRIVETPCGMLNSIGLQNPGVEKFLKEIYPKIKDVDTHFIANVFGETEEEYVEVCMALEDADKIVAYELNVSCPNVKKGGILFGHDPVILGNLVDRIKAKIKKPLLVKLSPNVTDVTEFAKVCIENGADGLVLINTLMGMKINIWKRKPDLATKTGGLSGPAILPIAVRMIYQVYEKFGDRIPIIGVGGITTWEDAMEHVMAGASAVQVGTANFYEPLAPLKVIEGIENFMKSQNIKDFKELIGIAHRVE

SEQ ID NO: 7969 - DNA, 1383 bp, Arabidopsis thaliana
  CDS (1)..(1383)
atggccggaagggctgcgacgtcgtcggcgaaatgggcgagagagtttttgttcagaagggtttcgtctaatcctcttggagctacccgtaactgttcttcggttcctggagcttcttctgcaccgaaagtccctcatttttccaagagaggaaggatattgacaggagctaccattggtctggccatagctggaggagcttatgttagtactgcagatgaagcaaccttctgtgggtggctattcaacgcaacaaaggttgtgaatcctttctttgctcttctggatgctgagtttgcgcataagctggctgtttcagctgcagctcgcgggtgggtacctagagaaaagaggcctgatccagcaatcttgggacttgaagtttggggaaggaaattctcaaacccaattgggcttgctgctggatttgacaaaaacgctgaggctactgagggactgctagggatgggatttggctttgttgaggtaggctctgtaactcctgttccacaagaaggcaatccgaaaccacgtatcttcagactaagccaagaaggagctattatcaataggtgtggatttaatagcgaagggattgttgtcgttgcaaagcggttgggtgctcaacatggtaaaagaatgttggctgaaacatcagctacttcgtcatctccaagtgatgatgtaaaaccagggggaaaatctggacctggtattcttggggtcaaccttggaaagaacaagacgagtgaggatgctgctgctgactatgtccaaggagttcataacttatcccagtatgctgattacttggtgatcaatgtttcatcacccaatactgcaggactgcgcatgcttcaaggaaggaaacagttgaaggaccttgtaaagaaggttcaagctgctcgggatgagatgcaatggggtgatgaaggtcctcctcctcttcttgtgaagattgctcctgatctgtccagaggagagcttgaagatattgcagcggtggctcttgctctgcacttagatgggctgatcatatcaaatacaacagtctcaaggcctgatgctgtaagcaacaaccccgtggcaacagaaacaggtggtttgagcgggaaaccgctctttgctctctccaccaacatgttgagagatatgtacactttgacacgaggaaagattccattgataggctgtggcggggttagtagtggtgaggatgcttacaagaaaataagagctggagctactcttgttcagctgtacacgggatttgcctatggaggacctgccctcatcccacaaataaaggaggaactggtgaaatgcttagaaagggatggcttcaagtcgatccatgaagcaattggtgctgatcacagatga

SEQ ID NO: 7970 - protein, 460 aa, Arabidopsis thaliana
MAGRAATSSAKWAREFLFRRVSSNPLGATRNCSSVPGASSAPKVPHFSKRGRILTGATIGLAIAGGAYVSTADEATFCGWLFNATKVVNPFFALLDAEFAHKLAVSAAARGWVPREKRPDPAILGLEVWGRKFSNPIGLAAGFDKNAEATEGLLGMGFGFVEVGSVTPVPQEGNPKPRIFRLSQEGAIINRCGFNSEGIVVVAKRLGAQHGKRMLAETSATSSSPSDDVKPGGKSGPGILGVNLGKNKTSEDAAADYVQGVHNLSQYADYLVINVSSPNTAGLRMLQGRKQLKDLVKKVQAARDEMQWGDEGPPPLLVKIAPDLSRGELEDIAAVALALHLDGLIISNTTVSRPDAVSNNPVATETGGLSGKPLFALSTNMLRDMYTLTRGKIPLIGCGGVSSGEDAYKKIRAGATLVQLYTGFAYGGPALIPQIKEELVKCLERDGFKSIHEAIGADHR

SEQ ID NO: 7971 - DNA, 1335 bp, Ashbya gossypii
  CDS (1)..(1335)
atgagttacaagatgtttggaaggtgccggacggcatgcttcagatcacccaacttatttgcagccaataagggcatgcctctccaggcaagcgttgcgggtggtgcttctagatatatcataggtactgcgagtgtcttggtgggagccatggcgggcttctacatcatgaactcgcggtctgccattcatgaatacgtatcctgcccattggtgaggctcgtgactccggacgcagaagacggccataagctcggaatctggttcctcaagtatggattagcgccaaaattgatgttcgacaaggacgacccagtcttaaaggtcgaggtctttgggaagacgatgagcaaccccattggatgtgctgctggtctggataaggacggcgaggctatcgatggcattgctcagagtgggtttggatacgtggagattgggaccgtgactccattggcgcagccaggtaaccccaagccgcgcttcttccgtctgccgatggacgaggctgtcatcaaccgttatggattcaattcttctggtcataagaaggtatacgataacgttctttcccgcgtgcgtcaatttcttggcgcttacttcagggacgatacagtgaactctctggcgctttacaaggacaaacttctgggaattaatctcggaaagaacaagaatggtgacgaggttgaggactacctgcgtggtgttgagaagttccagtcccttgccgatgtactagtgatcaatgtttcctctccgaacacgcccggattacgcgacctccagcaggagggcagattgacggagctgttatccatgattgtggctaagcgcaattctttgatcaacgagggcaatgtgctcggtgcaagtacccataagccacctgtcctggttaaaatcgcaccggatttgaccgagccagaattgcaatcgatcgcagaggcggccaagaaatcgagtattgacggtatcatcgtttcaaacactactatccaaaggccagactcgctgtacactgtcgatgaggagctgaaaaaccaggcaggcggcttgtccggcaagcccgtgaaaccatttgcgctaaaagctttgcgcacgatacaccaatacacaaaggacacgaacctggttttggttggatgtggtggtatcagtagtggccaggatgccatcgagtttgccaaagcgggggcgcactttgtgcaactctacactgcgtacgcatacagaggccctggcttaattgcgcgtatcaaggatgaagtcacagaggagctcaggaacgagggcaaaacgtggatggagatcattggtcaagatgccaagtaa

SEQ ID NO: 7972 - protein, 444 aa, Ashbya gossypii
MSYKMFGRCRTACFRSPNLFAANKGMPLQASVAGGASRYIIGTASVLVGAMAGFYIMNSRSAIHEYVSCPLVRLVTPDAEDGHKLGIWFLKYGLAPKLMFDKDDPVLKVEVFGKTMSNPIGCAAGLDKDGEAIDGIAQSGFGYVEIGTVTPLAQPGNPKPRFFRLPMDEAVINRYGFNSSGHKKVYDNVLSRVRQFLGAYFRDDTVNSLALYKDKLLGINLGKNKNGDEVEDYLRGVEKFQSLADVLVINVSSPNTPGLRDLQQEGRLTELLSMIVAKRNSLINEGNVLGASTHKPPVLVKIAPDLTEPELQSIAEAAKKSSIDGIIVSNTTIQRPDSLYTVDEELKNQAGGLSGKPVKPFALKALRTIHQYTKDTNLVLVGCGGISSGQDAIEFAKAGAHFVQLYTAYAYRGPGLIARIKDEVTEELRNEGKTWMEIIGQDAK

SEQ ID NO: 7973 - DNA, 942 bp, Bacillus caldolyticus
  CDS (1)..(942): transl_table=11
atgaaccggcttgcggtcgaactgccgggtctttcgctcaaaaacccgatcatgccggcgtccggctgttttggatttggccgcgagtacgcccggttttacgatttaagcgtgttaggcgccattatgatcaaggcgacgacaaaagagccgcgctttggcaacccgacaccaagggtggcagaaacgccgggcgggatgttaaacgccatcggcctgcaaaaccccggccttgacaaagtgctcgaagaagaactgccgtggcttgaacagtttgacgtaccgatcatcgccaacatcgctggctcgacggtggaagagtacgtcgaggtagccgaagcgatttccaaagcgcccaatgtccatgcgttagagctcaacatttcctgcccaaacgtgaaaaaaggcgggattgcgttcggcaccgtgccggacgtggccgcggaactgacgcggcttgtcaaagaagtggcggctgtccccgtgtatgtgaacgtgtcgcctaacgttacggacatcgtcgcgatggcgaaagccattgaacaagcgggtgctgacggcctgacgatgatcaacacgctcgttggcatgcgcatcgacgtgaaaacaggccggccgattttggccaacggcaccgggggcttatccggcccggcggtgaaaccgatcgccatccgcatgatttatgaagtgagccaggcggtgtcgattccgatcatcggcatgggcggcattcaaacggcggaagacgtgctcgagtttttctacgccggcgcgagcgcggttgcggtcggcacggccaacttcgtcgatccgttcgtctgcccgacgatcatcgccgacctgccggcgctgttggacgacctcgggatcggccacatttccgaatgcataggaaggagctggaagaccggtgcacacgccgttcattgtcgcgcttga

SEQ ID NO: 7974 - protein, 313 aa, Bacillus caldolyticus
MNRLAVELPGLSLKNPIMPASGCFGFGREYARFYDLSVLGAIMIKATTKEPRFGNPTPRVAETPGGMLNAIGLQNPGLDKVLEEELPWLEQFDVPIIANIAGSTVEEYVEVAEAISKAPNVHALELNISCPNVKKGGIAFGTVPDVAAELTRLVKEVAAVPVYVNVSPNVTDIVAMAKAIEQAGADGLTMINTLVGMRIDVKTGRPILANGTGGLSGPAVKPIAIRMIYEVSQAVSIPIIGMGGIQTAEDVLEFFYAGASAVAVGTANFVDPFVCPTIIADLPALLDDLGIGHISECIGRSWKTGAHAVHCRA

SEQ ID NO: 7975 - DNA, 936 bp, Bacillus subtilis
  CDS (1)..(936): transl_table=11
atgctagaggtgaaattgccgggacttgatttgaaaaacccaatcattcctgcatcaggctgcttcggttttggaaaagaattttcacgtttttatgatttgtcttgtcttggagctatcatgattaaggctacgacaaaggagccgcgctttgggaatccgacgccgcgggtagctgagactggtgctggaatgctcaatgcgatcggtctccaaaatccggggctggatagtgtgttgcatcatgagctgccgtggcttgagcagtttgatacaccgatcattgccaatgtcgcaggttctcaagtcgatgattatgttgaagtcgcagaacatatcagcaaagcgcctaatgttcatgctcttgaattgaatatttcctgcccgaatgtgaaaacaggcggaatcgcttttggcacgaatcctgaaatggctgccgatttgacaaaagcggtgaaagaggtttcggatgtacccgtttatgtgaagctatccccgaacgtggctaatatcacagaaattgcattagcgatcgaggaagcgggagcggacggtcttacgatgatcaacacactaatcggcatgagactcgatttaaaaaccggcaaaccgatattagcgaataaaacagggggactttcgggccctgctgtgaagccggttgccattcgcatggtgtatgaagtcagccagatggtcaacatcccgattatcggaatgggaggcgtgcaaacggctgaagatgccctggaatttcttctcgcgggagcaagcgcagtcgctgtcggaacagcaaactttgtgaatccttttgcatgtccagagattattgaacagctcccatctgttttgctccaatacggctatcaatcaattgaagaatgcatcggaaggagctggaatcatgaaaaacaacctgcccatcatcgcgcttga

SEQ ID NO: 7976 - protein, 311 aa, Bacillus subtilis
MLEVKLPGLDLKNPIIPASGCFGFGKEFSRFYDLSCLGAIMIKATTKEPRFGNPTPRVAETGAGMLNAIGLQNPGLDSVLHHELPWLEQFDTPIIANVAGSQVDDYVEVAEHISKAPNVHALELNISCPNVKTGGIAFGTNPEMAADLTKAVKEVSDVPVYVKLSPNVANITEIALAIEEAGADGLTMINTLIGMRLDLKTGKPILANKTGGLSGPAVKPVAIRMVYEVSQMVNIPIIGMGGVQTAEDALEFLLAGASAVAVGTANFVNPFACPEIIEQLPSVLLQYGYQSIEECIGRSWNHEKQPAHHRA

SEQ ID NO: 7977 - DNA, 1320 bp, Candida glabrata
  CDS (1)..(1320)
atgatgcacagagttggttttaacgttatcggtagaagatcctttttcaccgttaatgccagacgtcaggtgttgaaatccagtttcatgggtttaaagcccttgcaactaacggcccttctgcttgccggtagtgccggttacttgtacttcatgaatgctagatcagctattcatgagtatgtcgtttgtccagtggttagattgattactcctgacccagaaaacggtcacaagttgggtatatggtgtttcaaatggggtctttctccaaagttgtactttgataaggatcctgaatccctacacgttaatgttttcggtaccaccatgactaacccaattggctgtgcagctggtttagataaggatgctgaagccatcgatggtattatgccaactggtttcggctacatggaagtcggctctgtcaccccagttgctcaaccaggtaacccaagaccaagattttttagattgcctgcagatgatgctgttatcaacagatatggttttaactcaagtggtcacgacgttgtttacaacaacttgatgaagcgtgttaacaagttcttaaactcatactttggcgacaaatctattgacaaactatctctatacaaagacaaattgcttgctgtgaaccttggtaaaaacaagaatggtgacgaagtgaaggactacttgaaaggtgtcgaaaagttccaatcattagccgatgttcttgtcattaacgtctcttccccaaacaccccaggtttgagagaccttcaaaacgaagccaaactaactaaccttctatctgaaatcatcaccaaaagagactctcaaagcaataagccaaatgcgttgggtaaacaaaaccacaagcctcctgttttggtcaaaattgcaccagatttaactgaaccagaactacaatccattgttgaagctgctaagaagtctaaggttgatggtattattgtctccaacaccactattcaaagaccaaacactttgaagactcaggatgagactttgagaaaccaagtcggtgggttgtctggtaagccattgaagccatttgccttgaaggccatgaaagccgtatccaaatacgccaaagattctgacttagtcttggttggttgtggtggtatttcttctggtaaggatgccattgaattcgctaaagcaggtgctacttttgttcaactttacacttcatatgcttatgttggcccagctttgattgctagaatcaaggacgaagtcgctgaagaattgaagaaggaaggtaaaacttggatggaaataattggtgaagacaacaaataa

SEQ ID NO: 7978 - protein, 439 aa, Candida glabrata
MMHRVGFNVIGRRSFFTVNARRQVLKSSFMGLKPLQLTALLLAGSAGYLYFMNARSAIHEYVVCPVVRLITPDPENGHKLGIWCFKWGLSPKLYFDKDPESLHVNVFGTTMTNPIGCAAGLDKDAEAIDGIMPTGFGYMEVGSVTPVAQPGNPRPRFFRLPADDAVINRYGFNSSGHDVVYNNLMKRVNKFLNSYFGDKSIDKLSLYKDKLLAVNLGKNKNGDEVKDYLKGVEKFQSLADVLVINVSSPNTPGLRDLQNEAKLTNLLSEIITKRDSQSNKPNALGKQNHKPPVLVKIAPDLTEPELQSIVEAAKKSKVDGIIVSNTTIQRPNTLKTQDETLRNQVGGLSGKPLKPFALKAMKAVSKYAKDSDLVLVGCGGISSGKDAIEFAKAGATFVQLYTSYAYVGPALIARIKDEVAEELKKEGKTWMEIIGEDNK

SEQ ID NO: 7979 - DNA, 918 bp, Lactobacillus plantarum
  CDS (1)..(918): transl_table=11
atgggacgattaacagtaaatttagccggtgtcacgttcaaaaatccggttatgccggctagtggtacggcggcatatggtcaacagatggctcaacagttagacctgagtgcgctggggggcttggtcatcaagtcgaccaccgccgaaccgaaagcgggcaacccacgaccaacgaccgcggaaacaaccgcggggtggctcaatgcaattggactcaaaaatcccggaattgacaatgtgctggccgataaattaccgtggttagcgactcattatccggatttaccgattattgggagtgtcgcgggggcgagctttgatgaatacgtggcagtcgcacgaaaaatggcgtcggcacctaacgtcaaattattggaaatcaatatttcatgtccaaacgtcgaccatggcggcctagcatttggaactgatccagcgacggtaacggcgttgactaaggcgattgttgccgcggtcgataaaccagttttcatgaagctgaccccgaatgtcactgatattgtcccaattgcactcgctgccgaagctggtggagcggctggactgacgatgattaacacgttaacgggtatgggcatcgatttagccacacgtcaaccgatcttagcgcatggtacgggcggtttatctggaaaagccattcatccacttgctgttcggatgatccatgacgtgcgtcaacataccaagttgccgattattggcgttggtggcgtgttcacgccggctgatgtgttggaattttacctggctggtgcaaatgctgttcaagttggggccgcaacgtatggtcacccgactgcttgtacagacattattgctggattaccggcggcaatggatcagtacgggatcaccagcttgcaagcgttgattcaggaggtccaaggatga

SEQ ID NO: 7980 - protein, 305 aa, Lactobacillus plantarum
MGRLTVNLAGVTFKNPVMPASGTAAYGQQMAQQLDLSALGGLVIKSTTAEPKAGNPRPTTAETTAGWLNAIGLKNPGIDNVLADKLPWLATHYPDLPIIGSVAGASFDEYVAVARKMASAPNVKLLEINISCPNVDHGGLAFGTDPATVTALTKAIVAAVDKPVFMKLTPNVTDIVPIALAAEAGGAAGLTMINTLTGMGIDLATRQPILAHGTGGLSGKAIHPLAVRMIHDVRQHTKLPIIGVGGVFTPADVLEFYLAGANAVQVGAATYGHPTACTDIIAGLPAAMDQYGITSLQALIQEVQG

SEQ ID NO: 7981 - DNA, 915 bp, Listeria innocua
  CDS (1)..(915): transl_table=11
atgaatcgattagcggtagaaattccaggattatccttaaaaaatccgattatgccagcatctgggtgttttggattcggacaagaatatagcaaatactatgatttaaatgaacttggtgcgattatggcaaaagcagtcacaccagaacctagacttggaaatcccacaccacgagtagcagaaacagcgagcggaatgcttaatgcaattggcttacagaatcctggtttggaacatgttttagcccatgaattaccatttttagagcaatttgaaacgccgattatcgccaatgtagcaggtgcgacggaggacgattatgttcaagtctgctcccgaatcggggaatcaaaagcagtaaaagcaatcgagctcaatatttcttgcccaaatgtgaaacacggcggcattgcttttggaacagatccggaagtagcgcaccgtttaacaaaagccgtgaaaagtgtcgcaagtgtgccagtttatgtaaaattatcaccgaatgtagcggatattatttccatcgcccaagcaattgaagcggcgggggcagatggactaacgatgattaatacgttactcggtatgcggatagatttaaaaactagaaaaccagtcatcgctaatggtacaggtgggctttcaggtccagcgattaaaccagttgctatccggatgattcatcaagttcgtgctgtaagtaatattcctatcatcggcatgggcggcgtgcaaaccgttgatgacgtgctagaattcttaattgctggggcagatgcagtcgcagtcggaacgatgaattttacagatccctttatttgcccaaaattaattaccgaactgccaaaaagaatggacgaactcggcatttcttctctacaagaacttaaaaaggagctactaaaccaatga

SEQ ID NO: 7982 - protein, 304 aa, Listeria innocua
MNRLAVEIPGLSLKNPIMPASGCFGFGQEYSKYYDLNELGAIMAKAVTPEPRLGNPTPRVAETASGMLNAIGLQNPGLEHVLAHELPFLEQFETPIIANVAGATEDDYVQVCSRIGESKAVKAIELNISCPNVKHGGIAFGTDPEVAHRLTKAVKSVASVPVYVKLSPNVADIISIAQAIEAAGADGLTMINTLLGMRIDLKTRKPVIANGTGGLSGPAIKPVAIRMIHQVRAVSNIPIIGMGGVQTVDDVLEFLIAGADAVAVGTMNFTDPFICPKLITELPKRMDELGISSLQELKKELLNQ

SEQ ID NO: 7983 - DNA, 945 bp, Methanosarcina mazei
  CDS (1)..(945): transl_table=11
atgcagaaactgcctgcgggcaggaaacggagttatttaatgtatactcttaccggacttaaattaaaaaatcccactattcttgcagccggggtgctcgggacaaccggggcttccctctgcagggtcgcacgtgaagggggagctggtgcagttgtgaccaaatccataggtcctgctcccaaaaccggtcatccaaacccgagcatgattgagctggactgcggctttttaaatgccatggggcttccaaacccttcctatcccggcttcctccaggagctggagtttgcaaaagaaaactctgatgctccggtaattgcaagcattttcgggggcaccccttccgaattcgctgaagttgcagaggggctgctcccggcaaagcccgatgctttcgaacttaacgtgagctgcccccatgcagagggttacggggctgcaataggttccaacccctgcctcgttgaagcagttacggcggcggtaaaggatgttgtcaatgtacctgtctgggtcaagctgactcccaatgttgcggacattacatgcattggaaatgcagccgagtccgggggcgcggacgccgttgttgcgatcaacacggtaaagggaatggctattgacattgaatccgggtaccctgtgcttggaaaccgttcaggagggctttcgggaaaagctgttaagcccgtagcagtaaaatgtgtttatgaccttttcactgccctggaaatcccggtaatcggcgtgggaggagtttcttcctgggaagacgctgtggaaatgataatggcaggtgcagccgctgttcaggttgggtctgcggtatatgacagggtaggtatattctctgaaataggcaaaggaatagaagctttcctcaaaagaaaaggctattctgatataaagaaaattacagggcttgcccacgagatggtctga

SEQ ID NO: 7984 - protein, 314 aa, Methanosarcina mazei
MQKLPAGRKRSYLMYTLTGLKLKNPTILAAGVLGTTGASLCRVAREGGAGAVVTKSIGPAPKTGHPNPSMIELDCGFLNAMGLPNPSYPGFLQELEFAKENSDAPVIASIFGGTPSEFAEVAEGLLPAKPDAFELNVSCPHAEGYGAAIGSNPCLVEAVTAAVKDVVNVPVWVKLTPNVADITCIGNAAESGGADAVVAINTVKGMAIDIESGYPVLGNRSGGLSGKAVKPVAVKCVYDLFTALEIPVIGVGGVSSWEDAVEMIMAGAAAVQVGSAVYDRVGIFSEIGKGIEAFLKRKGYSDIKKITGLAHEMV

SEQ ID NO: 7985 - DNA, 1110 bp, Nocardia farcinica
  CDS (1)..(1110): transl_table=11
atgtatgcgctgctgcttcgtgtgatgttcctggtgccgccggaacgcatccaccatctcgccttcgccgcgatgcgggtggcggcccgcttcgcccccacccgggcgctggtgcggcgcctggccgtggtcgacgacccgatcctgcacagcaccgtgttcggggtgcccttccgcgccccgctggggctggccgccggattcgacaagaacgccgagggcgtcgacgtgtgggggcccttcgggtggggattcgccgagatcggcaccgtcaccgcgcaagcccagccgggcaatccggcgccgcggctgttccggctgcccgccgaccgcgccctgatcaaccggatggggttcaacaaccacggcgccgcccgcgccgccgagcagctgcgcgcccgcaccgccaccgtgcccatcggcgccaacatcggcaagaccaaggtcgtcgagcccgcgggcgcggccgccgactacgccaccagcgccgcgctgctcggtccgctggccgatttcgtcgtcgtcaacgtcagctcccccaacacccccggcctgcgcgacctgcaggcggtcgagtcgctgcggccgctgctgcgcaccgtgctcgagaccgtcgccgacggcggtcgccgcgtgccggtgctggtgaagatcgcccccgacctgtccgacgaggacatcgacgccgtcgccgacctggccgtggagctgggcctggccgggatcgtggccaccaacaccaccatccgccgcgacgggctgcacaccgaccccgaggacgtcgccgcgatgggcgcgggcgggttgtcgggcgcgccggtggccgaccgctccctcgaggtgctgcgcaggctctaccgccgcgtcggcgaccggctggcgctgatctcggtcggcggcatcgaaacccccgagcaggcctaccagcgagtcctggccggtgccagcctgctgcagggctacaccggcttcatctacggtggcccgttctggaccaggaagatccaccgcggcctggccgagctgctgcgccgcgacggctacaccagcctcaccgaggccgtcggcgccgaacaccgcggaccccgaccccaggccgacaccgcctga

SEQ ID NO: 7986 - protein, 369 aa, Nocardia farcinica
MYALLLRVMFLVPPERIHHLAFAAMRVAARFAPTRALVRRLAVVDDPILHSTVFGVPFRAPLGLAAGFDKNAEGVDVWGPFGWGFAEIGTVTAQAQPGNPAPRLFRLPADRALINRMGFNNHGAARAAEQLRARTATVPIGANIGKTKVVEPAGAAADYATSAALLGPLADFVVVNVSSPNTPGLRDLQAVESLRPLLRTVLETVADGGRRVPVLVKIAPDLSDEDIDAVADLAVELGLAGIVATNTTIRRDGLHTDPEDVAAMGAGGLSGAPVADRSLEVLRRLYRRVGDRLALISVGGIETPEQAYQRVLAGASLLQGYTGFIYGGPFWTRKIHRGLAELLRRDGYTSLTEAVGAEHRGPRPQADTA

SEQ ID NO: 7987 - DNA, 915 bp, Oceanobacillus iheyensis
  CDS (1)..(915): transl_table=11
atgaatctgtcagtaaaattaccaggattaaacttaaaaaatccgatcatgccggcatctggttgttttgggtttggaaaagaatacagtgagtattatgatttaagtcttttaggtggagtaatgatgaaagcagccactcaatttgaaagattaggtaatccaactccacgtgtcgcagaaactagtgcaggaatgttaaatgcaataggtcttcaaaatccaggagtccaacaaataattgaccatgaagtgccgcgacttgcaaaatacgatacatccattattgcaaatattgctggtagttctattgaggaatatgagtttgtagcagcttcatttaaccaaacaacagatgtagacgcacttgaattaaatatttcttgtccaaatgtaaaagaaggtggaattcaatttggtacagaccctttcatggcaaaaaaggtgacggaagtagtaaagaaagcaagtaacaagcctgtatatgtaaagctttcaccaaatgtgcataatattgtcgagatggcaaaagccgtagaagaagctggtgcagatgggctatcgatgattaacacattgacaggaatgaaaattcatctaccatcacgtaaaccgttaatcgccaataaaaccggtggactgtctggtcctgcaataaagccggttgctattcgtatgatatatgaagtaaggcaacaagtttcgattccgattatcgggatgggtggcatcactagcgcggaagatgttttagagtatctaatagctggggctgatgctgttgcggtcggtactgcgaattttcaaaatccatttgtttgtgtagatataataaatgagttaccagaagtattggagcagtatggatttaattcaatagaagatgttatcgaaaaaagggggattacggtatga

SEQ ID NO: 7988 - protein, 304 aa, Oceanobacillus iheyensis
MNLSVKLPGLNLKNPIMPASGCFGFGKEYSEYYDLSLLGGVMMKAATQFERLGNPTPRVAETSAGMLNAIGLQNPGVQQIIDHEVPRLAKYDTSIIANIAGSSIEEYEFVAASFNQTTDVDALELNISCPNVKEGGIQFGTDPFMAKKVTEVVKKASNKPVYVKLSPNVHNIVEMAKAVEEAGADGLSMINTLTGMKIHLPSRKPLIANKTGGLSGPAIKPVAIRMIYEVRQQVSIPIIGMGGITSAEDVLEYLIAGADAVAVGTANFQNPFVCVDIINELPEVLEQYGFNSIEDVIEKRGITV

SEQ ID NO: 7989 - DNA, 1023 bp, Pseudomonas putida
  CDS (1)..(1023): transl_table=11
atgtataccctggcccgccagctgctgttcaagctttccccggaaacttcccacgacctgtccctggacctgatcggcgccggtggccgtttgggcctcaacggcatgctgtgcaagcaaccggcgtcattgccggtttcggtcatgggcttgaacttcgccaacccggtggggctggcggctggcctggacaagaacggcgcggccatcgacggcttcgcccagctgggcttcggttttgtcgaaatcggcactgtcaccccgcgtccgcagcctggcaaccccaagccacggttgttccgcctgccggaagccacggccatcatcaaccgcatgggcttcaacaacctgggcgttgatcacctgctggggcgcgtacgcgcctcgcgctacaagggggtgctgggcatcaacatcggcaagaacttcgataccccggtcgaacgtgctgtcgatgactacctgatctgcctggacaaggtctacaccgccgccagctacatcacggtcaacgtcagctcgcccaataccccgggcctgcgcagcctgcagttcggcgactcgctcaagcagttgctcgacgccctggccgagcgccgcgaacaactggccggtgcacatggcaagcgcgtgcccctggcaatcaagatcgcgccggacatgagcgacgaagaaacggcgctggtggccgctgcgctgatggagtcgggcatggatgcggtgatcgccaccaacaccacgctgggccgtgaaggtgtcgaagcattgccgtacggtggcgaggcgggcggcctgtcgggcgcaccggtgctggagaagagcacccatatcgtcaaggtgctggcaggtgagctgggcggcaagttgccgatcattgccgccgggggcattaccgaaggccgccatgctgccgagaagatcgcggccggggcgagcctggtgcagatatactcgggcttcatctacaaagggccggcgctgattcgcgaagcggtggatgctatcgcggcaatgccgcggtga

SEQ ID NO: 7990 - protein, 340 aa, Pseudomonas putida
MYTLARQLLFKLSPETSHDLSLDLIGAGGRLGLNGMLCKQPASLPVSVMGLNFANPVGLAAGLDKNGAAIDGFAQLGFGFVEIGTVTPRPQPGNPKPRLFRLPEATAIINRMGFNNLGVDHLLGRVRASRYKGVLGINIGKNFDTPVERAVDDYLICLDKVYTAASYITVNVSSPNTPGLRSLQFGDSLKQLLDALAERREQLAGAHGKRVPLAIKIAPDMSDEETALVAAALMESGMDAVIATNTTLGREGVEALPYGGEAGGLSGAPVLEKSTHIVKVLAGELGGKLPIIAAGGITEGRHAAEKIAAGASLVQIYSGFIYKGPALIREAVDAIAAMPR

SEQ ID NO: 7991 - DNA, 903 bp, Pyrococcus furiosus
  CDS (1)..(903): transl_table=11
atgagcataaaaatagagctttttggaattactttcgaaaatccgctcatattagcctcgggagttgttgacatgacaccagagttgctaagaagagcccacaaagaaggagcaggaggagtagtgactaaatcaatcggaatagaacccagaaaaggatatgataacccaactgtagtagaagtcccatgtggattaataaatgctatgggactaccaaaccctggatggaaagcatttcttgaggaatttgagaaagagtcattcgattttccagttatagtctcaatctttggagggaatcccgaagagtttgcattccttgcggagaaacttgaacgtgtaggagatgcctttgaattgaacttaagttgtccccatgcaaaaggatatggattggagataggacaagatccagaaaacgtatatagggttgttaaagctgttaaagatgttacagataaacccgtaatagcaaaactaactccaaacacgagtgatataaccaagctgggcctagctgcagaaaaagctgaagcagatggagtttctgccataaacacactaaaggctattgcaattgatatctatgctaaaagaccgatactcagcaacaaatttgggggatactctggcccagggatcaaaccaatagcacttagagctgtttatgatctggcttcaaaactagatattccgattattggaatcggaggcataactacttggcaagatgcagtagaattcctattagccggagcttctgcagttcaaattggaactgctgtttatttaaaaggattttctgtatttagggagattgcagaagggattagaaaatacttggaggaagaaggattttccagtgtaaaggaaataatagggcttgcccaaaaagtttaa

SEQ ID NO: 7992 - protein, 300 aa, Pyrococcus furiosus
MSIKIELFGITFENPLILASGVVDMTPELLRRAHKEGAGGVVTKSIGIEPRKGYDNPTVVEVPCGLINAMGLPNPGWKAFLEEFEKESFDFPVIVSIFGGNPEEFAFLAEKLERVGDAFELNLSCPHAKGYGLEIGQDPENVYRVVKAVKDVTDKPVIAKLTPNTSDITKLGLAAEKAEADGVSAINTLKAIAIDIYAKRPILSNKFGGYSGPGIKPIALRAVYDLASKLDIPIIGIGGITTWQDAVEFLLAGASAVQIGTAVYLKGFSVFREIAEGIRKYLEEEGFSSVKEIIGLAQKV

SEQ ID NO: 7993 - DNA, 912 bp, Pyrococcus horikoshii
  CDS (1)..(912): transl_table=11
atggtgaaaaggatgctagaggtaaaactctttggcattagatttgaaaatcccctaatattagcctctggagtagttgacatgacaccggaactactcaggagagcccacaatgaaggagcaggaggagtcgttacaaaatccataggtaaggaacctagaaagggttacgataatccaactatcgttgaactaccctacgggttaataaatgctatgggtctcccaaaccctggatgggaggcatttttaaatgaatttattgatgaaaggtttgactttccagtgatagtttcaatatttggaggcacaccggaagagtttgcatttcttgcagagaagttagaaccagttgcagatgcctttgaattaaatttgagctgtccccatgcgaaaggctatggtatggaaattgggcaagaccctaaaaatgtgtatgaagttgtaaaagctgtcaaggatgtaacagataagccagttatagccaaactaactccaaatgttaatgacataacaaagctcggattagcagcggaaagaggaggagccgatggggtttcagcaattaatactgtgaaagcaatagccattgatatctacgctaagagaccgatacttagcaataaagttggaggatattcagggccggggataaaaccaatagcgcttagggctgtttacgatttagcgaaggttttagatattccagtaattggaattggaggaataactagctggcgggatgctgtagaatttttactagcaggagcatctgcccttcagataggaactgccgtataccttagaggatttaaagtgtttaaggaaatttcgaatgggataattgagtacctcaaggaggagggattctcaagtattagggatatcatcgggctagccctcaaggtttaa

SEQ ID NO: 7994 - protein, 303 aa, Pyrococcus horikoshii
MVKRMLEVKLFGIRFENPLILASGVVDMTPELLRRAHNEGAGGVVTKSIGKEPRKGYDNPTIVELPYGLINAMGLPNPGWEAFLNEFIDERFDFPVIVSIFGGTPEEFAFLAEKLEPVADAFELNLSCPHAKGYGMEIGQDPKNVYEVVKAVKDVTDKPVIAKLTPNVNDITKLGLAAERGGADGVSAINTVKAIAIDIYAKRPILSNKVGGYSGPGIKPIALRAVYDLAKVLDIPVIGIGGITSWRDAVEFLLAGASALQIGTAVYLRGFKVFKEISNGIIEYLKEEGFSSIRDIIGLALKV

SEQ ID NO: 7995 - DNA, 1881 bp, Saccharomyces bayanus
  CDS (569)..(1513)
  misc_feature (201)..(201): n is a, g, c or t
caaaagttcaatggggattaaggcaaaccttaagaattaggaaaagctccggagggtataaggcaaaaaaacatttattgtcttgggggggtaaaaggcttttaatttggaatgggttttaagctcttaatttgaatgtcatcaagcaattttatttcccctctttaaaaatttcgtccatttcagctacagcatgtgtanttgtttaagctgaaatatcgatcagtattcaccaaaatagtgatttacttcattttcacttttcagtatcttttaagatcagtattgttgattggccgtaatagttatttaatctttaaaactacttctcctgccttaacatgtatattcatctatctcgcatcgggcttcgccaaagcctattccaaaattttcggcctttgccgagaatttttcgttatgctcatcaccaggaaatgaaaaaactttatatatggcttatacatttggagcagatctttatcgtttattgtgtggctcgagtccttgatattgttgaatacatattgacgatcggtgaccaaaacacacacacataagacgaaaaatgacggccagcttaactaccaagttcttagacaatacttatgaaaatccatttatgaacgcatcgggtgttcattgtatgactaccccagaactggatgagttagccaactctaaggcaggtgcttttattactaagagtgctacaactttagaaagagaaggtaatcccaaaccacgttatatttccgttcctctaggtagtatcaactctatgggtttaccaaatgaaggtgttgattactatttgtctcacgtactaaaccgccaaaagaagtatcctgatgcacccgcaatcttcttctctgttgctggtatgagtatcgatgagaatctaggcttattgaaaaaaattcaagagagtgaattcaacggaattacagagctaaacttgtcatgtccaaatgttcctggtaaaccacaagtcgcttatgattttgacttaactaaggaaacattggaaaaagtttttgctttctttaataagcctttaggtattaaattgcctccttattttgattttgctcattttgatattatggccaagatcttaaatgagttcccattagcctatgtcaactctatcaacagtgtaggtaatggtctctttatcgatgtagaaaaggaaagtgtagtagtaaaaccaaagaatgggttcggaggtattggtggtgaatacgtcaagccaaccgcacttgctaatgttcgtgcgttttacactcgtttgagacctgaaatcaaaatcattggtactggtggtattaaatccggtaaagatgcatttgaacatttgctatgtggtgcttctatgctacaaattggtacagaattgcaaaaagaaggtgtacaaatctttgaacgtattgaaagagaattgaaggatataatggaagctaagggttatacgtcgatagacgaattccgtggtaagttgaacagtctttaattacacaatgaaaggtgggatatattatgattatcgttgaaatttgtgtagaatagcattttgcatctatgtactgaataatgctaggaacagttgcaaacgctcaattagttgacttgtactcattatctatgatggaacgtagagaggatatcactagtcattgagttattcaatagcactttagatgaatataaatatagattaaaactctgcgatgatcagaaagtagtattgttgcgatgtcatttctatctagtgcgctaattgtcaaaatcaagaaatatgcgaatgattttttatggtacatttttgttattaaaccttttgaaaactgcgtgttatcttctcgtaagtcctgttagtga

SEQ ID NO: 7996 - protein, 314 aa, Saccharomyces bayanus
MTASLTTKFLDNTYENPFMNASGVHCMTTPELDELANSKAGAFITKSATTLEREGNPKPRYISVPLGSINSMGLPNEGVDYYLSHVLNRQKKYPDAPAIFFSVAGMSIDENLGLLKKIQESEFNGITELNLSCPNVPGKPQVAYDFDLTKETLEKVFAFFNKPLGIKLPPYFDFAHFDIMAKILNEFPLAYVNSINSVGNGLFIDVEKESVVVKPKNGFGGIGGEYVKPTALANVRAFYTRLRPEIKIIGTGGIKSGKDAFEHLLCGASMLQIGTELQKEGVQIFERIERELKDIMEAKGYTSIDEFRGKLNSL

SEQ ID NO: 7997 - DNA, 1210 bp, Saccharomyces castellii
  CDS (212)..(1156)
gtcctatttctctaagaaaaattacatttcggagatgtccgagatgaataaaattaataaattatatcttgcatttggaaaatttttattaaatatatatgtataagaagtttactagttatctcaataagatattgcttttctatcactctatcttttcatactctacctagttgttttaacaaactgaacccaaagaacccaaaacaacatgccagcctccctaactacaaagtttttaaatcaaacatatgaaaatcccctaatgaatgcctctggtgttcactgtatgaccaccaaagagctggatgagctagcagcttcaagagctggagctttcataaccaaaagttcgaccactttagaaagagcagggaacccagagccacgttatgtgtctgttccattaggtagtattaattccatgggtttaccaaaccaaggtatagattactatttggaatacgtattagagcgtcaaagaacacatccaaacgagccagctattttcttctctgtggcaggtatgagtattgatgaaaatattaacatgctaaggaaaattcaagatagtgaatttcatggtattactgaactaaatctctcctgtcctaatgttccaggtaagccacaagtagcatacgattttgatttgactaaggaaatcttagataaagtgttccaattctttaagaaaccattggggattaaactaccaccctatttcgattttgcccatttcgatataatggcaggcatcctaaaccaatacccattagcctacgtcaactctataaatagtgttggtaatggtctttacattgacgtggataaggagtctgtagtcgtgaaacctaagaatgggtttggtggtattggtggtgaatatgtgaagcccactgcactcgcaaacgttcgtgccttttacaccagattgaatccaagtatcaagattgttggtacaggtggtattagaaccggtaaggatgtcttcgaacatttgttgtgtggtgcctcgatggttcaaattggtactgagttggtgaaggaaggtgttccaatttttgaacgcttggagagggaattgaaagaagttatggacaagaagggatataccaccattgaagaattccgtgggaaactaaacagtttataggtttgttaaactctaagttattgtgtaattaatcaactaatgcaagtcaagtgt

SEQ ID NO: 7998 - protein, 314 aa, Saccharomyces castellii
MPASLTTKFLNQTYENPLMNASGVHCMTTKELDELAASRAGAFITKSSTTLERAGNPEPRYVSVPLGSINSMGLPNQGIDYYLEYVLERQRTHPNEPAIFFSVAGMSIDENINMLRKIQDSEFHGITELNLSCPNVPGKPQVAYDFDLTKEILDKVFQFFKKPLGIKLPPYFDFAHFDIMAGILNQYPLAYVNSINSVGNGLYIDVDKESVVVKPKNGFGGIGGEYVKPTALANVRAFYTRLNPSIKIVGTGGIRTGKDVFEHLLCGASMVQIGTELVKEGVPIFERLERELKEVMDKKGYTTIEEFRGKLNSL

SEQ ID NO: 7999 - DNA, 1341 bp, Saccharomyces kluyveri
  CDS (1)..(1341)
atgcattcaagacctctaccaacattgggccgtcatgctgctagatctgttttgaattccccgaatttcttcattggcaacagagcctacccgttaaagtctagtgttggtgctaaagctatcctgtacacagctggtatacttggtggtgctttcgcaggctactacctctttaacgccagatctgctatccacgaatacctgctatgtccaatccttagacttgctactcctgatgccgaaaatggtcacagggctggtatcttctgtctcaaatggggattagcacccaagttgttgtttgatgaagatgacgaagtactacatgttaatgtttttggcactaagatgactaatccaattggatgtgctgctggccttgacaaagacgccgaagccattgacggtatcatgcaaggtggttttggatacatggaaattggttctgttacacctttgccacagccaggtaacccaaaaccaaggttttttagattacctcaggatgatgctgtgattaataggtacggtttcaactcatctggtcatgatgctgtgtactcaaacttgtctaaacgtgtcacttcctttttgaagagctattttgccaaggataatgagatcgacaaattgtctctttacaaaaataaactactggcaattaacctgggcaaaaacaagaccggtgacgaagttaaggattatttaaagggtgttgaaaaattccagtcccatgctgatgtcttggttatcaatgtttcttctccaaataccccaggtttaagagatttgcaaaatgagtcaaaattgacggatttgctgtcccaaatcgtacaaaagaggaactcgctaatccaaaacggtaatgttctaggtgctaagactcataagccaccagttttggtcaaaattgcacccgatttaacagaacctgaattggaatctatcgcagtcgctgctaagaagtcgaaggtcgatggtattattgtatcgaatactacgattcaaaggccagactctctagttactagagatgaagctttaaaaagtcaaactggtggattgtccggaaaacccttaaaaccattcgctcttaaagcattaaaaaccgtctacaaatacaccaaggattcagagttagttctagttggctgtggtggcatttcttccgggcaagatgctattgagtttgctaaggcaggcgctactttcgttcagttgtatacctcttatgcctataagggacctggtttaatcgcccatatcaaagatgaagttacagaagaactgaaaaaggaggggaagacttggaatcaaatcatcggagaagacagtaaatag

SEQ ID NO: 8000 - protein, 446 aa, Saccharomyces kluyveri
MHSRPLPTLGRHAARSVLNSPNFFIGNRAYPLKSSVGAKAILYTAGILGGAFAGYYLFNARSAIHEYLLCPILRLATPDAENGHRAGIFCLKWGLAPKLLFDEDDEVLHVNVFGTKMTNPIGCAAGLDKDAEAIDGIMQGGFGYMEIGSVTPLPQPGNPKPRFFRLPQDDAVINRYGFNSSGHDAVYSNLSKRVTSFLKSYFAKDNEIDKLSLYKNKLLAINLGKNKTGDEVKDYLKGVEKFQSHADVLVINVSSPNTPGLRDLQNESKLTDLLSQIVQKRNSLIQNGNVLGAKTHKPPVLVKIAPDLTEPELESIAVAAKKSKVDGIIVSNTTIQRPDSLVTRDEALKSQTGGLSGKPLKPFALKALKTVYKYTKDSELVLVGCGGISSGQDAIEFAKAGATFVQLYTSYAYKGPGLIAHIKDEVTEELKKEGKTWNQIIGEDSK

SEQ ID NO: 8001 - DNA, 1186 bp, Saccharomyces mikatae
  CDS (91)..(1035)
tggatatttatcttttgattcgcaatctttgaaccactggtagtttcaaatagatatagagaaccagtgaatacaccacccatacgaagcatgacagccagtttaactaccaagttcttaaacaacacctatgagaacccatttatgaatgcatctggtgttcattgtatgaccacagaggaattagatgaattagcagactctaaagcgggtgcgttcattacaaagagtgccacgactttagagagagaaggtaaccctaaaccacgttatatttctgtccctctaggcagcatcaactctatgggtttaccaaatgaaggtattgactactatttgtcctacgtactaaatcgtcagaagaagtatcctgacgcacctgctattttcttttctgttgctggtatgagcattgatgaaaacttgaacttgttaaaaaaaattcaagatagtgagtttaacggtattacagagctaaacttgtcctgtccaaacgttcctggtaaaccacaagttgcttatgattttgaattgacaaaggaaacattggaaaaggtctttgtgtttttcaagaagccccttggcattaagttacctccttattttgattttgcccattttgatattatagcgaaaatattgaatgagttccccttggcttatgtcaactctatcaatagtataggtaatggtcttttcattgatgtggagaaggaaagtgtagtagtaaagccaaagaacggtttcggaggtattggaggagaatatgtcaaaccaaccgcgctcgctaatgttcgtgcattttatactcgtttgagacctgatattaaagttatcggtaccggtggtatcaagtctggtaaggatgcatttgagcatcttctgtgtggtgcttctatgctacaaattggtacagaattgcaaaaagaaggcgtcaagatttttgaacgtattgaaaaagaactgaaagacataatggaagctaagggttacacatccatagaccaattccgtgggaagttgaacagtctttaattatctaaattcgtagaaaaaaatgggataggttatggagaccgttaagatatatatacctttacttttatggttatatgatgtcaaaggtagttgatagatgttattccacgattttttacttggtatattcatatctagcaatatatat

SEQ ID NO: 8002 - protein, 314 aa, Saccharomyces mikatae
MTASLTTKFLNNTYENPFMNASGVHCMTTEELDELADSKAGAFITKSATTLEREGNPKPRYISVPLGSINSMGLPNEGIDYYLSYVLNRQKKYPDAPAIFFSVAGMSIDENLNLLKKIQDSEFNGITELNLSCPNVPGKPQVAYDFELTKETLEKVFVFFKKPLGIKLPPYFDFAHFDIIAKILNEFPLAYVNSINSIGNGLFIDVEKESVVVKPKNGFGGIGGEYVKPTALANVRAFYTRLRPDIKVIGTGGIKSGKDAFEHLLCGASMLQIGTELQKEGVKIFERIEKELKDIMEAKGYTSIDQFRGKLNSL

SEQ ID NO: 8003 - DNA, 1841 bp, Saccharomyces paradoxus
  CDS (273)..(1217)
accgctactacctacatttactcctttcatactaatatgtgcttagagccactttcttcatcgggctttaccgaaggttatactccagtcttcggcgtttgccgaaaatttttcaagatgcccatcatcaagaaataaaaaagctttatatatggcatggcatgcaaatcgggaacgggtattcatcttttgaattgcaaagtttgaacctttagaagtctcaaatagatatacacaactagtaagaaaaaaatagagcttccacaccaagcatgacagctagtttaaccaccaagttcttgaacaacacctatgaaaacccatttatgaatgcttccggtgttcattgcatgactacacaggaattagacgaattagcaaactctaaagcaggtgccttcattacaaagagtgctacaaccttagaaagagaaggtaatcctaagccacgttacatttctgtccctctaggcagcatcaactccatgggtttaccaaatgaaggtatcgactactatttgtcctatgtattaaaccgccaaaaggaacatcctgatgcacccgcaattttcttttccgttgctggtatgagcattgatgaaaacttaaatttgttgaggaagattcaagatagcgaattcaacggtattaccgagctaaacttgtcatgtcccaatgttcctggcaagccacaagttgcttacgattttgacttgacaaaggaaacattggacagggtttttgcctttttcaagaaacctcttggaattaaattgcctccttattttgattttgctcattttgatatcatggcaaaaatattgaatgagtttccattagcttatgtcaactctatcaatagtataggaaatggccttttcattgacgtagagaaagagagtgttgtagtaaagccaaagaatggtttcggtggtattggaggtgaatatgtcaagccaactgcgctcgctaatgttcgtgcattttacacccggttgagacctgaaatcaaagttataggtacaggtggaataaaatccggtaaagatgcatttgaacatcttctgtgtggtgcctccatgctacagattggtacagaattgcaaaaagagggcgtcaagattttcgaacgtattgaaaaggaattgaaagacataatggaagctaagggttacacatccatagatcagttccgtgggatgttgaacagcatttaattattggaaatttgagtaaaaatgataagaacaatttactggagatcatttaggattcaatattaagtttaattattttgacgttataataatgttcaatgcaatatgttagagaatgaatttctagaatttccagcagaattttttcatgttaattgtaatttaaagctagagttttaaaatgtagcttttaagtaataatgaataagtaagtagaaattttaataataactttttttaaaataaatttaaataaaatgtaaaattagttagtcttagaattttaagtttaaaatttaaaataatctaaatctcaacaaataaaaaaattgtatactgaaagaaaggcttaaaataatgtttttaacaattaaaaatagtagtggtaatgatataaacaaaaaagcatagaccttaaatacaaaaatacgttgaaacaaagcaattgctaaattggaaaaccaaataaataaaaagtaatggggggataaattttcaaagaaatctgtataaaggtggtttttcaaaaaaaattctaatattccaagtttcaaaaatggcaatatttttttggcaattaaatgccttccgttaaataatttctttgtccctaagaaaaaaatt

SEQ ID NO: 8004 - protein, 314 aa, Saccharomyces paradoxus
MTASLTTKFLNNTYENPFMNASGVHCMTTQELDELANSKAGAFITKSATTLEREGNPKPRYISVPLGSINSMGLPNEGIDYYLSYVLNRQKEHPDAPAIFFSVAGMSIDENLNLLRKIQDSEFNGITELNLSCPNVPGKPQVAYDFDLTKETLDRVFAFFKKPLGIKLPPYFDFAHFDIMAKILNEFPLAYVNSINSIGNGLFIDVEKESVVVKPKNGFGGIGGEYVKPTALANVRAFYTRLRPEIKVIGTGGIKSGKDAFEHLLCGASMLQIGTELQKEGVKIFERIEKELKDIMEAKGYTSIDQFRGMLNSI

SEQ ID NO: 8005 - DNA, 1332 bp, Schizosaccharomyces pombe
  CDS (1)..(1332)
atgtatcaacgatctttgtttcgcggtgtcgctcagggtttaaagcgctcctctgtacgttttcaatctaccagctctggctcttcaaatggcaatttctttctccgtcattggaagcttttgagtgttattggtagttttactgccggcgttgccatttacgacatgtccgatgttcgtagttttatccatggccgcattgaaatgcctctctttcatgctttcaccactcctgagttttctcatcgtgtcgccattctcgctgcctcttggggtataacaccgaaggatcgtgtagctgatgatccatctcttgccgttgaagtttggggtaagaaattttgcaatcccattggtctagctgctggtttcgataaacaagccgatgctatctcaggtttgttgaacttcgggttttcctatcttgaaattggctcggtcacacctaaacctcaacctggtaatcctaaaccacgctatttccgccttaagcctgatttgtctgtaatcaatcgttacggttttaattctatcggccatgatgccatccttgctaagattcaaaagcgcgttcgcaaatacattgctaagacatctcctcaactattaaaacagtttgatgcaaatcccgcttcttgcactgatcccgctgtccttggcgtacctcgtagtttaattcctaacaagttccttggtatcaatttaggcaagaataagaacggtaacgagattgaggattatgttgaaggtgttcgtacctttggtaacttcgctgacattcttgtcattaacgtttcctctcctaatacccctggtcttcgtaacctacaaaagaaatctgccctctcaactttattgactgctgttgtcagtgagcgcaataaattgaactctcctcatcctcccgtacttgtaaaaattgcacctgatttgaacgaagaagaactcacggacattgccgatgtcctcaaaaagtgcaagattgacggtgtgatcgttggtaatactaccgttcaacgccctaagaccctcaaatcaactagccatgttgaagagacgggtggtctttctggacctcctctcaaacctatcgcattaaatactcttcgcacacttcgtaagcatctttcttccgatattcccatcatcggctgtggtggtatttcttctggcaaagatgctattgagtatgctcgtgctggtgcaactatggttcaagtttatactgctttgggatatgatggtcctgtaattgctcacaagattaagcaagagattcttgccgagcttaagggcaaacgttgggttgacataattggcaaggaagaatag

SEQ ID NO: 8006 - protein, 443 aa, Schizosaccharomyces pombe
MYQRSLFRGVAQGLKRSSVRFQSTSSGSSNGNFFLRHWKLLSVIGSFTAGVAIYDMSDVRSFIHGRIEMPLFHAFTTPEFSHRVAILAASWGITPKDRVADDPSLAVEVWGKKFCNPIGLAAGFDKQADAISGLLNFGFSYLEIGSVTPKPQPGNPKPRYFRLKPDLSVINRYGFNSIGHDAILAKIQKRVRKYIAKTSPQLLKQFDANPASCTDPAVLGVPRSLIPNKFLGINLGKNKNGNEIEDYVEGVRTFGNFADILVINVSSPNTPGLRNLQKKSALSTLLTAVVSERNKLNSPHPPVLVKIAPDLNEEELTDIADVLKKCKIDGVIVGNTTVQRPKTLKSTSHVEETGGLSGPPLKPIALNTLRTLRKHLSSDIPIIGCGGISSGKDAIEYARAGATMVQVYTALGYDGPVIAHKIKQEILAELKGKRWVDIIGKEE

SEQ ID NO: 8007 - DNA, 936 bp, Streptococcus pneumoniae
  CDS (1)..(936): transl_table=11
atggtatcaacgaaaacacaaattgctggttttgagtttgacaattgcttgatgaatgcagcaggtgtggcttgtatgacgatagaggagttagaagaggtcaaaaactcagcggcaggaacctttgttactaagacagcgaccttggacttccgtcaggggaatcctgagccacgctaccaagatgttccacttggttccatcaactctatgggcttgccaaataatggcttagactattatttggattatcttttggatttgcaggaaaaagagtcgaaccgaactttcttcttatctctggtcggcatgtctccagaggaaacccatactattttgaaaaaagtccaagagagtgattttcgtggtctgactgagctaaatctttcctgtccaaatgttccaggtaaacctcagattgcctatgattttgagacaacagaccggattttggcagaagtgtttgcttacttcaccaaacctcttggaattaaattgccaccttattttgatattgttcactttgatcaagcggcagctattttcaacaaatatccgctcaagtttgtcaactgcgttaactctagcggaaacggcctctatatagaagacgaatctgtcgttattcggcctaagaatggttttggtggaattggtggagaatacatcaaaccgactgctctagccaatgttcacgccttttatcaacgtttaaatcctcaaatccaaattatcggaacaggtggcgttctgactggtcgagatgcctttgaacacatcctctgtggagcaagtatggtgcaggtgggaacgacccttcacaaagaaggcgtcagtgcttttgaccgcattaccaatgaactgaaagcaatcatggtggaaaaaggctacgagagcttagaagatttccgtgggaaattgcgctatattgactaa

SEQ ID NO: 8008 - protein, 311 aa, Streptococcus pneumoniae
MVSTKTQIAGFEFDNCLMNAAGVACMTIEELEEVKNSAAGTFVTKTATLDFRQGNPEPRYQDVPLGSINSMGLPNNGLDYYLDYLLDLQEKESNRTFFLSLVGMSPEETHTILKKVQESDFRGLTELNLSCPNVPGKPQIAYDFETTDRILAEVFAYFTKPLGIKLPPYFDIVHFDQAAAIFNKYPLKFVNCVNSSGNGLYIEDESVVIRPKNGFGGIGGEYIKPTALANVHAFYQRLNPQIQIIGTGGVLTGRDAFEHILCGASMVQVGTTLHKEGVSAFDRITNELKAIMVEKGYESLEDFRGKLRYID

SEQ ID NO: 8009 - DNA, 903 bp, Thermoplasma acidophilum
  CDS (1)..(903): transl_table=11
atggctgatctctcaacatctgtggccggaatcaggctggagaacccactgatgctggcttctggaattcttgatgaaaatggatacaccatgcttgatgttatgaataacggcgctgcagccgtggtcacgaaatccataggcatggaagagagaaatggttattctgcaccggtaatagttgaatatggtgacagccttatcaacgcggtgggcctttccaatccaggcatagacaatttcgcggaggagataaggatagcaaaaagatccgggaagcccgtcataggaagtgtctttgcctcggacgcggaatcctttgtcaatctcggcaggaaaatgcaggaatatggttgtgatgccgttgaactcaacctgagctgcccgcatgttaagggctttggccttgaggtgggctccgatccggatcttgttgaggatattgtgaatgagatgaaatccaagatcagcgtgcctgtcttcgcgaagctcagcccaaacgtatccgacataatagagatagcgaaggctgcggaaaaggccgatgcgtatgtcctcataaacacggttaaggccatgaagatcgacataagggcgaggatgcccgtccttaccaacgcctatggcggcctgtccgggcctgcaataaagcctgtcggcgttagatatgtatacgaggtgaaaaaggagacgggaaaggatatcataggggtgggcggcataacgacatatgaggacgccgttgaatacataatggccggagcctccgcagttcagataggtactgcgctctataccgtgggaaaatctgtttttcgtaatataatatcccagatgaacacctttatggatgatgagaaattccacagcattcaggatatggtaggggtggcgataagatga

SEQ ID NO: 8010 - protein, 300 aa, Thermoplasma acidophilum
MADLSTSVAGIRLENPLMLASGILDENGYTMLDVMNNGAAAVVTKSIGMEERNGYSAPVIVEYGDSLINAVGLSNPGIDNFAEEIRIAKRSGKPVIGSVFASDAESFVNLGRKMQEYGCDAVELNLSCPHVKGFGLEVGSDPDLVEDIVNEMKSKISVPVFAKLSPNVSDIIEIAKAAEKADAYVLINTVKAMKIDIRARMPVLTNAYGGLSGPAIKPVGVRYVYEVKKETGKDIIGVGGITTYEDAVEYIMAGASAVQIGTALYTVGKSVFRNIISQMNTFMDDEKFHSIQDMVGVAIR

SEQ ID NO: 8011 - DNA, 906 bp, Thermoplasma volcanium
  CDS (1)..(906): transl_table=11
atgtctgatatttcgactacacttgccggaataaaactcgtgaatccttttatggtagcttccggcatactcgatgaaaatggctataccatgaaagaattgctggaacgtggggcagcagccgttgtaacaaaatccattggcatatctgagagggacgggtatccaacgcctgtcatagtagagtatggtgatagtctaataaatgcggttggcctatcaaatcctggcattgaaaactttggcgaagagattaacattgcgaaggaggccaaaagacctataattggaagtgtatttgcatataatgcagaagaattcactaaactttcggtgaagatggaggagtacggcgttgacgcaatagaactaaatttgagctgcccccatgtaaaggggttcggccttgaggttggttctgatccagatctagttgaagatattgttaacgaaattaaatcaaaagtaaaggtgcctgtatttgccaaacttagccctaatgtctccaacataattgaaatagcaaaagctgctgaaaaagcggatgcttatgtgctcataaacactgtaaaggcaatggcaatagatatatactctcgctcgccagtcctatcgaacctctatggtggcctctctggaccagctattaagccggtaggcataagatacgtctatgaagttaagaaagaaactggcaaggaaattataggtgtcggaggaatatcaaactacaaagacgcaatagaatatattatggcaggggcatcagctgtccaaataggaactgccctatacaagtacggaaaaggtattttccgtgaaatggagtggcagctccgcacctttatggatgaagaacggtttgaaaaaatagaggaaatggtcggggtggcgatcaaaagatga

SEQ ID NO: 8012 - protein, 301 aa, Thermoplasma volcanium
MSDISTTLAGIKLVNPFMVASGILDENGYTMKELLERGAAAVVTKSIGISERDGYPTPVIVEYGDSLINAVGLSNPGIENFGEEINIAKEAKRPIIGSVFAYNAEEFTKLSVKMEEYGVDAIELNLSCPHVKGFGLEVGSDPDLVEDIVNEIKSKVKVPVFAKLSPNVSNIIEIAKAAEKADAYVLINTVKAMAIDIYSRSPVLSNLYGGLSGPAIKPVGIRYVYEVKKETGKEIIGVGGISNYKDAIEYIMAGASAVQIGTALYKYGKGIFREMEWQLRTFMDEERFEKIEEMVGVAIKR

SEQ ID NO: 8013 - DNA, 25 bp, Artificial sequence
  primer
atgacagccagtttaactaccaagt

SEQ ID NO: 8014 - DNA, 24 bp, Artificial sequence
  primer
ttaaatgctgttcaacttcccacg

SEQ ID NO: 8015 - protein, 381 aa, Artificial sequence
  consensus sequence
  Variant (3)..(5): Xaa in position 3 to 5 is any amino acid
  Variant (7)..(7): Xaa in position 7 is any amino acid
  Variant (9)..(23): Xaa in position 9 to 23 is any amino acid
  Variant (24)..(27): Xaa in position 24 to 27 is any or no amino acid
  Variant (29)..(32): Xaa in position 29 to 32 is any amino acid
  Variant (34)..(41): Xaa in position 34 to 41 is any amino acid
  Variant (42)..(51): Xaa in position 42 to 51 is any or no amino acid
  Variant (53)..(54): Xaa in position 53 to 54 is any amino acid
  Variant (55)..(55): Xaa in position 55 is any or no amino acid
  Variant (58)..(66): Xaa in position 58 to 66 is any amino acid
  Variant (67)..(76): Xaa in position 67 to 76 is any or no amino acid
  Variant (78)..(79): Xaa in position 78 to 79 is any amino acid
  Variant (82)..(84): Xaa in position 82 to 84 is any amino acid
  Variant (86)..(128): Xaa in position 86 to 128 is any amino acid
  Variant (129)..(189): Xaa in position 129 to 189 is any or no amino acid
  Variant (191)..(191): Xaa in position 191 is any amino acid
  Variant (193)..(194): Xaa in position 193 to 194 is any amino acid
  Variant (197)..(224): Xaa in position 197 to 224 is any amino acid
  Variant (225)..(241): Xaa in position 225 to 241 is any or no amino acid
  Variant (243)..(245): Xaa in position 243 to 245 is any amino acid
  Variant (247)..(248): Xaa in position 247 to 248 is any amino acid
  Variant (250)..(257): Xaa in position 250 to 257 is any amino acid
  Variant (258)..(259): Xaa in position 258 to 259 is any or no amino acid
  Variant (261)..(272): Xaa in position 261 to 272 is any amino acid
  Variant (273)..(284): Xaa in position 273 to 284 is any or no amino acid
  Variant (286)..(302): Xaa in position 286 to 302 is any amino acid
  Variant (303)..(320): Xaa in position 303 to 320 is any or no amino acid
  Variant (323)..(324): Xaa in position 323 to 324 is any amino acid
  Variant (326)..(329): Xaa in position 326 to 329 is any amino acid
  Variant (331)..(331): Xaa in position 331 is any amino acid
  Variant (333)..(348): Xaa in position 333 to 348 is any amino acid
  Variant (349)..(355): Xaa in position 349 to 355 is any or no amino acid
  Variant (357)..(357): Xaa in position 357 is any amino acid
  Variant (360)..(364): Xaa in position 360 to 364 is any amino acid
  Variant (367)..(367): Xaa in position 367 is any amino acid
  Variant (369)..(372): Xaa in position 369 to 372 is any amino acid
  Variant (375)..(380): Xaa in position 375 to 380 is any amino acid
NPXXXAXGXXXXXXXXXXXXXXXXXXXGXXXXKXXXXXXXXXXXXXXXXXXGXXXPRXXXXXXXXXXXXXXXXXXXNXXGLXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXNXXCPXXXXXXXXXXXXXXXXXXXXXXXXXXXXXXXXXXXXXXXXXXXXXPXXXKXXPXXXXXXXXXXAXXXXXXXXXXXXXXXXXXXXXXXXNXXXXXXXXXXXXXXXXXXXXXXXXXXXXXXXXXXXGGXXGXXXXPXAXXXXXXXXXXXXXXXXXXXXXXXGXGGXXXXXDAXEXXXXGAXXXXXXT

SEQ ID NO: 8016 - protein, 24 aa, Artificial sequence
  protein pattern
  Variant (3)..(3): Xaa in position 3 is Ile or Val
  Variant (4)..(8): Xaa in position 4 to 8 is any amino acid
  Variant (9)..(9): Xaa in position 9 is Ala or Val
  Variant (10)..(10): Xaa in position 10 is any amino acid
  Variant (12)..(15): Xaa in position 12 to 15 is any amino acid
  Variant (18)..(19): Xaa in position 18 to 19 is any amino acid
  Variant (20)..(20): Xaa in position 20 is Ile, Leu or Val
  Variant (21)..(21): Xaa in position 21 is any amino acid
  Variant (22)..(22): Xaa in position 22 is Ile, Leu or Val
  Variant (23)..(23): Xaa in position 23 is any amino acid
  Variant (24)..(24): Xaa in position 24 is Ala, Ser or Thr
GGXXXXXXXXEXXXXGAXXXXXXX

SEQ ID NO: 8017 - DNA, 1623 bp, Saccharomyces cerevisiae
  CDS (1)..(1623)
atgatgctaagaactactgcctcacgaaaaattgtgctaaggaggggtctagccagcataaacacagggactaccgttgcatcaaaaaaggcttcgcacaaatttcgcaataccctttggactattgctttgtcagcgacagctttctacgctggaggtatcatatattcgcaaaaaaatgacaaatttggtgactttttctctaataacgttccttttgccgaggatttactagaaacatatgaacactatcacgataggccaacattgtttttagaagattcttgggacggcttgaaggcaaagagcaatgatttattatctggattaactggtagttcacaaacgcgcagatctaatagggaaaatattgaagtaaaaaaaatcttatcattagaaccactaaatattgaaacagaaaattctgatccgcaactgaaagaaatcattggctctttgaatgatctcatcaacagtctaaatgactcaaacctctccatccccgaatcagaattcaattcaatcaaaaaatctaaccagaatatgcttacgaatctatcccaattaaatgaaacgttaaaagaggctttatccaattacatgatacaaagaacatcagaagtaatcacggaattgaacacacaatatgaaaactcgaaaagggagtttgaaaagaatcttcaaaaaaacctattacaagaagtagacgaattcaaagaaaacttgaccaagcaaaaggacaaagaactagaagaaaaattaaaggcgaacgaagaattgttacaagccaaacatgcaaatgaagtgggcttactatccatcactcaagtcaaagaatttaataaaattatcaaagacaaaattgagaaggaaagaaatggcagattagcccatttagaggaaataaattctgaagttaacgacctcagcaaatccatcgacagatcgagcaaaatcttaagtaaaaacgaggctctagtgcaattaactttccaagtagatgagatcaaatctaggattaacaacaataacttacccgatgtgaatatcgacaaggaactatccagattgaaacttctttccaatcttctctctaccttcaacaaaaaatcttgttgcgacgatggcgactgctgctcctgcaaaaagggtaataagaatgaaggcaaggaagggaagatatcatgcaaatgcaaaccaaagacaaaccctccatcgctattaagcgtagctttagatgaattagaatccacatgtagcggtaaaaaaatcttatcgaatgagcagatctataacaggtggaacttactggcagatgactttaagacagcctctttattgccaccaaattccggtattttggggcaattaaccgccaaagttttttcccttttcttattcacaaagacaggtaatccttcaaatgccacggatttcgattctgtttatgcaagagtcggcgataacttgagggtatccaacctcaacgatgctgtagaagaggttgtctccctaaagggttggcctcataaagtttgcgaaagctggatcgaagatgctagaagaaaattagaagtccagcgcctggtagagattcttgactgtgaaataaggacgttgtga

SEQ ID NO: 8018 - protein, 540 aa, Saccharomyces cerevisiae
MMLRTTASRKIVLRRGLASINTGTTVASKKASHKFRNTLWTIALSATAFYAGGIIYSQKNDKFGDFFSNNVPFAEDLLETYEHYHDRPTLFLEDSWDGLKAKSNDLLSGLTGSSQTRRSNRENIEVKKILSLEPLNIETENSDPQLKEIIGSLNDLINSLNDSNLSIPESEFNSIKKSNQNMLTNLSQLNETLKEALSNYMIQRTSEVITELNTQYENSKREFEKNLQKNLLQEVDEFKENLTKQKDKELEEKLKANEELLQAKHANEVGLLSITQVKEFNKIIKDKIEKERNGRLAHLEEINSEVNDLSKSIDRSSKILSKNEALVQLTFQVDEIKSRINNNNLPDVNIDKELSRLKLLSNLLSTFNKKSCCDDGDCCSCKKGNKNEGKEGKISCKCKPKTNPPSLLSVALDELESTCSGKKILSNEQIYNRWNLLADDFKTASLLPPNSGILGQLTAKVFSLFLFTKTGNPSNATDFDSVYARVGDNLRVSNLNDAVEEVVSLKGWPHKVCESWIEDARRKLEVQRLVEILDCEIRTL

SEQ ID NO: 8019 - DNA, 1653 bp, Schizosaccharomyces pombe 972h-
  CDS (1)..(1653)
atgaatcgacagcttagaactgttaaaagttgcttttctttacagaaaacgcaccaatatcgttcgttttggatccaatccagcttaagggcattacctcctgatgtgaagcaaaacaagacggaaccaattccgtttgtaccaaaaccagaggaaggttcatcaaataaatcgaattcctctaaatttcgtaaaagatttcttcttctctttcttttaggcataactggctattcatgcagcgtcgtttattgctttaaagacccaaatttttatgactactttgctgagcatactccttttggtaagcaagtgctatataacgtcgagcaatcatggataggatacaaatatttaggcggtaacagaataaaagtcgatgattcatcccctaaattgaagcagaactccaataatatatctaagaaacaaaattctagtaggaacgacgataccaaggtgaaaaaagatacaactatagaacgacccgagtctttagttgtggaaatagtggatttaccttctgaagtgactaaggatactgcagaagaatctgtatggaaagatattggattggatcaagaaactggtctttcagtaactgccatacccatcattactgaaactttagatcatgctcatgaacaagaaataaaggatcagtcattaagatttgaatcttcattaaacgaagctaatgagttgcatggcaagctttcgaaaattcagcaagagcaagagcatctttttgagcaacgtcttcgtgagaaagttagtgaaatggaaagtaagttggaagctttgcttatagcgagagacgaaaaatggcaatctgcctttgagtctgagaaactacgacttcaaaaacttcatgaagctcgtctacaacaagagcttttcaagcttgcaagtgtttttgaatccaagctgaaaaatgaacttactgagcaagctatcacgttggagaaattacacttacaatctattaaagcccaggtcgaacaagaacgtggttcaaggttgggacgtttacaagagttaagaaattcattccagcaattgcaagaactagttagagttgttttacatgaaaacggccgtgtaactagattagttgatgttagcaatactctagatgatttgaacaaagacatgcgtttccataaactttctgaagttcgtcaacacgtaaatacattaaaagaagccactaaagatgatgagttggctgctttagcatcacgtgttattgagaaaattgtggactccgggccgatcttagacaaagaagagctgcagacgaagtttgacacgttatcaaaggaaatttacaaaacctgtttcctcactacagaaagtggattttttggtcatttgaagagcatcatactgtctcaacttcccgctgctgtatttaagtctcctgatattgtttctgtgaaaaaaacgctggaagacgctcgttctcatctattaaaagatgatcttgatggctctgttcgtgctcttttatcactttcacagtggcctcgtgctctttctcgagattggataaatgcgtgtcgtcgccgtatggaactgcagcaagccatagagatcatcaaggcatctgctactctttcttcacaacttgaagacgcccaacaagcatag

SEQ ID NO: 8020 - protein, 550 aa, Schizosaccharomyces pombe 972h-
MNRQLRTVKSCFSLQKTHQYRSFWIQSSLRALPPDVKQNKTEPIPFVPKPEEGSSNKSNSSKFRKRFLLLFLLGITGYSCSVVYCFKDPNFYDYFAEHTPFGKQVLYNVEQSWIGYKYLGGNRIKVDDSSPKLKQNSNNISKKQNSSRNDDTKVKKDTTIERPESLVVEIVDLPSEVTKDTAEESVWKDIGLDQETGLSVTAIPIITETLDHAHEQEIKDQSLRFESSLNEANELHGKLSKIQQEQEHLFEQRLREKVSEMESKLEALLIARDEKWQSAFESEKLRLQKLHEARLQQELFKLASVFESKLKNELTEQAITLEKLHLQSIKAQVEQERGSRLGRLQELRNSFQQLQELVRVVLHENGRVTRLVDVSNTLDDLNKDMRFHKLSEVRQHVNTLKEATKDDELAALASRVIEKIVDSGPILDKEELQTKFDTLSKEIYKTCFLTTESGFFGHLKSIILSQLPAAVFKSPDIVSVKKTLEDARSHLLKDDLDGSVRALLSLSQWPRALSRDWINACRRRMELQQAIEIIKASATLSSQLEDAQQA

SEQ ID NO: 8021 - DNA, 1890 bp, Gibberella zeae PH-1
  CDS (1)..(1890)
atgttgcgaacttcgcttcagtctgtgagggcttttggcggtaggcccgttgtggccgctgctgcccgccaatggcccattgcggctacgcggactgcctctcttgctggccagcggttttatgctgtcgacaagaagcccgagctcgatcctcttaagcaaccggtattgccaacttcccagactatcacatccgagagaatccacgagaccactatcgacgatgtcggcgagaccaaggctattattggagaggttcccagaacaccccctccccctcctcccgcacctaagaagaagggcttcttccgaagactgaagaactttgtcttcacccttctcgtccttggtgtagttggcttcgctggaggtgtctggtactctcgtgttagcgataacttccacgactttttcactgaatacgtcccattcgccgagcaggctgtcctttacctcgaggagatggattataagaagcgattccctaacgtcaccggccgatccaagacccaggctactgaggatgccgtcagagtccctgctcagagtggtgcttcatggagagttgctgaggccgagcgtcactcaagtgctggccctgttgcatccgctgccaagaaggttaaggagacagtcaagcccaagcccaagcccaaggctcccgccgtggaggccaaggctgttgcgaaggaggaacccgctcccgcccccaaatccaacaccgatttcaaggctcccgaagttaacgagccctccaagatgcctcctctgaagcccattgacctactatcacttgagcatgccagagagcctgttgtccaggacctcgtccacatggtcaatgaccttattctggtcatcaacgctgacggtgctcacggcaagtatggcacctccgtagacaaggccaagagtgaaatcgccaaggttggagagaagcttaagggtatgaagggcgagttcgagaggaaggctgctttgcaagtcagggaaaagatcgaggagttcgacaaggccgccactgacctaattgaccgcgttgagaataccatgattaaccaggagaaccaatggcgacaggactttgaggatgagatgaagaaggtccgagaaaactacgagggccgagtaagcgttcttctggagcgtgagaagaaggtcaacgaagagaagcttcaaaaccagctcgcccagcaggctttggccctcaagaaggagttcaccaaggatatcgagaagcaggttgagcaggagcgtgagagccgcctgggcaagctgaacgctttgtcttctgctgttggagagcttgagaagctcaccaccggttggaacgaagttctcgacaccaacctcaagactcagcaactacacgtcgctgtcgaggctgtccgagccagccttgaagatgaccagcacccccgcccctttatccgcgaactggttgccctccgtgagatcgcttctgacgatcctgttgtcaacgccgccattgcctcagttaaccctgcggcctaccagcgcggcatctctacctcttcccagctgattgaccgtttccgccgtgttgctaacgaggtccgaaaggcttcgctgctacccgacgaggccggtgttgccagccacgcctccagctgggtcctcagccacgttatgttcaagaagcagggtcttgctgacggtaacgatgtggagagcattcttacccgaacccaaacatatctggaagagggtgatctggattctgcggcacgagaaattaacggtttggatggatgggccaagactttgagtaaggattggctgggtgaggttcgcaaggtgttggaggttcagcaggctcttgacgtgattgccacagaggcccgtctgcagagtcttcgtgtggattaa

SEQ ID NO: 8022 - protein, 629 aa, Gibberella zeae PH-1
MLRTSLQSVRAFGGRPVVAAAARQWPIAATRTASLAGQRFYAVDKKPELDPLKQPVLPTSQTITSERIHETTIDDVGETKAIIGEVPRTPPPPPPAPKKKGFFRRLKNFVFTLLVLGVVGFAGGVWYSRVSDNFHDFFTEYVPFAEQAVLYLEEMDYKKRFPNVTGRSKTQATEDAVRVPAQSGASWRVAEAERHSSAGPVASAAKKVKETVKPKPKPKAPAVEAKAVAKEEPAPAPKSNTDFKAPEVNEPSKMPPLKPIDLLSLEHAREPVVQDLVHMVNDLILVINADGAHGKYGTSVDKAKSEIAKVGEKLKGMKGEFERKAALQVREKIEEFDKAATDLIDRVENTMINQENQWRQDFEDEMKKVRENYEGRVSVLLEREKKVNEEKLQNQLAQQALALKKEFTKDIEKQVEQERESRLGKLNALSSAVGELEKLTTGWNEVLDTNLKTQQLHVAVEAVRASLEDDQHPRPFIRELVALREIASDDPVVNAAIASVNPAAYQRGISTSSQLIDRFRRVANEVRKASLLPDEAGVASHASSWVLSHVMFKKQGLADGNDVESILTRTQTYLEEGDLDSAAREINGLDGWAKTLSKDWLGEVRKVLEVQQALDVIATEARLQSLRVD

SEQ ID NO: 8023 - DNA, 1563 bp, Candida glabrata CBS 138
  CDS (1)..(1563)
atgctgagaaccaaaattactggatcttctcatgtcctcaggactgcgttcaagagatattcttcaactatcgatagtggagctgtggaagttgtgaaacctaagaaaacaagtttcacacgccgtctctttagattgggtttagccgtcacggcattctatgctggtggtgttgctgtttctcaatatgatgacgatttaggtactttatttaccgaaaaggtgccgggagctgaaaaactggttgacagttatgtgacttacagatatgatccaacaatttcaaaaatgctatcaaccgagtatcttctaaatttgtttaaaggagaaaatacggaggtgaaaccatcgacaagtagtcgtctcgtgcctatccatgatgcgatcaaagaacttcatttggaactattggaactggattcggagaataattcagagccggaaatgcaaaaaatcataaactccttaaacagtacaattaacatgattaatgagcaaaaattgagaatcgggggtaaaaaatcaagatctatagaagagaattataagcaattgattgaagacattctacatctcgacaaaaacctaaaggaaactgtctcgaaaagtattaatgaaaagactgaagaggttgttaaaaaggtcagagagcaatacaagagaaaacttgctgtttctgaagtcgaactacaagacaaatataagaatgagtttattcatctcaaggaagagatggaaaaacactaccaagatattttgaatcagaagctggaagccaataaacaacatttagaggcgaagcatgccaatgaaattgcattgctttccatcacacaagtaagtgaatttaataaaattattaaggaaaaagttgattcagagaggaatggtagattggcgaaaatcgaggatcttgataagaaggcagagaacctaacagaggctctaaaacatgttaacaaagttgttacaagaaatgaagctgtgaaacaaattgctcaacaaattgaaataattaggtcgaagttgaattcacatgatttaaacagtatctctttgcatgatgatctcacaagattgagaacactaactgatattgcagttccaggaccaaagccatgttgtaaacataaggatttgacaccttctttatttagagttgctctagatgaacttgaatctgttgctggatcttctgagagtaagatactgtctgaagaacagatttacaatagatggaatctattagaatccgacttcaaaacagcatcactattaccaccaaatgctggtatgctaggtcacttcacagcaaaactattctcattgtttttatttaccaaaagaggcagcgccttaccagatgctactgatctagattctgtctttgctagaataaatgaaaatctaagacattctaaattggataaagcagtagcagatgttgtcacattaaaaggatggacgcatgtcttatgtgatgattggttaaagaatgcaagaaggaaacttgaagtagagaaacttgtggatgtgcttgactccgaattgaagtctttgtga

SEQ ID NO: 8024 - protein, 520 aa, Candida glabrata CBS 138
MLRTKITGSSHVLRTAFKRYSSTIDSGAVEVVKPKKTSFTRRLFRLGLAVTAFYAGGVAVSQYDDDLGTLFTEKVPGAEKLVDSYVTYRYDPTISKMLSTEYLLNLFKGENTEVKPSTSSRLVPIHDAIKELHLELLELDSENNSEPEMQKIINSLNSTINMINEQKLRIGGKKSRSIEENYKQLIEDILHLDKNLKETVSKSINEKTEEVVKKVREQYKRKLAVSEVELQDKYKNEFIHLKEEMEKHYQDILNQKLEANKQHLEAKHANEIALLSITQVSEFNKIIKEKVDSERNGRLAKIEDLDKKAENLTEALKHVNKVVTRNEAVKQIAQQIEIIRSKLNSHDLNSISLHDDLTRLRTLTDIAVPGPKPCCKHKDLTPSLFRVALDELESVAGSSESKILSEEQIYNRWNLLESDFKTASLLPPNAGMLGHFTAKLFSLFLFTKRGSALPDATDLDSVFARINENLRHSKLDKAVADVVTLKGWTHVLCDDWLKNARRKLEVEKLVDVLDSELKSL

SEQ ID NO: 8025 - DNA, 1608 bp, Kluyveromyces lactis NRRL Y-1140
  CDS (1)..(1608)
atgttccgtgcaagcaaagctcttggtcagaggtttgcctctaccaacgttccagttaaaacggcccgtcccttcagaaactttctatggaaattaggtgctgctactactgtcttctacgtcggcggggtggccttgtccacttataactatcaattcgctgaattgttcaccgataatgttccattggctgaagaattggttcaattggttgaatcgtataacgatggaactttgaacgctcctcaattgtctctggatgagattagaaagaagttcggatcgatcacaaggaaagtacaaagtgttcctcatctgggatccacctcttccactgtcactgaatctcaatcgattgcctccgggtccggttctactgcggcagcagcaaccacaggcacggattctaattccgtggtattatcctctgttccacctgttggctccgtgttgttgagattacctcatttgaaactcgacgatgattcaaactcctttaacaacaagtcctttgtcgagtctttcaacaagcaagttgattcactcaacgaaaaagagtttatacttccagaaaatgcagtagaatcattcctagaatcgtaccatggcttatccagtcaattgaacgaattgaatagagacttggctgatcaattgaactctcaattaggtcaactttctgcggaattgaaacaatcagttgaatctgataaagtgaaagaaattgaatcaaataagttgcaattgatgcaacaatttgaaaaggatttatccaacttgaaagtagaattcgaacagaaatttgattctcaattgcaatcctctttgaaggcgaacgaacaggcgatgcttgctaagcataagaacgaattagccatgctatccattaaacaagtgcaagaatttaacaagattatttccaataagattgaaaatgaaagaaacgggaggttaaagaatttggatgaattaaacggctctgtgaaaactgtttctgattccttagccgctttggaagaaactttactcagatccgaatgtgttaaccagttgaccaacttggtctcatctatcaaattcaagttgaatttggataacactccatcccttgacatttccaaagatcttcaaaagttgaccaccttagtcaatatcttgcctggtaagccaaacaaatgtgacgccaaggaacctcagttgattgatgttgtcgttaacgaattgaactctttgacctctgccaaagaaaacaagcaaattctatctaacgaacaacttctaaacagatggggcttgctccaagacaaaatcagagaagcgtcactattacccccaaacgcaggtttcctaggccacgtctcggctaagttcttctcattgttcctatttaataaatcaggcatttctaacgaaaatgatatcgactccgtcatctctcgggtcacagaaaacatcaaactcaacagacttgacaaggcagtcgaagatgtcgtgcaactacaaggctggtctagactagaagctgacgattggctacaagcagctcgttccaaactggaacttgaaactttggttgatgttgttgatcacgaaattaaaactctatga

SEQ ID NO: 8026 - protein, 535 aa, Kluyveromyces lactis NRRL Y-1140
MFRASKALGQRFASTNVPVKTARPFRNFLWKLGAATTVFYVGGVALSTYNYQFAELFTDNVPLAEELVQLVESYNDGTLNAPQLSLDEIRKKFGSITRKVQSVPHLGSTSSTVTESQSIASGSGSTAAAATTGTDSNSVVLSSVPPVGSVLLRLPHLKLDDDSNSFNNKSFVESFNKQVDSLNEKEFILPENAVESFLESYHGLSSQLNELNRDLADQLNSQLGQLSAELKQSVESDKVKEIESNKLQLMQQFEKDLSNLKVEFEQKFDSQLQSSLKANEQAMLAKHKNELAMLSIKQVQEFNKIISNKIENERNGRLKNLDELNGSVKTVSDSLAALEETLLRSECVNQLTNLVSSIKFKLNLDNTPSLDISKDLQKLTTLVNILPGKPNKCDAKEPQLIDVVVNELNSLTSAKENKQILSNEQLLNRWGLLQDKIREASLLPPNAGFLGHVSAKFFSLFLFNKSGISNENDIDSVISRVTENIKLNRLDKAVEDVVQLQGWSRLEADDWLQAARSKLELETLVDVVDHEIKTL

SEQ ID NO: 8027 - DNA, 1737 bp, Debaryomyces hansenii CBS767
  CDS (1)..(1737)
atgattcgcacaagtgtacgtagagttgttgttaactcgaacaaatttgatgttcgtagcatctctaattcatcgatacgtttcaatgtaccaaataatcaaagaacaccaccaccagcggtaagaccaccaacgagtccaatcattgtcacagaaggaggacctaaaggtggaagtcaaaaacaaaagaagaaattttcattcgctgggtttttgttcaaaacagcgttttgggcatctgttgtttatgggggaactttatttgttgctaccaaaaatgacaaggttatggactttattatggacaaacaaccaccatattatgaagagttgttgaacgtgattgaacacgggtcaattgaagacttgaagaggcagttgagagacacacaacataagatttccaattttgatttcaagcttccatccaaggccaagattgatgaatttacccacgaattggaatcgaggggtgaaaacttgatcgaggaaaccaagaggaaattgggaaccagcactggtgctaagccaaggcaagcaatcccagaaggaaactctgcacctacaccagccgagcagttacagaaaccagtggaaactattcataagaccgttgaccatttaccattaatccaattagataagggtatcgcgtcatctgttgactcttcaattaagtccaccataaagtcgtttaatgatttaatcttgtctattgacgctggatcccagtctggtaacgaatcgttgatgagagaaattaccgaaaacgttagcaagttgtccagtaaattaaataaattgaccctgagctttgacgaagaattactgagtaaattaaaaatatcgcaaagtgaattgttatcatcttacaccaagaaggaattggaattgactgaaaacttgttacatcaatttcaccacgaaaaggcgcaaatggaaaagaaactcggctccagattggaccaggagattgaagctaccaagcaaaccatttctcaagctgccgttaatgccgtttcgatgatgagagttgaacaaactaagaatttcgagaaattaatcaaaggtaagattgaccaagaaagagatggtagattagccaacttggacaaattgaattcgagaataaccgaattagaaaacttttctacttccttagaatcccaattggttgccaaccaccaaaagtcattaattcaacaatccttaactaaattgaaatcattattgttaggtgcgtcgtcagaacaggaaaaaccaagattgatcagtccttatgttgataacttagcaaaggtttctcatgaatctaaggatgaattgatagcattagccttgcaagacttacaaccattgctttccagagagtcaacccaatctattttgtccacccctcaattgttaacccgttgggaacaattagttcctgaattaagatctgcatccttattacctccaaatgcaggtttattgggccacttgtcgtccatgcttttctccaagttgttgttccctgtcaagggtgctaagcctgatggcaaggatattgaatcagttatcggtagagtcgaatctagtttagccagaggcgaattagatgttgctgtcgaagaagctgccaacttaaagggttggtcaagaaaattagctgatgactgggtcaaagaaggtagaaagaaattagaaattgaatttttgatgaagataatcgatgctgagtcaaaaattttataa

SEQ ID NO: 8028 - protein, 578 aa, Debaryomyces hansenii CBS767
MIRTSVRRVVVNSNKFDVRSISNSSIRFNVPNNQRTPPPAVRPPTSPIIVTEGGPKGGSQKQKKKFSFAGFLFKTAFWASVVYGGTLFVATKNDKVMDFIMDKQPPYYEELLNVIEHGSIEDLKRQLRDTQHKISNFDFKLPSKAKIDEFTHELESRGENLIEETKRKLGTSTGAKPRQAIPEGNSAPTPAEQLQKPVETIHKTVDHLPLIQLDKGIASSVDSSIKSTIKSFNDLILSIDAGSQSGNESLMREITENVSKLSSKLNKLTLSFDEELLSKLKISQSELLSSYTKKELELTENLLHQFHHEKAQMEKKLGSRLDQEIEATKQTISQAAVNAVSMMRVEQTKNFEKLIKGKIDQERDGRLANLDKLNSRITELENFSTSLESQLVANHQKSLIQQSLTKLKSLLLGASSEQEKPRLISPYVDNLAKVSHESKDELIALALQDLQPLLSRESTQSILSTPQLLTRWEQLVPELRSASLLPPNAGLLGHLSSMLFSKLLFPVKGAKPDGKDIESVIGRVESSLARGELDVAVEEAANLKGWSRKLADDWVKEGRKKLEIEFLMKIIDAESKIL

SEQ ID NO: 8029 - DNA, 1692 bp, Yarrowia lipolytica CLIB122
  CDS (1)..(1692)
atgatcagagctacagccatgcaccggtcaattgtgcagcgtcgcatgctgagcaccgcctctcggctccagcaggccgccaagcccgctaccggctccactgttggaacagccaatggcgcctctgctgcctcgggcaagcctcccggagccacctttgagggagcctccaagcagaagaagaagactcacaagttccgaaactttgtgctgctctccacctttgtcggcgccggcgcctttgccggaggtgtttattactcccttcagaacgaccagttccagagcctgtttgtcgagtacgtgcccgcggccgagcacgccatcaactacattgaggagcagcagctgcgatccggccgactcaagatcgcgactcccacctccaagcatgacgttgaccagtccaccgtccgagtgcccaagtccggtgctacctggcgagcggtcgactccaccgatgctgctacttctgccaagtctgcatcttctcccgctgccaacgtggccaaggacgtcgcttcccccgctcctgctgccaccgcctcccctgtctctagtggttcccccaagactgacaacaccaccgtgcccgctgtgcgactggctaacgactctgaccccgccgtcaaggccgccgtccagaccttcaatgatctgatcgccgtggccccctctggtgccgccaagcagctctccgccaaggtctccaccgtggtcgaccagctgcagcacaacgtggcccagatcaagtctgaggccgccgaggaagctaagaactccatcaacaagctcaacagcgagctggccaagctcaaggcttccaccggcgaggaaatctcgtctaaggtgtctgccgccgagcagcagctgcgaaacgagtttgccgctctgcgagcccactctgagaaggtctaccacgaccgtctccgagtcgagattgaggccaccaagtcccttgtttcttctcacgccaacaacctgattcaggccgtcgaggccgagcgacaaaagcagtacgcccaggagattgccgagcgagtcgaaaccgagcgagagggccgtctctccaagctcaaggacctccagacttccctcacccagctgcaggacctggctctcaagaccgagcaggccgttgacgcctccggccgaaccgcagctctgcatcttgccatcgctaagctcaccggtgctctcaagggttccgagcccgtggccctcggcccttacgtcgagtccatccgacgggctgctggtgacgatcctctgctgcaggccgctctggactctattcccgaggtcgctcagaccgagggagttcttacccctgcccagcttaccattcgattcaagctgctcgagcctgagctacgaaagtcctctctggttcctgttaacgccggtgtcgccggtcatctgggctccctcattttctcctctctgctgttcaagaagagcggagtgcccaagggagacgacgtcgagagtgtgcttgctcgagccaacattgctctggagcagggcaagctatacgacgccgtggctgaggtcaacactctcaagggatggccccgaaagctggcctctgactggctggacgagggtcgacgacgaaccgagattgagttcctcgccgacgtcattgccgaggagggcaagctgtacggagctctttctagcaagaagtag

SEQ ID NO: 8030 - protein, 563 aa, Yarrowia lipolytica CLIB122
MIRATAMHRSIVQRRMLSTASRLQQAAKPATGSTVGTANGASAASGKPPGATFEGASKQKKKTHKFRNFVLLSTFVGAGAFAGGVYYSLQNDQFQSLFVEYVPAAEHAINYIEEQQLRSGRLKIATPTSKHDVDQSTVRVPKSGATWRAVDSTDAATSAKSASSPAANVAKDVASPAPAATASPVSSGSPKTDNTTVPAVRLANDSDPAVKAAVQTFNDLIAVAPSGAAKQLSAKVSTVVDQLQHNVAQIKSEAAEEAKNSINKLNSELAKLKASTGEEISSKVSAAEQQLRNEFAALRAHSEKVYHDRLRVEIEATKSLVSSHANNLIQAVEAERQKQYAQEIAERVETEREGRLSKLKDLQTSLTQLQDLALKTEQAVDASGRTAALHLAIAKLTGALKGSEPVALGPYVESIRRAAGDDPLLQAALDSIPEVAQTEGVLTPAQLTIRFKLLEPELRKSSLVPVNAGVAGHLGSLIFSSLLFKKSGVPKGDDVESVLARANIALEQGKLYDAVAEVNTLKGWPRKLASDWLDEGRRRTEIEFLADVIAEEGKLYGALSSKK

SEQ ID NO: 8031 - DNA, 1698 bp, Candida albicans SC5314
  CDS (1)..(1698): transl_table=12
atgattagaattacgagtcgcagcgtgaaaggagctgcaggtattcgtagtgtttcatcaagtactgtgagactcaatattgccccaaaagtagtttcaccaccagttccaccaccagtcaaaccacagggatcagaaattccaccaccgccgccaccaccacctccaaaggctaagagattctcattgtttggatttcttttcaagactactttgttagccactgtggtttatggaggaactttatatgctgccacaaagaatgacaaagttatggattttgtaattgataagcaattaccattccatgaagaattgattgatttaattgagaatggatccaccgaggatttacaagaagcatgggaacaattgaaaaacaaattcacagatgtcaaattgcctactaaagatgacattgacgaacttactcaaaaattggaacacaggggtgaagacataatcaaggaaaccaaaaagaaaatagcttctactcacattgggcataaaagcggtacagacttgactcccactgaacaattacaaagaggtgttgaaattgaaagtgttaaaaaagacgttgcccatttgcctttgattgaattaaattctgaccttggcaagtcggtcgacgaaacagttaagcaaacaattacttcattcaacaactttatacaatcaattgatgccagttcccttgccaccaaagatgacaaactaattacatcgataaacactagtgttaaccaattggcctctagattgaacagcttgaccaaggattttgataatgagttacagaacaaattgaaagtatctcaaacagaattgttttcatcgtttacaaaaaaagaattggaattaaccgagaatttgttgcaccaatttagcacagaaaagcaacaattggaagctaaattgaatcaaaaattgagccaagaaattcaagcagctagagctgctatttcacaagccgcaagtaatgcagttgccatggttagaatcgagcaaactaaaaactttgaaaaattggtctctgagaaattgaacgaagaaagaaatggtagattagccaacttagagaaattgaatgaccgtattgttgaattagagaagtttgctgaaggattcgaaacccaaattgtgtccaatcataaaaaggcaatcattcaccaagctgtgtccaaactcaagtctttattattggctccagctgcaggtgataaaccacaacctatcaaaccatatattgacgagttaaccaaaattgccactgatgacgaagttttggcattagccataaaagatttgagtccattgattactaacgagtctacccattctattttgacgaatgcccagttgttgtctcgttgggaacaattggcaccagaattgagatctgcttcattgttgccaccaaatgcaggtttattaggacacttggcatcaattgttttttctaaacttttattaccagtgaaaggtgttaaagaagatggcaaagatattgaatctgtcattggaagagtagaatcaagtttggccagaggtgaattggatattgcagttgaagaagctgctaacttgaaaggatggagtagaaagcttgccaatgattgggttgttgaaggcagaaagagacttgaaattgagttcctacttggtttaattgaaagcgaatcaaagattatttaa

SEQ ID NO: 8032 - protein, 565 aa, Candida albicans SC5314
MIRITSRSVKGAAGIRSVSSSTVRLNIAPKVVSPPVPPPVKPQGSEIPPPPPPPPPKAKRFSLFGFLFKTTLLATVVYGGTLYAATKNDKVMDFVIDKQLPFHEELIDLIENGSTEDLQEAWEQLKNKFTDVKLPTKDDIDELTQKLEHRGEDIIKETKKKIASTHIGHKSGTDLTPTEQLQRGVEIESVKKDVAHLPLIELNSDLGKSVDETVKQTITSFNNFIQSIDASSLATKDDKLITSINTSVNQLASRLNSLTKDFDNELQNKLKVSQTELFSSFTKKELELTENLLHQFSTEKQQLEAKLNQKLSQEIQAARAAISQAASNAVAMVRIEQTKNFEKLVSEKLNEERNGRLANLEKLNDRIVELEKFAEGFETQIVSNHKKAIIHQAVSKLKSLLLAPAAGDKPQPIKPYIDELTKIATDDEVLALAIKDLSPLITNESTHSILTNAQLLSRWEQLAPELRSASLLPPNAGLLGHLASIVFSKLLLPVKGVKEDGKDIESVIGRVESSLARGELDIAVEEAANLKGWSRKLANDWVVEGRKRLEIEFLLGLIESESKII

SEQ ID NO: 8033 - DNA, 1704 bp, Candida albicans SC5314
  CDS (1)..(1704): transl_table=12
atgattagaattacgagtcgcagcgtgaaaggagctgcaggtattcgtagtgtttcatcaagtactgtgagattcaataatgccccaaaagtagtttcaccaccagttccaccaccagtcaaaccacagcgatcagaaattccaccaccgccgccaccaccacctccacctccaaaggctaagagattctcattgtttggatttcttttcaagactactttgttagccacggtggtttatggaggaactttatatgctgccacaaagaatgacaaagttatggattttgtaattgataagcaattaccattccatgaagaattgattgatttaattgagaatggatccaccgaggatttacaagaagcatgggagcatttgaaaaacaaattcacagatgtcaaattgcctactaaagatgacattgacgaacttactcaaaaattggaacacaggggtgaagacataatcaaggaaaccaaaaagaaaatagcttctactcacattgggcataaaagcggtacagacttgactcccactgaacaattacaaagaggtgttgaaattgaaagtgttaaaaaagacgttgcccatttgcctttgattgaattaaattctgaccttggcaagtcggtcgacgaaacagttaagcaaacaattacttcattcaacaactttatacaatcaattgatgccagttcccttgccaccaaagatgacaaactaattacatcgataaacactagtgttaaccaattggcctctagattgaacagcttgaccaaggattttgataatgagttacagaacaaattgaaagtatctcaaacagaattgttttcatcgtttacaaaaaaagaattagaattaaccgagaatttgttgcatcaatttagcacagaaaagcaacaattggaagctaaattgaatcaaaaattgagccaagaaattcaagcagctagagctgctatttcacaagccgcaagtaatgcagttgccatggttagaatcgagcaaactaaaaactttgaaaaattggtctctgagaaattgaacgaagaaagaaatggtagattagccaacttagagaaattgaatgaccgtattgttgaattagagaagtttgctgaaggattcgaaacccaaattgtgtccaatcataaaaaggcaatcattcaccaagctgtgtccaaactcaagtctttattattggctccagctgtaggtgataaaccacaacctatcaaaccatatattgacgagttaaccaaaattgctactgatgacgaagttttagcattagccataaaagatttgagtccattgattactaacgagtctacccattctattttgacgaatgcccagttgttgtctcgttgggaacaattggcaccagaattgagatctgcttcattgttgccaccaaatgcaggtttattaggacacttggcatcaattgttttttctaaacttttattaccagtgaaaggtgttaaagaagatggcaaagatattgaatctgtcattggaagagtagaatcaagtttggccagaggtgaattggatattgcagttgaagaagctgctaacttgaaaggatggagtagaaagcttgccaatgattgggttgttgaaggcagaaagagacttgaaattgagttcctacttggtttaattgaaagcgaatcaaagattatttaa

SEQ ID NO: 8034 - protein, 567 aa, Candida albicans SC5314
MIRITSRSVKGAAGIRSVSSSTVRFNNAPKVVSPPVPPPVKPQRSEIPPPPPPPPPPPKAKRFSLFGFLFKTTLLATVVYGGTLYAATKNDKVMDFVIDKQLPFHEELIDLIENGSTEDLQEAWEHLKNKFTDVKLPTKDDIDELTQKLEHRGEDIIKETKKKIASTHIGHKSGTDLTPTEQLQRGVEIESVKKDVAHLPLIELNSDLGKSVDETVKQTITSFNNFIQSIDASSLATKDDKLITSINTSVNQLASRLNSLTKDFDNELQNKLKVSQTELFSSFTKKELELTENLLHQFSTEKQQLEAKLNQKLSQEIQAARAAISQAASNAVAMVRIEQTKNFEKLVSEKLNEERNGRLANLEKLNDRIVELEKFAEGFETQIVSNHKKAIIHQAVSKLKSLLLAPAVGDKPQPIKPYIDELTKIATDDEVLALAIKDLSPLITNESTHSILTNAQLLSRWEQLAPELRSASLLPPNAGLLGHLASIVFSKLLLPVKGVKEDGKDIESVIGRVESSLARGELDIAVEEAANLKGWSRKLANDWVVEGRKRLEIEFLLGLIESESKII

SEQ ID NO: 8035 - DNA, 1995 bp, Phaeosphaeria nodorum
  CDS (1)..(1995)
atgtgcagtagtttgagacgaccaacacccaccccgtcctccatccacatccccgccatcaggaggcagcccacgatgctgcgcgcctccattctccgggccagtccagccgtgaggccattggcccgccagacccgcccgcaatggcgcgtcgtccagcgctgctacgccgacaacaagaacctgggcgagaccgctgtccccaacccggcgcccaccgtcacgccctcgtccacggagaaggcgaccatcccgtcttccgacatcccgaagcccccgcctgcgcctgagaccgcaggtgcatcgcgctcggcacccaccatacagcccgcaacgacacccccaaccggccctggcagcgcaagcatagcgcccgaccccaagcagcccaagcccaagaagaagggcagaatacggcgcctcttgttctggctcaccatcctgtctggtctcggatacgctggcggtgtgtggtactcgctggtgtcggacaacttccacgacttcttcaccgagtacgttccctatggcgaggatgccgtcgcctacttcgaggagcgcgaattccgcaagcgggttccctggccgtgctgggacagcccccgattgcagccccagaatctcgtgcgaagaacaagttcatcaatcctccggccgcagtgggctgagtggcgcgtgttgccgacgagggccacagcgacctccggaaccaagggcccgcacaccattgctgtttgccgacaacaagtccaaaaccgccggcgggacagccaaagacgtccgaagaacgtgcaggagaagaagcaagaggcggctcagacagcgactgtggtcaaggaggaggctgctgcgcctgccccagcaaaacctgtcaaccacctcgaccatctcgccgtgcccgacgccaacgatgccgtcgtgcaggacgttgtcaagattgtcaacgacatcatcaccgttatcaacgccgactccgcccacgatggcaagtacaactcggccctcgacaaggccaagtctgagcttggacgcgtcgtttccgacatcaacctgatgaaggcgaatctcaggaaggagtcggaagagaaggtcaagtctgcacacgacgagttcgaacaggccgcgaaggaacttgtccagcgcttagaccaccagatgcaggctcaagaggcgcactggaaagaggagtttgagaatgagcgcgaacgcctgtcccaaacatacaaggacaggctgcggtctgagcttgaggccgccgagaaggtctacgagcaaaagaccaagaacgagcttctccagcagagcatccacctccagaagtctttcaccgccagcgtacgcgaacgcgttgaagctgagcgtgacggccgtctcggaaagctcaacgagctctcctcgtccgtacacgaactcgagaagctgaccgccgagtggaactcggttgtcgatgccaacctcaagacacaacatctcgtagttgctgtcgaggccgtcaagtctgcgctcgagacacaagccacgccaaagcctttcgtcaccgagctcgcagctctcaaggaaattgccgccgacgacccggttgtcagcgccgccatcgccagcatcaaccccgccgcctaccaacgcggcatccccagcccagccctgctcatcgaccgcttccgccgcgtcgcagctgaagtcaggaaagctgcgcttctccccgaagacgccggcgtcgcctcacatatcgcctcccttgccatgtccaaggtcctcttcaagaagtccggtcttgctgtcggtcaggatgtcgaagccgtccttgcgcgcacagaggtcctgctcgaagaaggcgacctcgacgccgcagcacgcgagatgaacggcctgcaaggctgggccaaggtgctgagcaaagactggctgggtgagtgcagaagagtattggaggtcaggcaggcgctggatgttattgctaccgaggcgcggttgaatagtttacttgtggactag

SEQ ID NO: 8036 - protein, 664 aa, Phaeosphaeria nodorum
MCSSLRRPTPTPSSIHIPAIRRQPTMLRASILRASPAVRPLARQTRPQWRVVQRCYADNKNLGETAVPNPAPTVTPSSTEKATIPSSDIPKPPPAPETAGASRSAPTIQPATTPPTGPGSASIAPDPKQPKPKKKGRIRRLLFWLTILSGLGYAGGVWYSLVSDNFHDFFTEYVPYGEDAVAYFEEREFRKRVPWPCWDSPRLQPQNLVRRTSSSILRPQWAEWRVLPTRATATSGTKGPHTIAVCRQQVQNRRRDSQRRPKNVQEKKQEAAQTATVVKEEAAAPAPAKPVNHLDHLAVPDANDAVVQDVVKIVNDIITVINADSAHDGKYNSALDKAKSELGRVVSDINLMKANLRKESEEKVKSAHDEFEQAAKELVQRLDHQMQAQEAHWKEEFENERERLSQTYKDRLRSELEAAEKVYEQKTKNELLQQSIHLQKSFTASVRERVEAERDGRLGKLNELSSSVHELEKLTAEWNSVVDANLKTQHLVVAVEAVKSALETQATPKPFVTELAALKEIAADDPVVSAAIASINPAAYQRGIPSPALLIDRFRRVAAEVRKAALLPEDAGVASHIASLAMSKVLFKKSGLAVGQDVEAVLARTEVLLEEGDLDAAAREMNGLQGWAKVLSKDWLGECRRVLEVRQALDVIATEARLNSLLVD

SEQ ID NO: 8037 - DNA, 1824 bp, Aspergillus oryzae
  CDS (1)..(1824)
atgccaaacctcctaccagtgcccctacccctgtctccccatcatccgaaacacccatccccccggagactattcctaagccatcgcctagtgagcaaggttcgattcctatcgtcaattgaatacatcgactcctccgatgctaaagtatgcgcagattctcagactcctccaccacccccacccgccccggctcgtaaaacgggacgtttccgaagattccttctctacctgattctcacatctggtttcgcctacggtggaggtgtcttccttgccttgaagtctgacaacttccatgacttcttcaccgaatacattccgtacggtgaagaggccgttctttacttcgaggaacgggacttctatcgtcgtttcccgaacaccctgaagggccaggcccgcatctctggacacaaggatgagagcaagaaggttacaatcccaagagagagtggcctgacttcgaaggctgcagaggagcagggttctggaagcgatctttcccaaaaagggccccatatgagtgctgtcaagggtgacgaagcccaaatcaagaccgagagtgctaagcctgaacataagactgccgccgtggagaaggcgaagagtgacaaagccgctaaggatcaggcacccaagaccagtgataagaacgccgaggaacctagacaaccagcactgcctgccgtgacaaccttggaatttgctcaggtcaatgagggagatgaagccattgtgcaagagttggtgaagactttcaacgatattatcactgttattagtgccgatgagaactctggcaagtattctacacctgtcgccaaagccaaggaggagctccagaagattggggagaagatcattgccgtcagagaagaagcccgtcgcgcagcgcaggaggagatcaccaaagcccatgccaccttcgacgaatctgctcgcgagcttatccgccggtttgaggagtgtcgcgcggctgatgctgctcagttccgggaggagtttgagtcggagcgggagaagctggcttttgcttaccaagagaagatccagactgagctgcagagagctcaagaagttgctgaacagcgtcttcagaatgaattggttgaacaagccattgaactcaatcgcaagtacctccacgaagtgaaggatcttgttgagcgagagcgtgagggccgtcttagcaagcttaacgaactgaccgccaacgttagcgagctggaaaagcttactagcagttggaaggacgtgatcgatactaacctgaagacccagcaacttcaagtcgctgtggatgcagtccgctccgtccttgagcgctcttcgacccctcgtccatttgttcgggagcttgttgctgtgaaggaactggctgccgatgaccctgtggttgaggctgcgattgcatctatcaaccctacagcataccagcgtggcattccctcgaagtctcagatcattgaacgtttccgccgcgtcgctgatgaggttcgcaaggcaagccttctgcctgaggatgcgggcattgctagccacgctgccagcctcgtcttgagcaaggtcatgttcaagaaggaccctgtcgcccacagcgatgatgttgagagtgttcttgttcgcactgaaagcctcctggaaaagggcgaccttgatgccgctgcacgtgagatgaacagtctgaaggggtgggcaaagattttgagcaaggattggctcggagacgtgcgcagggtcctggaagtgaagcaagcactagaggtatggttcctaaacacaaagtcacttctcgtcaacaattccaagctaactcattga

SEQ ID NO: 8038 - protein, 607 aa, Aspergillus oryzae
MPNLLPVPLPLSPHHPKHPSPRRLFLSHRLVSKVRFLSSIEYIDSSDAKVCADSQTPPPPPPAPARKTGRFRRFLLYLILTSGFAYGGGVFLALKSDNFHDFFTEYIPYGEEAVLYFEERDFYRRFPNTLKGQARISGHKDESKKVTIPRESGLTSKAAEEQGSGSDLSQKGPHMSAVKGDEAQIKTESAKPEHKTAAVEKAKSDKAAKDQAPKTSDKNAEEPRQPALPAVTTLEFAQVNEGDEAIVQELVKTFNDIITVISADENSGKYSTPVAKAKEELQKIGEKIIAVREEARRAAQEEITKAHATFDESARELIRRFEECRAADAAQFREEFESEREKLAFAYQEKIQTELQRAQEVAEQRLQNELVEQAIELNRKYLHEVKDLVEREREGRLSKLNELTANVSELEKLTSSWKDVIDTNLKTQQLQVAVDAVRSVLERSSTPRPFVRELVAVKELAADDPVVEAAIASINPTAYQRGIPSKSQIIERFRRVADEVRKASLLPEDAGIASHAASLVLSKVMFKKDPVAHSDDVESVLVRTESLLEKGDLDAAAREMNSLKGWAKILSKDWLGDVRRVLEVKQALEVWFLNTKSLLVNNSKLTH

SEQ ID NO: 8039 - DNA, 24 bp, Artificial sequence
  primer
atgatgctaagaactactgcctca

SEQ ID NO: 8040 - DNA, 25 bp, Artificial sequence
  primer
tcacaacgtccttatttcacagtca

SEQ ID NO: 8041 - protein, 559 aa, Artificial sequence
  consensus sequence
  Variant (2)..(2): Xaa in position 2 is any amino acid
  Variant (4)..(11): Xaa in position 4 to 11 is any amino acid
  Variant (13)..(22): Xaa in position 13 to 22 is any amino acid
  Variant (23)..(23): Xaa in position 23 is any or no amino acid
  Variant (25)..(26): Xaa in position 25 to 26 is any amino acid
  Variant (28)..(33): Xaa in position 28 to 33 is any amino acid
  Variant (35)..(104): Xaa in position 35 to 104 is any amino acid
  Variant (105)..(170): Xaa in position 105 to 170 is any or no amino acid
  Variant (172)..(173): Xaa in position 172 to 173 is any amino acid
  Variant (175)..(223): Xaa in position 175 to 223 is any amino acid
  Variant (224)..(225): Xaa in position 224 to 225 is any or no amino acid
  Variant (227)..(245): Xaa in position 227 to 245 is any amino acid
  Variant (246)..(253): Xaa in position 246 to 253 is any or no amino acid
  Variant (255)..(268): Xaa in position 255 to 268 is any amino acid
  Variant (270)..(285): Xaa in position 270 to 285 is any amino acid
  Variant (287)..(309): Xaa in position 287 to 309 is any amino acid
  Variant (312)..(312): Xaa in position 312 is any amino acid
  Variant (316)..(317): Xaa in position 316 to 317 is any amino acid
  Variant (319)..(320): Xaa in position 319 to 320 is any amino acid
  Variant (322)..(327): Xaa in position 322 to 327 is any amino acid
  Variant (329)..(358): Xaa in position 329 to 358 is any amino acid
  Variant (360)..(386): Xaa in position 360 to 386 is any amino acid
  Variant (387)..(429): Xaa in position 387 to 429 is any or no amino acid
  Variant (431)..(442): Xaa in position 431 to 442 is any amino acid
  Variant (443)..(445): Xaa in position 443 to 445 is any or no amino acid
  Variant (447)..(450): Xaa in position 447 to 450 is any amino acid
  Variant (452)..(454): Xaa in position 452 to 454 is any amino acid
  Variant (456)..(465): Xaa in position 456 to 465 is any amino acid
  Variant (471)..(472): Xaa in position 471 to 472 is any amino acid
  Variant (475)..(477): Xaa in position 475 to 477 is any amino acid
  Variant (479)..(484): Xaa in position 479 to 484 is any amino acid
  Variant (486)..(492): Xaa in position 486 to 492 is any amino acid
  Variant (494)..(498): Xaa in position 494 to 498 is any amino acid
  Variant (499)..(500): Xaa in position 499 to 500 is any or no amino acid
  Variant (502)..(503): Xaa in position 502 to 503 is any amino acid
  Variant (506)..(507): Xaa in position 506 to 507 is any amino acid
  Variant (509)..(512): Xaa in position 509 to 512 is any amino acid
  Variant (514)..(517): Xaa in position 514 to 517 is any amino acid
  Variant (520)..(520): Xaa in position 520 is any amino acid
  Variant (522)..(527): Xaa in position 522 to 527 is any amino acid
  Variant (529)..(529): Xaa in position 529 is any amino acid
  Variant (532)..(534): Xaa in position 532 to 534 is any amino acid
  Variant (536)..(537): Xaa in position 536 to 537 is any amino acid
  Variant (540)..(543): Xaa in position 540 to 543 is any amino acid
  Variant (545)..(546): Xaa in position 545 to 546 is any amino acid
  Variant (549)..(558): Xaa in position 549 to 558 is any amino acid
YXGXXXXXXXXDXXXXXXXXXXXPXXEXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXIXXXXXXXXXXXXXXXXXXXXXXXXXXXXXXXXXXXXXXXXXXXXXXXXXXXEXXXXXXXXXXXXXXXXXXXXXXXXXXXFXXXXXXXXXXXXXXLXXXXXXXXXXXXXXXXNXXXXXXXXXXXXXXXXXXXXXXXERXGRLXXLXXLXXXXXXLXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXAXXXXXXXXXXXXXXXIXXXXQXXXRXXXXXXXXXXASLLPXXAGXXXHXXXXXXSXXXXXXXGXXXXXXXDXXSVXXRXXXXLXXXXLDXAXXXXXXLXGWXXXLXXDWXXXXRXXLEXXXXXXXXXXE

SEQ ID NO: 8042 - protein, 57 aa, Artificial sequence
  protein pattern
  Variant (2)..(2): Xaa in position 2 is Phe, Ile, Leu or Val
  Variant (3)..(3): Xaa in position 3 is Asp or Glu
  Variant (4)..(4): Xaa in position 4 is Ala or Ser
  Variant (6)..(6): Xaa in position 6 is any amino acid
  Variant (7)..(7): Xaa in position 7 is Ala, Gly, Ser or Val
  Variant (9)..(12): Xaa in position 9 to 12 is any amino acid
  Variant (13)..(14): Xaa in position 13 to 14 is any or no amino acid
  Variant (16)..(17): Xaa in position 16 to 17 is any amino acid
  Variant (18)..(19): Xaa in position 18 to 19 is any or no amino acid
  Variant (21)..(22): Xaa in position 21 to 22 is any amino acid
  Variant (24)..(24): Xaa in position 24 is Ala or Val
  Variant (25)..(25): Xaa in position 25 is any amino acid
  Variant (26)..(26): Xaa in position 26 is Asp or Glu
  Variant (27)..(27): Xaa in position 27 is any amino acid
  Variant (28)..(28): Xaa in position 28 is Ala, Asn or Val
  Variant (29)..(29): Xaa in position 29 is Gly, Asn, Gln, Ser or Thr
  Variant (31)..(31): Xaa in position 31 is any amino acid
  Variant (34)..(34): Xaa in position 34 is Ala, Pro, Ser or Thr
  Variant (35)..(35): Xaa in position 35 is His, Lys or Arg
  Variant (36)..(37): Xaa in position 36 to 37 is any amino acid
  Variant (38)..(38): Xaa in position 38 is Ala, Cys or Ser
  Variant (39)..(39): Xaa in position 39 is any amino acid
  Variant (40)..(40): Xaa in position 40 is Asp or Ser
  Variant (42)..(42): Xaa in position 42 is Ile, Leu or Val
  Variant (43)..(43): Xaa in position 43 is any amino acid
  Variant (44)..(44): Xaa in position 44 is Ala, Asp, Glu or Asn
  Variant (45)..(45): Xaa in position 45 is Ala, Cys, Gly or Val
  Variant (47)..(49): Xaa in position 47 to 49 is any amino acid
  Variant (51)..(51): Xaa in position 51 is Ile, Leu or Val
  Variant (52)..(53): Xaa in position 52 to 53 is any amino acid
  Variant (54)..(54): Xaa in position 54 is Ala or Leu
  Variant (55)..(56): Xaa in position 55 to 56 is any amino acid
  Variant (57)..(57): Xaa in position 57 is Ile, Leu or Val
DXXXVXXRXXXXXXLXXXXLXXAXXXXXXLXGWXXXXXXXWXXXXRXXXEXXXXXXX

SEQ ID NO: 8043 - protein, 53 aa, Artificial sequence
  protein pattern
  Variant (2)..(6): Xaa in position 2 to 6 is any amino acid
  Variant (7)..(11): Xaa in position 7 to 11 is any or no amino acid
  Variant (13)..(13): Xaa in position 13 is any amino acid
  Variant (14)..(14): Xaa in position 14 is Ser or Thr
  Variant (15)..(17): Xaa in position 15 to 17 is any amino acid
  Variant (18)..(18): Xaa in position 18 is Ile or Leu
  Variant (19)..(19): Xaa in position 19 is any amino acid
  Variant (20)..(20): Xaa in position 20 is Asp, Glu, Asn, Ser or Thr
  Variant (22)..(22): Xaa in position 22 is Phe or Trp
  Variant (23)..(24): Xaa in position 23 to 24 is any amino acid
  Variant (25)..(25): Xaa in position 25 is Leu or Val
  Variant (26)..(26): Xaa in position 26 is any amino acid
  Variant (27)..(27): Xaa in position 27 is Ala, Asp, Asn, Pro or Ser
  Variant (28)..(28): Xaa in position 28 is Asp, Glu or Lys
  Variant (29)..(29): Xaa in position 29 is Phe, Ile, Leu or Val
  Variant (30)..(30): Xaa in position 30 is Lys or Arg
  Variant (31)..(31): Xaa in position 31 is any amino acid
  Variant (33)..(33): Xaa in position 33 is Ala or Ser
  Variant (37)..(37): Xaa in position 37 is Asp, Glu or Pro
  Variant (38)..(38): Xaa in position 38 is Asp, Glu or Asn
  Variant (39)..(39): Xaa in position 39 is Ala or Ser
  Variant (41)..(41): Xaa in position 41 is Phe, Ile, Leu, Met or Val
  Variant (42)..(42): Xaa in position 42 is Ala or Leu
  Variant (43)..(43): Xaa in position 43 is Gly or Ser
  Variant (44)..(45): Xaa in position 44 to 45 is any amino acid
  Variant (46)..(46): Xaa in position 46 is Ala, Ser or Thr
  Variant (47)..(47): Xaa in position 47 is Ala or Ser
  Variant (48)..(49): Xaa in position 48 to 49 is any amino acid
  Variant (50)..(50): Xaa in position 50 is Phe, Leu or Met
  Variant (52)..(52): Xaa in position 52 is any amino acid
  Variant (53)..(53): Xaa in position 53 is Phe, Leu or Val
SXXXXXXXXXXIXXXXXXXXRXXXXXXXXXXAXLLPXXXGXXXXXXXXXXSXX

SEQ ID NO: 8044 - protein, 28 aa, Artificial sequence
  protein pattern
  Variant (2)..(2): Xaa in position 2 is Ala, Ser, Thr or Val
  Variant (3)..(4): Xaa in position 3 to 4 is any amino acid
  Variant (5)..(5): Xaa in position 5 is Phe or Leu
  Variant (6)..(6): Xaa in position 6 is any amino acid
  Variant (8)..(15): Xaa in position 8 to 15 is any amino acid
  Variant (16)..(17): Xaa in position 16 to 17 is any or no amino acid
  Variant (19)..(20): Xaa in position 19 to 20 is any or no amino acid
  Variant (22)..(22): Xaa in position 22 is Asp, Glu, Gly or Asn
  Variant (23)..(23): Xaa in position 23 is Gly or Ser
  Variant (26)..(27): Xaa in position 26 to 27 is any amino acid
  Variant (28)..(28): Xaa in position 28 is Ile or Leu
QXXXXXKXXXXXXXXXXEXXRXXRLXXX

SEQ ID NO: 8045 - DNA, 2748 bp, Saccharomyces cerevisiae
  CDS (1)..(2748)
atgctccaattcaatacagaaaatgatactgtagctccagtgtttcccatggagcaagatataaatgcagcacctgatgccgtcccactggtgcagacaacaacactacaagtctttgtaaagcttgccgaacccatagtgtttttaaaaggatttgaaactaacggactgtctgaaatagcccccagtatcttacgaggatctcttatcgtcagggtgttgaaaccgaataaattaaaaagtatatcgataaccttcaaaggaatatccagaacagagtggccggaaggtataccaccgaagagagaagaattttcagatgttgaaactgttgtcaatcacacatggccattttatcaggcggatgacggcatgaattctttcaccttagaacatcacagctcaaataattcgtccaatcgcccatctatgagcgatgaagattatctacttgaaaaaagcggtgcttcagtatatatcccaccaaccgctgaaccccctaaagataatagcaatctaagtctggatgcctatgagcgcaactcattgtcatccgataatttgagtaacaagccagtatcaagtgatgtttcccatgacgacagtaaactgttggctattcaaaagacaccattaccatcatctagtcgaagaggatcggtaccggcaaattttcacggtaactctttgtcacctcataccttcatatctgatttgttcacaaaaacattcagtaatagtggcgctactccaagtcctgagcaagaggataactatcttacaccatccaaagattctaaagaagtttttatttttcgaccgggcgattatatttacacttttgaacagccaatatcgcaatcttatccagaaagtataaaagccaattttggttccgtggagtataaactgtcaatagacatagagaggtttggcgcattcaaatcaactatacatactcaattacccatcaaagtcgtaaggcttccttctgatggatccgtagaagagactgaagctattgcaatttccaaggactggaaagatcttcttcattatgacgtggtaattttctcgaaagagatcgttttgaatgcatttttacccatcgatttccatttcgctcctctagataaagttactctgcatcgtattagaatttatctaacagagtctatggaatacacttgtaatagtaatggaaatcacgagaaggctcgtagattagagccaactaaaaagtttctgttggctgaacataacggtcctaaactgcctcatataccagctggttcgaatcctttgaaggctaaaaatagagggaacatcctcttggatgaaaaatccggcgatctagttaacaaagattttcagttcgaggtgtttgtcccaagcaagtttacaaacagtatacggttacaccctgatacaaattatgataaaatcaaagcccaccattggataaaaatttgccttcgtctttccaagaagtacggggacaatagaaaacatttcgaaataagtattgattctccaatccatattttaaatcaactatgctcacacgcgaatactttgctaccgagctacgagagtcatttccagtattgtgatgaagatggtaatttcgcaccagcagcagatcaacaaaattacgcaagtcatcatgattccaatattttcttcccaaaagaagttctttcgtctcccgttctttcacctaacgtgcagaagatgaacattagaataccgtctgatcttccagtagtgcgtaatagagctgaaagcgtaaagaaaagcaagtcagataatacctccaagaagaatgatcaaagtagcaatgtcttcgcatccaaacagctggtcgcaaacatttataagcccaatcagattccaagagaattaacttctcctcaggcgttaccattatcgcccatcacctcaccaattctcaattaccaaccattatcaaactccccgcctccagattttgattttgatctagctaagcgcggcgcagccgattctcatgctattcctgtggatcctccatcatattttgatgtattaaaggccgatgggattgaattgccatactacgatacaagttcatctaaaattcctgaactaaaactaaacaaatctagagagacattggccagcattgaggaggactcattcaatggttggtctcaaattgatgacttatccgacgaagatgacaatgatggcgatatagcatctggtttcaacttcaagctgtcaaccagtgctccgagtgagaacgttaattcacacactcctattttgcagtctttaaacatgagtcttgatgggagaaaaaaaaatcgtgccagtctacacgcaacatcagtgttacctagtacaataagacagaacaatcagcatttcaatgacataaaccagatgctaggcagtagtgacgaagatgcctttcccaaaagccaatcattaaatttcaataagaaactaccaatacttaaaattaatgataacgtcatacaatcaaacagcaatagtaataacagagttgataatccagaagatacagtggattcttcagtcgatattacagcattttatgatccaagaatgtcatcagattccaaatttgattgggaggtaagcaagaaccatgttgacccagcagcctactcggttaacgttgctagtgaaaaccgtgtactggacgactttaagaaagcatttcgcgaaaagagaaaataa

SEQ ID NO: 8046 - protein, 915 aa, Saccharomyces cerevisiae
MLQFNTENDTVAPVFPMEQDINAAPDAVPLVQTTTLQVFVKLAEPIVFLKGFETNGLSEIAPSILRGSLIVRVLKPNKLKSISITFKGISRTEWPEGIPPKREEFSDVETVVNHTWPFYQADDGMNSFTLEHHSSNNSSNRPSMSDEDYLLEKSGASVYIPPTAEPPKDNSNLSLDAYERNSLSSDNLSNKPVSSDVSHDDSKLLAIQKTPLPSSSRRGSVPANFHGNSLSPHTFISDLFTKTFSNSGATPSPEQEDNYLTPSKDSKEVFIFRPGDYIYTFEQPISQSYPESIKANFGSVEYKLSIDIERFGAFKSTIHTQLPIKVVRLPSDGSVEETEAIAISKDWKDLLHYDVVIFSKEIVLNAFLPIDFHFAPLDKVTLHRIRIYLTESMEYTCNSNGNHEKARRLEPTKKFLLAEHNGPKLPHIPAGSNPLKAKNRGNILLDEKSGDLVNKDFQFEVFVPSKFTNSIRLHPDTNYDKIKAHHWIKICLRLSKKYGDNRKHFEISIDSPIHILNQLCSHANTLLPSYESHFQYCDEDGNFAPAADQQNYASHHDSNIFFPKEVLSSPVLSPNVQKMNIRIPSDLPVVRNRAESVKKSKSDNTSKKNDQSSNVFASKQLVANIYKPNQIPRELTSPQALPLSPITSPILNYQPLSNSPPPDFDFDLAKRGAADSHAIPVDPPSYFDVLKADGIELPYYDTSSSKIPELKLNKSRETLASIEEDSFNGWSQIDDLSDEDDNDGDIASGFNFKLSTSAPSENVNSHTPILQSLNMSLDGRKKNRASLHATSVLPSTIRQNNQHFNDINQMLGSSDEDAFPKSQSLNFNKKLPILKINDNVIQSNSNSNNRVDNPEDTVDSSVDITAFYDPRMSSDSKFDWEVSKNHVDPAAYSVNVASENRVLDDFKKAFREKRK

SEQ ID NO: 8047 - DNA, 2877 bp, Magnaporthe grisea 70-15
  CDS (1)..(2877)
atgtctgcagaaagaccccgcggctacagacgtagtcgaacagagcctttctgcaggacagctcacggagccatatattttacacccagggaacagagcgaccggcgatcgattgcggctgcacccgtcactcttcccccacctctgattggccccaggccccgacggccacattcgattcacatcgtctcgtatccagccggtttcatcccgcgtgagctgcgaccaatttcggcggaggagttggcacggagggaacttgcagcttcgggcaggtggaagggaaggaagagaaagcaaaagcaaaacgacaacgtcgataggaagcgggtccattttcagttggaggacggtgcagcaaccagactatttcaaaaagtcctctcggtattttcgacaccaaaggcaccgccccgtccgccgacaccgccgattctccacagcgaggtcgtccagcgaccagaagagggccgggcgcgtagaccggttgactggctcgcagacggtcgactaggccggagattttccaggatagctgacggatttcaaggggacgaatctgtggatttcaacatggtagaccaaatggtacgaccgccgatgatggatttgcgccgtggcgtgggatacgccaacaactccaacaggcatagcatactttcgacgaggtccgcaaagaccgtcatgagctcggccgtcaccgaggtccccaagccagtggcgtccgccagtgggctgagctgctccattctgctcgctgaacagaacgtttttctttctggcttcgaacacgagggccacaaccgcgaatcttcaacccccggtaccgcacttttgcgcggcaaactggtgttgaacgttaacaagaacacaaaactcaagtcaataacgctaaaattagtcggcaaggcgagaactgagtggcccgaaggcatcccgccattgaaagtggatacttttgaggagcagtccctccggacacaggggcttaccttcttccatgccatgcacgatggatgggagacggagtttggcaaccagtgtgtctttaccatgaagacgccgaccaaccaaactcatggacatatactcgagcgactttctcccaacggatcaaatacatccgtaaacacacttgcgagacacagacaatcaacaagcctcacgcctaaggaattaaagagattgtcactgcagtctgtgcagtccaggagtttcggcaagggcgagtcaccacttgcgaaccagacgcaattgaaaggttacaaagtgttcactccgggcacttatgagtactccttcgagctccctatcgaccaccaccagcttgagaccatcaagcttcagtatggctccgtcaagtggaacctggagactgtcatcgagagagccggcgccttcagggccaatctcagcggctccaaggaggtcagcatcgttagggtacctgaccagctgtccctcgaaatgagcgagccaatctcaatatcacgacagtgggaagaccaacttcactacgatatcatgatctccggcaaatcgttccccattggcggcaaaattcccatcgcttttaaactgactccacttgccaaggtgcaagtccacaagatcaaggtgttcgtcaccgaatcgatcgagtactggacaaacgacaaacgtgtcaccaggaaggaccagggcaggaagatcctgctcctggagaagactgctggaaagggaatcgacccgcaatacgcaacaagtgagatcaacgttgtacgtggcggcgagctgacagatgaggaacgcatatacgccagggcggcggctgagaggaggagggctatggatgccgcaaggtctcacaccatgcctgaacccctgccggaatcaacagagaacctgcttggcgatctcgacctgggcttggagtcctactgggcagcaacggaaatggagatgaacgttcagatcccgacttgcgagatgatggcaagagatcgaagcaggaggttacatcccgactgcagctggaagaatgtcaatgtcttccactggatcaagatcgtcatgcgcatctctcgccttgaccccgaagacccaacaggaaaacgccgccgccacttcgagatcagcatcgactcaccattcaccgtgctcaactgccgggccactcaggccaacacttccctcccgcagtactccggctcgcagctatcacaatactgccaagccacaacttgcggttgcccagacgccgccgtcatagcgaccgagccgagccccgccagctcgacgggcaccctccccgtcgtcgaagtcaacccggactcgccgaccgcaccgtctctgccagccactcccccagccgcacacctcgcagctgcgaacccaggaatcggccgctccgacagcagcggcagcggcagcagcagtttccgacccgcgagctcgatgatcgcgaacccgctccagcgcgtgcgcaacaacgagctcccgaccgcgcgtcccatgcacctgatgcgcgtgccatccttcaacccgccgccgttcgatgcggaccagccgccgccagcgctcgacgggctcagcaccccgccgccaaactacgacctaatcattggcacgcccagcgtcgacggcctggcagactactttgctcgtctcgcaaactacgaggatagggaggccggcaggtccgacagcgaagacgacgaagacgacgaagaggcacacacgcctgcgaggctgacggagcgcggagggcgcgtcaacgtagccaaccctcgcaccccgggcgggaggaacgtccccagcaggagtttcgacatccaacgtcccgtcatgaacctcagtatggatggggtcgtggccagggggcagcagagggtttaa

SEQ ID NO: 8048 - protein, 958 aa, Magnaporthe grisea 70-15
MSAERPRGYRRSRTEPFCRTAHGAIYFTPREQSDRRSIAAAPVTLPPPLIGPRPRRPHSIHIVSYPAGFIPRELRPISAEELARRELAASGRWKGRKRKQKQNDNVDRKRVHFQLEDGAATRLFQKVLSVFSTPKAPPRPPTPPILHSEVVQRPEEGRARRPVDWLADGRLGRRFSRIADGFQGDESVDFNMVDQMVRPPMMDLRRGVGYANNSNRHSILSTRSAKTVMSSAVTEVPKPVASASGLSCSILLAEQNVFLSGFEHEGHNRESSTPGTALLRGKLVLNVNKNTKLKSITLKLVGKARTEWPEGIPPLKVDTFEEQSLRTQGLTFFHAMHDGWETEFGNQCVFTMKTPTNQTHGHILERLSPNGSNTSVNTLARHRQSTSLTPKELKRLSLQSVQSRSFGKGESPLANQTQLKGYKVFTPGTYEYSFELPIDHHQLETIKLQYGSVKWNLETVIERAGAFRANLSGSKEVSIVRVPDQLSLEMSEPISISRQWEDQLHYDIMISGKSFPIGGKIPIAFKLTPLAKVQVHKIKVFVTESIEYWTNDKRVTRKDQGRKILLLEKTAGKGIDPQYATSEINVVRGGELTDEERIYARAAAERRRAMDAARSHTMPEPLPESTENLLGDLDLGLESYWAATEMEMNVQIPTCEMMARDRSRRLHPDCSWKNVNVFHWIKIVMRISRLDPEDPTGKRRRHFEISIDSPFTVLNCRATQANTSLPQYSGSQLSQYCQATTCGCPDAAVIATEPSPASSTGTLPVVEVNPDSPTAPSLPATPPAAHLAAANPGIGRSDSSGSGSSSFRPASSMIANPLQRVRNNELPTARPMHLMRVPSFNPPPFDADQPPPALDGLSTPPPNYDLIIGTPSVDGLADYFARLANYEDREAGRSDSEDDEDDEEAHTPARLTERGGRVNVANPRTPGGRNVPSRSFDIQRPVMNLSMDGVVARGQQRV

SEQ ID NO: 8049 - DNA, 2085 bp, Candida glabrata CBS 138
  CDS (1)..(2085)
atgggagttgcagcatgcaccaagggtgatgaggccggtgcgacagcgccgttatcacctagggataagcgatttgatgtgatagataagaaggccaacccagtaataaaaaccaataacattagggcgtatgtgcggtttgtggagaataacgtgtttttgcagggcttcaagaacggccaagatcagttgaaccagaagcctccagtattgctgcgaggatgcctgattttggaagtactgagaccttgcaagcttagtcgcataatgcttacatttcaaggtgacttagaacttcgatggccgcccgacatgaaacaaaatatagacgcttatcatgagaagaagagcctgatgacccaccattgggtttactttgatggtgaaaactcgaataacactccagtagagaacaacgaaaaggatgacatcctgggaagaagtggtgcagcaatttatagagcacctgatgatacagcatcctctaaggaaagtggagactccattgatccagaattaacagactcacaagggccgttcgttttccaaaaaggtgaatatgtgtatacgtttgagcaccctataccgcatttctacccagaaactatgcatatgcctcatgcttctgttaaatattacatgcagttgcgggttgagaaaatcgttggtcatgtaattaaaacaaaaaagattatgatcggtagtaggttcataaatctttatcgtattccaccatctgaccaggtagagcttggagagcctatcgttgtcgataaagtatggaacgacaaacttaaatataaccttatcatacctagaaaggagctagtattaaacgcatttttgcctattcattttgaatttcttcctttggacaaactaataatacacagaatacggatttatttatctgaaacaatcacttatactgctacagataagagtattacaagaattgatagtgaaaaaaactaccttttatcagaactaaatggtcctgttcaggaaggaacagggtcttcaggtaaaaagccaggagtcaaaaacttgggtaatttattagaagatcccaacactggtgatattacaaacaaagcatttcaattcaacatatttgtaccatcatcattcacaagtcctaaggctgactcgacgtcactaaaacaggtcctccatcctgatacaacttttgaaccgatcgtctgtaaacattggttaaaagtagcattaagaattacagttggacctaagcattacgaggtggtaattgactcacccattcatgtacttaatccatactgcgctcatgccaatacgcttctaccaaaatatgatgacttagtgtctagttcattaccggtagatatgacaaatgggtcagacagtcacgattcaaatatcttctatcctaaagagattatacattctcctatattaggttctgaaactgacgatgtgacgtcaaataatgaaaataaggaaaaaaggaaaaaagtcttcaattcgcctactttaaaatccaatatatatagaccagaatttattaagacggaaatgacatcacctcaagctctacctatgttatcacttgagccagacttgggaagcaagccgcctaaatattctgttagcaatgaagatatgccggcatatcctccaagctacgagcaggcacaggttcctagagtatctgttggtgaaatacctcatttgaacctggatgatgaaagcattaacaatagcattagtagcagagaagaagatatcacctcaaacacatttcaaccttccatacaattcagagttccggatgaggaatctaattgttttctaaatggaagactgtcaagaagagcaagtatgccgaactcatacaaccaaaaggatgcgcattatctgttcagaagaaggaaactatcttttgatcacgttactgagcatagtcgtccgagaaatatggaggaaattctagccgcgcacgcggaagatgcctcagactacgaagaagcacttgaatctcctaaggtgctcccgacggatagttctgtagatatagcttcattgctgaaagatcagcacaaataa

SEQ ID NO: 8050 - protein, 694 aa, Candida glabrata CBS 138
MGVAACTKGDEAGATAPLSPRDKRFDVIDKKANPVIKTNNIRAYVRFVENNVFLQGFKNGQDQLNQKPPVLLRGCLILEVLRPCKLSRIMLTFQGDLELRWPPDMKQNIDAYHEKKSLMTHHWVYFDGENSNNTPVENNEKDDILGRSGAAIYRAPDDTASSKESGDSIDPELTDSQGPFVFQKGEYVYTFEHPIPHFYPETMHMPHASVKYYMQLRVEKIVGHVIKTKKIMIGSRFINLYRIPPSDQVELGEPIVVDKVWNDKLKYNLIIPRKELVLNAFLPIHFEFLPLDKLIIHRIRIYLSETITYTATDKSITRIDSEKNYLLSELNGPVQEGTGSSGKKPGVKNLGNLLEDPNTGDITNKAFQFNIFVPSSFTSPKADSTSLKQVLHPDTTFEPIVCKHWLKVALRITVGPKHYEVVIDSPIHVLNPYCAHANTLLPKYDDLVSSSLPVDMTNGSDSHDSNIFYPKEIIHSPILGSETDDVTSNNENKEKRKKVFNSPTLKSNIYRPEFIKTEMTSPQALPMLSLEPDLGSKPPKYSVSNEDMPAYPPSYEQAQVPRVSVGEIPHLNLDDESINNSISSREEDITSNTFQPSIQFRVPDEESNCFLNGRLSRRASMPNSYNQKDAHYLFRRRKLSFDHVTEHSRPRNMEEILAAHAEDASDYEEALESPKVLPTDSSVDIASLLKDQHK

SEQ ID NO: 8051 - DNA, 3222 bp, Candida glabrata CBS 138
  CDS (1)..(3222)
atgcccattgcagattctaactcgccgcttttccccatagggaaggacttgaccatcccaactgatgccaaaccggtggcatccaccgcgtctgtgcagatatatatcaagttggcggagcctgttgtttttctacaggatttcgagaacttgaatcacagcgataagccccccgggatcctgagaggttccttgattttgaggattctgaaacctactaaagtgaagaacctgactttgaacttcaaaggttatgcacgtacagaatggatcgaaggtataccgccaaagaagcaggagtttgccgagattaacgatatcataaatcacacttggccgttctaccagtcctcagagcatcaccactctcatcatgcacattcttcaacggcctctagctctccagctgcaagtaatgcaacttcaaataatagtggatcgaatacaagaacagggactcctggtaacgaggacagtcctgtttataaaggcacaggtgccgcattgtatagacctttaccaagaagtaccagcgaaagagcacttagaactggtgctactcagtcatctacaccaacaaatttctctcctttgaagaataatactgttctgaggtcaaaatcaaaggataatctagatgactttgccagaaagcgtgtcctttctagggcttcatcccattcgactttgactaacaatagttttaacagttccagtaataacaataatggccacaccctaaataaaaccctatcaccaatgagttttttgagaagagctacatcctcgaactctgcccacgcttttggcgtaaatgatacaccttcagcctcacatagaaacggcgcttcaacacctactcatcctgcaccaacaggctcattcatttctgatatattgagcggaaactttgcatctccaggcgattccacaactcataatcatgcaggaaactcctcacaccaagtgaactctaataatcagagtcaacaggctactgcagattttgatccagtaggtgagaatggaacttttcaacctggtgattatatctatccgtttgaacaattgattcctcaatcatacccagaaacagtcaaggctgagttcggatttgttgagtattatttattcgtaagtttggagagacatggtccatttaagtctaatctaactggtagaactccggtcaatatcataagaacacagtctgataactcggtggaagagagtgaaccaataattatctctagggattgggagaatgcgttattttatgatattgtaattggttctaaagatattgtcttagatgcttttttgcctataaattttagactatcaccaatggaaaagctaacattacatagaataagaatttatgttaccgagacaatggaatatttttgcaagaatcagaaggtacataggattgagcccactaaaaagtttttacttgcagaacacaaaggtccaagagtcccaggtttaccgaaagatgcaaattataacaaggctaagaacatgggaaatttgctattagatgaaagttccggggatttggtaaataaagagtttcaataccaactatttgttcctagtaagttcaataatcatcaaaaaatacacccagatacgacgtatgacaatatcaaagccaaccattggatcaagatatgtttacgactctctagagtagtcggagataaaagaaaacattatgaaattagtattgattctccaatgcgtgttttacataagctgtgttcacatgcgaacacactattgccaagctatgaaagtcacttaatcttcaataagcaaaactttactgatagcagttcacaaaagaatagggaaagcaccaatgataatgaacttggtctgtatcatgattctaatattttctttcctaaagaagtcctgatgtcaccattgctgtcgcctgatgttcaggcattggatgtaaacacagaatcgatatataatgcaccataccgtgttatacgtcatgatgagtttgatgactccaggcataaatcaggaaatgatcctagcgcaaatgttttcaattctcccactttgaaatcaaacatttatcaacctgattcaattcaaagagagcttgcctctcctcaagctgtcccactttcgccaatgctatcatcactttcacttactgattttcatcaatcaaaccctcctgatttcgaaagcctggaagaccagctttcagcagcaactactaggtccaattcgccaatgattctaccaaaagatcctcctacctataaagaagctacacacaatgacccttccggtgtggtagcttctgcaagtatacctaaaataaaattgagtcattctcaagagtctctaccgattaataataaaaatcttcgtatcaaagggctgacaccattctcagatactgcctccatagatacgttgagtaatgatagcgatattgcggccggattccaatttagctcttcaccaaatttaacccattcactattgagatctcattcaccatctatgatatccctccatacaggtgagaatgttaagaataccccacgtcttgatgttagccatgataatatgccttctactattagagatgaccgccatttttttaatgacataagtcagattttgggagatgaagcggaagagaacgagaaccatttgaaactgagcaggactcatgaatcatctaatggtgaggcttcagcacgttcatcattcgacatgtctgctattaattttaggaaggatagtgtcacagctgagccattactttccaatcgcaataactctcaaatttctggtattggcaattttgcaatgccatcaaaagaatctttaccattactaggatcacccacagattcttctgttgatataacagcactatatgatagaaactctgctgcctggcatcctctgcaactagagggtgaaataccactctctcctatagtgagtaacgaatcacattcaaacatgttattcaaggcaaatcaaagacctaacgatgatgctacaaatacatctcacgatgacatgctaactagggatgttaatccaaccgatgattcatcaggagggctatcagatacggatcacagaagaacctcacatataggcgagcatgaaaagcccataactaacgcagctgaaacacataaaaatatcaatgcggtagatagtatatga

SEQ ID NO: 8052 - protein, 1073 aa, Candida glabrata CBS 138
MPIADSNSPLFPIGKDLTIPTDAKPVASTASVQIYIKLAEPVVFLQDFENLNHSDKPPGILRGSLILRILKPTKVKNLTLNFKGYARTEWIEGIPPKKQEFAEINDIINHTWPFYQSSEHHHSHHAHSSTASSSPAASNATSNNSGSNTRTGTPGNEDSPVYKGTGAALYRPLPRSTSERALRTGATQSSTPTNFSPLKNNTVLRSKSKDNLDDFARKRVLSRASSHSTLTNNSFNSSSNNNNGHTLNKTLSPMSFLRRATSSNSAHAFGVNDTPSASHRNGASTPTHPAPTGSFISDILSGNFASPGDSTTHNHAGNSSHQVNSNNQSQQATADFDPVGENGTFQPGDYIYPFEQLIPQSYPETVKAEFGFVEYYLFVSLERHGPFKSNLTGRTPVNIIRTQSDNSVEESEPIIISRDWENALFYDIVIGSKDIVLDAFLPINFRLSPMEKLTLHRIRIYVTETMEYFCKNQKVHRIEPTKKFLLAEHKGPRVPGLPKDANYNKAKNMGNLLLDESSGDLVNKEFQYQLFVPSKFNNHQKIHPDTTYDNIKANHWIKICLRLSRVVGDKRKHYEISIDSPMRVLHKLCSHANTLLPSYESHLIFNKQNFTDSSSQKNRESTNDNELGLYHDSNIFFPKEVLMSPLLSPDVQALDVNTESIYNAPYRVIRHDEFDDSRHKSGNDPSANVFNSPTLKSNIYQPDSIQRELASPQAVPLSPMLSSLSLTDFHQSNPPDFESLEDQLSAATTRSNSPMILPKDPPTYKEATHNDPSGVVASASIPKIKLSHSQESLPINNKNLRIKGLTPFSDTASIDTLSNDSDIAAGFQFSSSPNLTHSLLRSHSPSMISLHTGENVKNTPRLDVSHDNMPSTIRDDRHFFNDISQILGDEAEENENHLKLSRTHESSNGEASARSSFDMSAINFRKDSVTAEPLLSNRNNSQISGIGNFAMPSKESLPLLGSPTDSSVDITALYDRNSAAWHPLQLEGEIPLSPIVSNESHSNMLFKANQRPNDDATNTSHDDMLTRDVNPTDDSSGGLSDTDHRRTSHIGEHEKPITNAAETHKNINAVDSI

SEQ ID NO: 8053 - DNA, 2688 bp, Kluyveromyces lactis NRRL Y-1140
  CDS (1)..(2688)
atgtcttttgacctgagtccggtaatgtcaccagtgtttccttcggatattcatttgggaataccgaaggacgctactcctttagcgaaatcaagttctttccaagtatacattcaacttgctgagcctataatctttttgcaagggtttagtccgactcattgggagggaagaccacctgctatactaagaggatcgttgattcttcgagtcttaaaatctacaaaattgaaatctattaatttaacgttcaaaggtacgtcaaagacagaatggcctgaaggtattccaccaaagaagcaagaatttgtagagctcaatgatgttgtgaaacatacgtggccttttttccaaagcgatttgcaaagtgttccaaataaccagtcaacagagcctgctgatttactgaaagggagtaacgcttcgttattcaggcctttgcacgatgatatggataaaccaatggccaggaggcatagtaatgcacagatgcggtctctttctccaatagggaattttttaagatctacttcaaaggacattccaaatgtcaagatggtatctgaaaccttttgcgacatgctttctatttccaattctgttagtgatatttcatcggtgaagtctaacggaaactcgtcttcagcaactcctggtcccttcatatttcatccaggtgattatattttttcctttgagcatgctattccattatcgtatccagagactataactgctacgttcggtcaagttgagtattttttgcttgtgaatatcgaacgtcaaggtgctttcaagtcaggtgtaaacgctaagctacctattacaattgtaaggacaccatccgataactcagtagaagaaactgaacctattgcaatttccagagactggaatactcatttacattatgatatcatgattgtttccaaagacattgtgcttgatgcatttctaccaattgcatttcgaattatgcctatggataaagtcgcgctacacagaataagaatattcttgactgagacattagagtactattgtaaaggcaagaaagttcacaggcttgaaccaactaaaaaattcctactcacggagcatagagctcctcccataaaagatttaccaccagatgcggtacctactaaagctaaatatttgggaaatttattagaagatgaacatggtgatttggtaactagggacttcaaatatcaggtatttttcccagaaaggcttaattaccaacaaaagattcatccggacacttcatatgggaccatcaaatcaaatcattggattaaaattagtttgagattgtcgaagaatgttgatggcgtcaaaaaacacttcgaaataagtattgattcacctattcatgtcttgaataagctttcttctcacgcaaatacattgcttccaagctacgatactcatgccgctattccccacagtggctctgtaccattcggtgattctgattttaatatgtatcatgattcgaatctatatttcccaaaacaagtcattaactcaccagttatgtctccggaagttcaaccattagatgagaaaattggattatcacctgtttcgttaagtcctgtggcccacaacagaaccagtctgagtttactgcagcacagaaatctaagccatagcgaattatcaatatcggaactgaatttaaggaataaagtgttgcagtctccagaattatcctctaatatttaccagcctgagcatattcatgctgaattggcttcacctcaggcattacctttatctccaatttcatctcccacttggaaaccaatatcgctcgcacaaaatcaaaccatagatgcagtgtctctggacgatgagcttccaccatttcaagaagctcttaaagcagagtctctacctgtcgatccacctacatattcggagtcagttgcaactgatggtaagacgacaaagtcaaaagctagcagcgaggcttcatcggtggtggttcctgaaatatgcctttccaatactacagatttggtagatgaagacattgctgcagggttccacttcaatggaaatgatagcggatctttaaatcttccgactgcaatgatgagatcccactcacacaatgataggacagcagtttctcgtaaatcatctgtttctgggaggagacgcagtagcattatcgttcctgattctctaccatctactatcaaaaactcaagcgaatcattcaacgacttggagcacgttctttcagcagctggtaatgatgaaagaaatgggcctaatgaaagtaatggagctggcgaaggtaatgaacaggatgatgtattttctcattcatctgcagacacaattcagaagttggaaccatcacaatcacacactaattcgatttccactcagccgcttctacttcgtcaagtaacaacggaagatgaccaagagagtaaagcgtccatggacctaactgcaatgataggcaaagagcgcacatcttggcacccactgcaaagtgaaccagcgatgtctccattgctttcacaatcatattcgatgaatgttttgcagtccaatcatgctttggaggatttcaagaataacctagaaaggtataatcagcgtgaatctcctgaaccaacaaacatatcagattctatagacaaagatttattaaatatgtag

SEQ ID NO: 8054 - protein, 895 aa, Kluyveromyces lactis NRRL Y-1140
MSFDLSPVMSPVFPSDIHLGIPKDATPLAKSSSFQVYIQLAEPIIFLQGFSPTHWEGRPPAILRGSLILRVLKSTKLKSINLTFKGTSKTEWPEGIPPKKQEFVELNDVVKHTWPFFQSDLQSVPNNQSTEPADLLKGSNASLFRPLHDDMDKPMARRHSNAQMRSLSPIGNFLRSTSKDIPNVKMVSETFCDMLSISNSVSDISSVKSNGNSSSATPGPFIFHPGDYIFSFEHAIPLSYPETITATFGQVEYFLLVNIERQGAFKSGVNAKLPITIVRTPSDNSVEETEPIAISRDWNTHLHYDIMIVSKDIVLDAFLPIAFRIMPMDKVALHRIRIFLTETLEYYCKGKKVHRLEPTKKFLLTEHRAPPIKDLPPDAVPTKAKYLGNLLEDEHGDLVTRDFKYQVFFPERLNYQQKIHPDTSYGTIKSNHWIKISLRLSKNVDGVKKHFEISIDSPIHVLNKLSSHANTLLPSYDTHAAIPHSGSVPFGDSDFNMYHDSNLYFPKQVINSPVMSPEVQPLDEKIGLSPVSLSPVAHNRTSLSLLQHRNLSHSELSISELNLRNKVLQSPELSSNIYQPEHIHAELASPQALPLSPISSPTWKPISLAQNQTIDAVSLDDELPPFQEALKAESLPVDPPTYSESVATDGKTTKSKASSEASSVVVPEICLSNTTDLVDEDIAAGFHFNGNDSGSLNLPTAMMRSHSHNDRTAVSRKSSVSGRRRSSIIVPDSLPSTIKNSSESFNDLEHVLSAAGNDERNGPNESNGAGEGNEQDDVFSHSSADTIQKLEPSQSHTNSISTQPLLLRQVTTEDDQESKASMDLTAMIGKERTSWHPLQSEPAMSPLLSQSYSMNVLQSNHALEDFKNNLERYNQRESPEPTNISDSIDKDLLNM

SEQ ID NO: 8055 - DNA, 2949 bp, Debaryomyces hansenii CBS767
  CDS (1)..(2949)
atgcagacacccaactctccattattccctgctcagaagttgacgttatcacccagcgcagtaagtttgggtggattaaccgggacatcgtctggagttggtagttcaaccttgatacctcagttgcctgataagccgttgacagaaacttcatctatacaggtgtatgtggtaccagcagaaaaggatttgttcatgcaaggatttgagccagaagaatacgaaggtaggccgcctacattattgagaggttgtttgttcttgcgggtacttaaaccgtccaaaattagatcagtgactttaacattcaagggtcaacaacgaacggattggccagaaggtataccacctaaaaaaacttcatatgtggagctaaatgacatattgtctcatacgtggccattctaccagctgggaaatcctctacacagcgctaatggaggagcagacttctttcaagagttactgaaggatcacaattcagaggtggagaactcgactctcaatgtaccactacctgtttcaagatcacgctctcctgcagcagagaacggacttggtaactttttcaccagaaatttgtcaccagctaccagttttatgaggagagccgcatcaccttcgtcgacggtcaacgaatctttttcggatcttacgtcagtgttgtctactgagacagatccgttgaagccagcgttatttactccgggtgattatatctataactttgaacatccgttgcacccatcgattccggaaacgtcctcggtgacatttggggaagtattttattatattgaagcatcagttgtaagagctggaacctttaagctgaacctaactgggaaattaccgattaatataattagaacaccctcagaatcgaatatggaagaaaacgaaccaataataataacgagggattgggatgaccaattaagatacgatattgttatcgggagaaaatcgattgtattagactcatacttgccgttagcatttagatttgtgccattatggggaaaggttgctttacatagaataagagtatacttgtctgagaatttggaatattattgtcagaacaaaaaggttcacaggcttgaacctcccaagaaatatcttttactagaacataaggcaaagaaaggaaaatcgctattatctgaaaaactgggacaagatgaagatgaagacgatgatgcagagatattaccgaaagaattggaatttcaactatttgttccaagagtgttaagtggtagaatcaagcatgaaatacatcctgacacgtcatatgaaaatattcaagcacaccattggataaaaatttgtttaaggctttctaaaacagatcccgaagatccttcgaagaggaagcattatgaaattctgattgattcaccaattcatattttgtcgtcattagctgcacacgtgaatactttattgccggcgtacgatgagcatcttgtattaagcccatcctataatgtacaagaccatgctactccacctttatctccagaggttatacctattgacaatactactgtagccggtagaaatatactgagaaaaggaactgagaatagtgtttcattagatgaagtaatagaacgcccacatgcgaattttgagcatattactaaccataacggcacatttgatgattctgatgcagatatgcatttagaggctaacttgtatctgccaccagatgataatagaccagaaatggcatctccacaagctctaccacatctgggaacatttaactcgcctattcaaaggccaatccatttcgttagaaagccttctattaaccctcctccatttcaagaaaatactaatgatatgcttattggtgtggataatctcccaccaccagcatacgaagaggaagatcattcattgtctatgtcacccttaagaattgatgaaagtagtgacagaggaagaagtaagtcaaacctgcgctttcctggattaaccatgactgtttcacatgaaggccctgtaaagaatttattaagccaacaacttcgaaaatctgaaagtgaactctccagaaagtatgaaagtgaagatatttctgataatgtctcatctgttaagcctccaaccatgagtcctataagaaatgctgtgagtccgaatagacgagcaacagatgcaaccagacaatcaaattctagtgcaaattctagcgacacaggcttaacgaattcaattataagttcttctcaatctaatgaaactaagagtactcatgatcaagatgagatgtacgaatcttcaaatgtgcataaaatcaccaatagaaatgagaaagctgatgcaaatagaaagtttagcgacgataattatgttcctgaatcaaccttccatgaatcggaaaacaaagacaagtctcgtcagtcgtctattctgtcattgacgtcgtcgctcgatatacccgtggaacatacattacccttgttgaaccactctagctcatcgttattgactcctcaatcaaatttcaaaagtatgaactcttcgatcaattcattgaatgatagaagaacaagtaatgtacacgagatcaccaaaattaccgatttggtagagggtggtttcaatgacgacctatacagagtgaatgacaacttgtcccatttaagaaatccaaggataaagaaacactaccagaatagtgatcatatgtcagagacagaaataaataaacaaaggcaaaagtcgtttggtgttataaacaataacgattccgatatggtaacaagaatgagctcttcaagcgaatcgacagtccatggagatgatacagttggtgctctgccactttttaattctaatggtggttccccttctaatacgaatagtttattcaagcctctttctggttcgcccgccccgggattaaattatggattcattatagaatag

SEQ ID NO: 8056 - protein, 982 aa, Debaryomyces hansenii CBS767
MQTPNSPLFPAQKLTLSPSAVSLGGLTGTSSGVGSSTLIPQLPDKPLTETSSIQVYVVPAEKDLFMQGFEPEEYEGRPPTLLRGCLFLRVLKPSKIRSVTLTFKGQQRTDWPEGIPPKKTSYVELNDILSHTWPFYQLGNPLHSANGGADFFQELLKDHNSEVENSTLNVPLPVSRSRSPAAENGLGNFFTRNLSPATSFMRRAASPSSTVNESFSDLTSVLSTETDPLKPALFTPGDYIYNFEHPLHPSIPETSSVTFGEVFYYIEASVVRAGTFKLNLTGKLPINIIRTPSESNMEENEPIIITRDWDDQLRYDIVIGRKSIVLDSYLPLAFRFVPLWGKVALHRIRVYLSENLEYYCQNKKVHRLEPPKKYLLLEHKAKKGKSLLSEKLGQDEDEDDDAEILPKELEFQLFVPRVLSGRIKHEIHPDTSYENIQAHHWIKICLRLSKTDPEDPSKRKHYEILIDSPIHILSSLAAHVNTLLPAYDEHLVLSPSYNVQDHATPPLSPEVIPIDNTTVAGRNILRKGTENSVSLDEVIERPHANFEHITNHNGTFDDSDADMHLEANLYLPPDDNRPEMASPQALPHLGTFNSPIQRPIHFVRKPSINPPPFQENTNDMLIGVDNLPPPAYEEEDHSLSMSPLRIDESSDRGRSKSNLRFPGLTMTVSHEGPVKNLLSQQLRKSESELSRKYESEDISDNVSSVKPPTMSPIRNAVSPNRRATDATRQSNSSANSSDTGLTNSIISSSQSNETKSTHDQDEMYESSNVHKITNRNEKADANRKFSDDNYVPESTFHESENKDKSRQSSILSLTSSLDIPVEHTLPLLNHSSSSLLTPQSNFKSMNSSINSLNDRRTSNVHEITKITDLVEGGFNDDLYRVNDNLSHLRNPRIKKHYQNSDHMSETEINKQRQKSFGVINNNDSDMVTRMSSSSESTVHGDDTVGALPLFNSNGGSPSNTNSLFKPLSGSPAPGLNYGFIIE

SEQ ID NO: 8057 - DNA, 2991 bp, Candida albicans SC5314
  CDS (1)..(2991): transl_table=12
atgaatatacctaattcaccattattcgcgccgcagcaactttcaaatcataatagcacacctactaattccagtaatgacaaaggaactaccatcacatctactcccacttctaaaaaccatctaaataaatcttcatcttcgtcattagcggtgttaactccaactttgcctgaaaaaccaactgtatcaacttcatcattggcagtatacattgttccgtcagaacagaatctatttgtgcaagggtttgaagagcatgtatatttatccagaccaccaactatattacgaggatccttagttgtgaaagtgttaaaaccaactaaaatcaagtcaataagtttgacatttaaaggaattcaaagaacagattggcccgaaggtataccacccaaaaagaaccaatataacgaaataaatgaagttatcacccacacttggccatttttgcaaggaaatatcaacgacaagttaccccacaatggcgctgattatttcattgaaaaagacggaacaactcaccagggtggtattaatgctagttttgaagatgacttgtcatctgtgaggtcaagcacaccacctccattggggcatctggcaaccagtccatcagctaatctttctcctacccggaaatcacactatgacgaacaatcaagtaacaatgcaactaatttcttcactcgtaatttatcaccaagttttattcgaagagggaaatcgtcttctatttcttcaatggcagagatagggaaagccagttcattcactgatttgatgccatccacttcttctcctagtcctggtgacggtcattcaaacattattcattttgcccctggcgattacatttacaactttgaacatccattgccagcatcgatccctgagtcatgcaatgcgacattcggaagcacatcatattatttagaagtgaatattactcgaccaggtgctttcaaaaccaatttagctggcagattaccaataaatataatcagaacccttgctgaaacaagtttggaagaaaacgaatccattgttattaccagagattgggaagatcaacttcgatacgatatagtgataggagccaaatctgttgtgttggatctgtatttacctttggcgttcaggtttgtgccactttgggggaaagtagctttacacagaatcagagtatacttgacagaaaacttggaatattattgttctaataagaaagtacaccggatggaacctgccaagaaatacttgttgttagaacataaggccaaaaaggggagatcgttactttcatctaaaaaccccgaggatgaatcatccactgatagtttaaatgatttcgatgatgatattttaccgaaagaactagaatttcaattattcgtacccactgaattaaacgcaagaaccaatagccgtcttcatccagatacatcctatgaaaatatccaagcccatcattggattaaaatttgtttacgtatcagtaaacaggatccagagaatccagaaaagaggaaacattacgaaatcagcattgattccccgttacatgtattgagtcatttgtgttcacacaacaacacattattaccagcttacgatgacctaattccggggatgtcattggttcacaaccaaagtgaactcccacctctctcacctggggtcacacctgttgaacatacagcaagacctcgtaatggaagtgttggcaaccaaatcttgggtattttcaacaataatggcagtaatggaaacagtcaatcgcgtagtagtagtgtgccaccagaaaatgaaaacggtcgtccactgactccaatagaattccatcatatttcttctggtcttgaaagcgctggtgctgttgaaagagaggccgatatgcatttagaagctaatttgtacctgcccaaagaaaacgccattactgctataaattcaccacaagcattaccacacccggacacgttctcatcaccagtacttctgctgccagtgcaacgaccaattcatttaattcggaaaccatcagtcaacccacctccctttgatgcagatgtgccaccaccacctgccacgattcctccaccagcatacgaagaacgagattcaggaagtagacgtggttctgttggttatgggagagggttatctgataatagtagtaatagcagatcattaagtttatccccattgagaatagatgaacctagtgagaacggaaacaccacttctactaggccaaatgttgccactaatggcttccactctaccgctgcagctagtaacactcctgttagagatttattgattcaacaattgaatggttctggaagctccagtcttgttacgcctactgaattggttgagcctacaactagaatcgacgacaatattccaattgacagttctatcccacagattgaaatacacaatgaaaataacgtggagatccatggcaccgacgcaagtaccatatccaattcttctgcccgtcgatcaagtgttaatagtgaacgtggcggcactattaatggacacagcgaggacagggcactgaatcatgaaactgaaactgaaactgaagaagaagaagaagatattgcagattatccttcacccatactaccacctacagcaatacatggaatggcaaagatatcgcgtacctcatcagccgcgtcagctacgtcagctgcatcagtaaactctgcagagattcccgtggaacaaactattccactacttagtcttgttccgtcgcacaattctcaagctaatatagattcttataataagggtcggaatgagtcaacgggttctttgttgtatgaagttgctaagcctaccgaattttataatgggttagagtctagtgctggtgtcgataacgatttttttaaggtaatgagcagtagtttaagtaaattacggaatcctcggcttgctaaacattatcaagatcaacaaagttga

SEQ ID NO: 8058 - protein, 996 aa, Candida albicans SC5314
MNIPNSPLFAPQQLSNHNSTPTNSSNDKGTTITSTPTSKNHLNKSSSSSLAVLTPTLPEKPTVSTSSLAVYIVPSEQNLFVQGFEEHVYLSRPPTILRGSLVVKVLKPTKIKSISLTFKGIQRTDWPEGIPPKKNQYNEINEVITHTWPFLQGNINDKLPHNGADYFIEKDGTTHQGGINASFEDDLSSVRSSTPPPLGHSATSPSANLSPTRKSHYDEQSSNNATNFFTRNLSPSFIRRGKSSSISSMAEIGKASSFTDLMPSTSSPSPGDGHSNIIHFAPGDYIYNFEHPLPASIPESCNATFGSTSYYLEVNITRPGAFKTNLAGRLPINIIRTLAETSLEENESIVITRDWEDQLRYDIVIGAKSVVLDSYLPLAFRFVPLWGKVALHRIRVYLTENLEYYCSNKKVHRMEPAKKYLLLEHKAKKGRSLLSSKNPEDESSTDSLNDFDDDILPKELEFQLFVPTELNARTNSRLHPDTSYENIQAHHWIKICLRISKQDPENPEKRKHYEISIDSPLHVLSHLCSHNNTLLPAYDDLIPGMSLVHNQSELPPLSPGVTPVEHTARPRNGSVGNQILGIFNNNGSNGNSQSRSSSVPPENENGRPSTPIEFHHISSGLESAGAVEREADMHLEANLYSPKENAITAINSPQALPHPDTFSSPVLSSPVQRPIHLIRKPSVNPPPFDADVPPPPATIPPPAYEERDSGSRRGSVGYGRGLSDNSSNSRSLSLSPLRIDEPSENGNTTSTRPNVATNGFHSTAAASNTPVRDLLIQQLNGSGSSSLVTPTELVEPTTRIDDNIPIDSSIPQIEIHNENNVEIHGTDASTISNSSARRSSVNSERGGTINGHSEDRASNHETETETEEEEEDIADYPSPILPPTAIHGMAKISRTSSAASATSAASVNSAEIPVEQTIPLLSLVPSHNSQANIDSYNKGRNESTGSLLYEVAKPTEFYNGLESSAGVDNDFFKVMSSSLSKLRNPRLAKHYQDQQS

SEQ ID NO: 8059 - DNA, 4142 bp, Saccharomyces cerevisiae
  CDS (839)..(3979)
ttatacaaacgtcagggcgtgtattctccggcactaaatcgactcttccttgtataggccatcccgcactcttcatcaattactaaaaaggaaccaaatacgtcactttataaccaatttattgatgtcgaacggagagcaactcccttgcgccatctatcgcgcgccgtcccaaaaagaaaaaaagcaaaaaaaacataatttgaagaaggttctctcagcggctaacctttcttcattctcaattataacaataatgatacaaatactggccctgatcaatagtttgtcatgacagccgttaagaccaaaccatattgctgtagttcatctcatcccactgtttcattcatcacccaaaaattcatcgctcctttccccaatacatataacacctttttccttttttaaattagtgacgcctctgtgagagggttcagtacccattcctccatggcaacaactctcatttctcaacgccttcacctatcactcttcactgtcatttctttttgctttgttattctgctaaatgtctttcattggttttcctttattaaaacattctctggaggatttgcagtttcggaaaaaagaaatttaatccgatatggtccaatttgggaaaaaaaaaagacttggctagttctccttttcgtcttttaagaataggtactaattacgctacaagcagtctgtgagtattgagagagactaaaaagggcaaattagtctgtagacttcgctattcattaccgttagtcctttatttttttaacgttgaaacatcttttttttttttccagcctttctcattgtagatcagtcatttttcaagatgcccatggaccaatctatctcatctccattgtttcccatggaaaaggatattgatatccccctcgatgctacacccttggcacaaagttcatcattacagctttttattcatttagctgaaccagttgttttcctccaaggctttgaccctcagaagacggaatatccctcggttgttcttcggggctgtctagtggtaagaatactgaaacccacaaagctgaaaagcataagtctttcgttcaaaggatattctagaactgaatggcctgaaggtatccctcctaaaagacaagaattcgtggaaatcaaagatattgtagaccatacatgggctctatatccgccaactgaacagaagagcaagaaaaagatggatgcttccgcacctaatgagagcaacaatgcagctaataattttttgacgaaggaaagtggtgcctctctttatagaacactgtctgataatgaaactataacaagcagaaaaaattctatatcaggtttgtcctcgttgaacttgtcacctctaggtgcacctggaaattcctctgtcaacgtaaaagacagagaaagtagacaaagatctagatcttcgtcagtcacttcttccaatggaccatcaagaaacctatccccgataaatttattgaagagagccacgtctccttccgtgtctcaccacaactataaacctacgaccacttccatcttttccgacttgttgaataacacctttacccataatgatgcagcatcgcatcatggtcatcatatccccaccagtagcaatcatctggcaatgacaagcaacaacttcaccagcgggtctggaggagaattttttgtctttcaaccaggcgactatatttatgctttcgaagaactaattcctcaagcatacccagaatctattaaagctgatttcggatttgtggaatacttcttatttgccagtatagagagacctggtgcctttaaatcaaacattagcgcccggcaagtggttaatatcgtacggacacaggctcataattctgtggaagaaagtgagccgattatcatatctagagattgggaaaaccaattatattatgatatcgttatagcatcaaaggatattattttagatgcttttctgcctatcacgttcaaattcgctcccctcgataaagttacgttgcatagaataagaatttatgtgacagagacaatggagtattattgtagagaaaagaaggttcataggatggagcccaccaagaaatttttattgacagaacagaaaggtcctaaattaccgaacttgcccaatgatgcaaatttgtcaaaggccaagaatatggggaacctgttgcaggatccaaagaatggtgatttagtgaataaagagtatgagtaccagatttttattccgagtcgtttcaacaaccatcagcaattgcatccagatacttcttatgaaaacatcaaagcaaaccattggattaaaatttgcctgagactgtctagagtagtagataataaaaggaaacattacgaaattagtattgactcgccaatacatgttttacatagattgtgctcgcatgcaaatacccttttaccgagctatgatggacatcctgcttcttttccaaaagaaacagattcctcaatttcctcaatattggaatcgtctgatgacaatataaatctataccataactctaatattttctttcccaaggaagtcctttcgtctccagtactttcgcccaatgtccaaccattagacattttaatcccacatttaccttccacttcattgaccagaaactctaggcaattcaataggaactcaaaatcccatccgagtgataataccatcttcaattctgcaaagttgaaatccaacatatatcaaccggagagtttgcaaagagaattagcatcaccccaggcaatcccgctctctccaataacatcgccaatgtcaaatatggaagtgcctccgccagattttgacttttcttccgatttcatatctgatgctgcttccggaaccactactactgaggtatcttcatcagagtcgagcatcttaccacgggatccaccatcttataaggatactgtgttgcatgacaacaatcaaaaaaggaggcctaattccaaacatccgacgcctccaagtttaaaagcttcccatccaaataaaaattcggataagaattcttcagaaactttgaataaaaaagaatcgatgtcaaagatagaagaaaataaacacaaaagagagacaactcctaaaaagagagaaaatagggacgtgaaaagtttatcaaccccacaacgcgaggaaagcaaagactcgacatccactgggaatcaaagtaacgaaaagaacagaaaaagagtattaagcctatcgtcttcattacatagctcaccaaataatagcggatttgcgcattcagctttaggaaatctgagcaatgaatcattaagatcattgaatagaagggaaagtgttcaagataatttaccgtccacaataagacacgataatccttttttcacagatttaaatcaagttttaatagaagacgaacttaaaaatcatgataaaaatgaactaaatcgacattctacaaatacttcgagcacccccgcctcagctagatcctcttttgactattcaggaattaatataagcaaggacaagttgaacatggaaccattactgagtaaaacggaaacgttgactaataaagttaatgaagactcctttttaaggcctaatgattcatacgttgatctacttgaaccctcagtagatactacgattgatatcactgcgccgtacgctagaaattcctctgcttggcatcctttacaaaacgataacgataacaatcagttttctccacttttgggaagtaacgagaatttcttgaatgcagctaatgcacaaaattctgccgaatcagatcataataatgacattttcacacagggctcaggattaacggaaagctctaagaattctgattccgaggaaagatttatttcaagactttcttcacccgagaaagtactgattaatacgttagataatgaatctggattacaaagtataaatgagagtaccctttagtctagcacaaggttcctacgtcatcccttcctgttcttacatctggcgtccagagcaaacataaaatattagaaactctaattgttatacatatatatgtttatatctgtttatggtacgttcttttctttaattttgctttttgaaaagtgatgttcgcaat

SEQ ID NO: 8060 - protein, 1046 aa, Saccharomyces cerevisiae
MPMDQSISSPLFPMEKDIDIPLDATPLAQSSSLQLFIHLAEPVVFLQGFDPQKTEYPSVVLRGCLVVRILKPTKLKSISLSFKGYSRTEWPEGIPPKRQEFVEIKDIVDHTWALYPPTEQKSKKKMDASAPNESNNAANNFLTKESGASLYRTLSDNETITSRKNSISGLSSLNLSPLGAPGNSSVNVKDRESRQRSRSSSVTSSNGPSRNLSPINLLKRATSPSVSHHNYKPTTTSIFSDLLNNTFTHNDAASHHGHHIPTSSNHLAMTSNNFTSGSGGEFFVFQPGDYIYAFEELIPQAYPESIKADFGFVEYFLFASIERPGAFKSNISARQVVNIVRTQAHNSVEESEPIIISRDWENQLYYDIVIASKDIILDAFLPITFKFAPLDKVTLHRIRIYVTETMEYYCREKKVHRMEPTKKFLLTEQKGPKLPNLPNDANLSKAKNMGNLLQDPKNGDLVNKEYEYQIFIPSRFNNHQQLHPDTSYENIKANHWIKICLRLSRVVDNKRKHYEISIDSPIHVLHRLCSHANTLLPSYDGHPASFPKETDSSISSILESSDDNINLYHNSNIFFPKEVLSSPVLSPNVQPLDILIPHLPSTSLTRNSRQFNRNSKSHPSDNTIFNSAKLKSNIYQPESLQRELASPQAIPLSPITSPMSNMEVPPPDFDFSSDFISDAASGTTTTEVSSSESSILPRDPPSYKDTVLHDNNQKRRPNSKHPTPPSLKASHPNKNSDKNSSETLNKKESMSKIEENKHKRETTPKKRENRDVKSLSTPQREESKDSTSTGNQSNEKNRKRVLSLSSSLHSSPNNSGFAHSALGNLSNESLRSLNRRESVQDNLPSTIRHDNPFFTDLNQVLIEDELKNHDKNELNRHSTNTSSTPASARSSFDYSGINISKDKLNMEPLLSKTETLTNKVNEDSFLRPNDSYVDLLEPSVDTTIDITAPYARNSSAWHPLQNDNDNNQFSPLLGSNENFLNAANAQNSAESDHNNDIFTQGSGLTESSKNSDSEERFISRLSSPEKVLINTLDNESGLQSINESTL

SEQ ID NO: 8061 - DNA, 26 bp, Artificial sequence
  primer
atgctccaattcaatacagaaaatga

SEQ ID NO: 8062 - DNA, 26 bp, Artificial sequence
  primer
ttattttctcttttcgcgaaatgctt

SEQ ID NO: 8063 - protein, 810 aa, Artificial sequence
  consensus sequence
  Variant (2)..(15): Xaa in position 2 to 15 is any amino acid
  Variant (17)..(19): Xaa in position 17 to 19 is any amino acid
  Variant (21)..(22): Xaa in position 21 to 22 is any amino acid
  Variant (25)..(32): Xaa in position 25 to 32 is any amino acid
  Variant (33)..(35): Xaa in position 33 to 35 is any or no amino acid
  Variant (37)..(38): Xaa in position 37 to 38 is any amino acid
  Variant (39)..(40): Xaa in position 39 to 40 is any or no amino acid
  Variant (44)..(44): Xaa in position 44 is any amino acid
  Variant (46)..(49): Xaa in position 46 to 49 is any amino acid
  Variant (52)..(53): Xaa in position 52 to 53 is any amino acid
  Variant (55)..(59): Xaa in position 55 to 59 is any amino acid
  Variant (61)..(61): Xaa in position 61 is any amino acid
  Variant (63)..(63): Xaa in position 63 is any amino acid
  Variant (65)..(67): Xaa in position 65 to 67 is any amino acid
  Variant (69)..(69): Xaa in position 69 is any amino acid
  Variant (77)..(82): Xaa in position 77 to 82 is any amino acid
  Variant (84)..(89): Xaa in position 84 to 89 is any amino acid
  Variant (91)..(91): Xaa in position 91 is any amino acid
  Variant (93)..(150): Xaa in position 93 to 150 is any amino acid
  Variant (151)..(324): Xaa in position 151 to 324 is any or no amino acid
  Variant (326)..(326): Xaa in position 326 is any amino acid
  Variant (329)..(329): Xaa in position 329 is any amino acid
  Variant (331)..(331): Xaa in position 331 is any amino acid
  Variant (333)..(333): Xaa in position 333 is any amino acid
  Variant (336)..(342): Xaa in position 336 to 342 is any amino acid
  Variant (345)..(350): Xaa in position 345 to 350 is any amino acid
  Variant (352)..(352): Xaa in position 352 is any amino acid
  Variant (354)..(354): Xaa in position 354 is any amino acid
  Variant (356)..(362): Xaa in position 356 to 362 is any amino acid
  Variant (364)..(364): Xaa in position 364 is any amino acid
  Variant (366)..(366): Xaa in position 366 is any amino acid
  Variant (367)..(370): Xaa in position 367 to 370 is any or no amino acid
  Variant (373)..(384): Xaa in position 373 to 384 is any amino acid
  Variant (386)..(392): Xaa in position 386 to 392 is any amino acid
  Variant (394)..(395): Xaa in position 394 to 395 is any amino acid
  Variant (397)..(397): Xaa in position 397 is any amino acid
  Variant (399)..(399): Xaa in position 399 is any amino acid
  Variant (401)..(403): Xaa in position 401 to 403 is any amino acid
  Variant (405)..(407): Xaa in position 405 to 407 is any amino acid
  Variant (409)..(409): Xaa in position 409 is any amino acid
  Variant (412)..(413): Xaa in position 412 to 413 is any amino acid
  Variant (415)..(416): Xaa in position 415 to 416 is any amino acid
  Variant (418)..(420): Xaa in position 418 to 420 is any amino acid
  Variant (422)..(424): Xaa in position 422 to 424 is any amino acid
  Variant (427)..(428): Xaa in position 427 to 428 is any amino acid
  Variant (430)..(432): Xaa in position 430 to 432 is any amino acid
  Variant (434)..(435): Xaa in position 434 to 435 is any amino acid
  Variant (436)..(436): Xaa in position 436 is any or no amino acid
  Variant (438)..(440): Xaa in position 438 to 440 is any amino acid
  Variant (445)..(448): Xaa in position 445 to 448 is any amino acid
  Variant (450)..(451): Xaa in position 450 to 451 is any amino acid
  Variant (454)..(461): Xaa in position 454 to 461 is any amino acid
  Variant (462)..(465): Xaa in position 462 to 465 is any or no amino acid
  Variant (467)..(470): Xaa in position 467 to 470 is any amino acid
  Variant (473)..(473): Xaa in position 473 is any amino acid
  Variant (476)..(476): Xaa in position 476 is any amino acid
  Variant (478)..(512): Xaa in position 478 to 512 is any amino acid
  Variant (513)..(559): Xaa in position 513 to 559 is any or no amino acid
  Variant (561)..(561): Xaa in position 561 is any amino acid
  Variant (563)..(571): Xaa in position 563 to 571 is any amino acid
  Variant (572)..(579): Xaa in position 572 to 579 is any or no amino acid
  Variant (584)..(587): Xaa in position 584 to 587 is any amino acid
  Variant (589)..(591): Xaa in position 589 to 591 is any amino acid
  Variant (597)..(597): Xaa in position 597 is any amino acid
  Variant (600)..(600): Xaa in position 600 is any amino acid
  Variant (602)..(604): Xaa in position 602 to 604 is any amino acid
  Variant (605)..(613): Xaa in position 605 to 613 is any or no amino acid
  Variant (616)..(616): Xaa in position 616 is any amino acid
  Variant (619)..(619): Xaa in position 619 is any amino acid
  Variant (624)..(626): Xaa in position 624 to 626 is any amino acid
  Variant (628)..(632): Xaa in position 628 to 632 is any amino acid
  Variant (634)..(634): Xaa in position 634 is any amino acid
  Variant (640)..(640): Xaa in position 640 is any amino acid
  Variant (642)..(699): Xaa in position 642 to 699 is any amino acid
  Variant (700)..(737): Xaa in position 700 to 737 is any or no amino acid
  Variant (739)..(740): Xaa in position 739 to 740 is any amino acid
  Variant (742)..(742): Xaa in position 742 is any amino acid
  Variant (744)..(744): Xaa in position 744 is any amino acid
  Variant (746)..(753): Xaa in position 746 to 753 is any amino acid
  Variant (754)..(754): Xaa in position 754 is any or no amino acid
  Variant (759)..(759): Xaa in position 759 is any amino acid
  Variant (761)..(792): Xaa in position 761 to 792 is any amino acid
  Variant (793)..(808): Xaa in position 793 to 808 is any or no amino acid
PXXXXXXXXXXXXXXEXXXFXXGFXXXXXXXXXXXPXXXXLRGXLXXXXLKXXKXXXXXLXFXGXXXTXWPEGIPPXXXXXXEXXXXXXHXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXPGXYXYXFEXXXXXXXPEXXXXXXGXVXYXXXXXXXRXGXXXXXFKXXXXXXXXXXXXRXXXXXXXEXXEXIXIXXXWXXXLXYDXXIXXKXXXLXXXLPXXFXXXPXXXKXXXHRIRXXXXEXXEYXXXXXXXXXXXXRXXXXKKXLLXEXXXXXXXXXXXXXXXXXXXXXXXXXXXXXXXXXXXXXXXXXXXXXXXXXXXXXXXXXXXXXXXXXXXXXXXXXXXXXXXXXXFXPXXXXXXXXXXXXXXXXXHPDTXXXXIXXXHWIKIXLRXSXXXXXXXXXXXXKHXEIXIDSPXXXLXXXXXHXNTLLPXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXNXYXPXXXXXXXXXSPQAXPXXXXXXXXXXXXXXXXXXXXXXXXXXXXXXXXXXXXXXXXXXXXXXXXPP

SEQ ID NO: 8064 - protein, 54 aa, Artificial sequence
  protein pattern
  Variant (4)..(4): Xaa in position 4 is any amino acid
  Variant (6)..(6): Xaa in position 6 is Phe, Ile or Val
  Variant (7)..(7): Xaa in position 7 is Leu or Val
  Variant (8)..(8): Xaa in position 8 is any amino acid
  Variant (9)..(9): Xaa in position 9 is Ile or Val
  Variant (10)..(10): Xaa in position 10 is any amino acid
  Variant (12)..(12): Xaa in position 12 is Asn, Pro or Ser
  Variant (13)..(13): Xaa in position 13 is Asn, Ser or Thr
  Variant (15)..(23): Xaa in position 15 to 23 is any or no amino acid
  Variant (25)..(25): Xaa in position 25 is any amino acid
  Variant (26)..(26): Xaa in position 26 is Ala, Gln or Ser
  Variant (27)..(27): Xaa in position 27 is Lys or Arg
  Variant (29)..(29): Xaa in position 29 is Asp or Glu
  Variant (31)..(31): Xaa in position 31 is Ile or Pro
  Variant (37)..(37): Xaa in position 37 is any amino acid
  Variant (38)..(38): Xaa in position 38 is Lys or Arg
  Variant (39)..(39): Xaa in position 39 is any amino acid
  Variant (40)..(40): Xaa in position 40 is Asp, Glu, Gln or Ser
  Variant (41)..(42): Xaa in position 41 to 42 is any amino acid
  Variant (43)..(43): Xaa in position 43 is Asp or Glu
  Variant (44)..(45): Xaa in position 44 to 45 is any amino acid
  Variant (46)..(46): Xaa in position 46 is Asp, Glu, Ser or Thr
  Variant (47)..(47): Xaa in position 47 is Ile, Leu or Val
  Variant (48)..(50): Xaa in position 48 to 50 is any amino acid
  Variant (51)..(51): Xaa in position 51 is Gly or Thr
  Variant (52)..(52): Xaa in position 52 is any amino acid
  Variant (53)..(53): Xaa in position 53 is Ala, Pro or Thr
  Variant (54)..(54): Xaa in position 54 is Phe or Leu
LRGXLXXXXXKXXKXXXXXXXXXGXXXTXWXEGIPPXXXXXXXXXXXXXXXXXX

SEQ ID NO: 8065 - protein, 40 aa, Artificial sequence
  protein pattern
  Variant (2)..(2): Xaa in position 2 is Ala, Pro or Ser
  Variant (4)..(4): Xaa in position 4 is any amino acid
  Variant (6)..(6): Xaa in position 6 is Ser or Thr
  Variant (7)..(7): Xaa in position 7 is Lys or Arg
  Variant (8)..(8): Xaa in position 8 is Asp or Gln
  Variant (10)..(10): Xaa in position 10 is any amino acid
  Variant (11)..(11): Xaa in position 11 is Asp, Asn or Thr
  Variant (12)..(12): Xaa in position 12 is any amino acid
  Variant (14)..(14): Xaa in position 14 is any or no amino acid
  Variant (16)..(16): Xaa in position 16 is any or no amino acid
  Variant (18)..(18): Xaa in position 18 is Ile or Val
  Variant (19)..(19): Xaa in position 19 is Met or Val
  Variant (21)..(22): Xaa in position 21 to 22 is any amino acid
  Variant (24)..(24): Xaa in position 24 is Asp, Glu or Ser
  Variant (25)..(25): Xaa in position 25 is Phe, Ile or Val
  Variant (26)..(26): Xaa in position 26 is Ile, Pro or Val
  Variant (27)..(27): Xaa in position 27 is Ile or Leu
  Variant (28)..(28): Xaa in position 28 is Asp, Gly or Asn
  Variant (29)..(29): Xaa in position 29 is Ala, Gly or Ser
  Variant (30)..(30): Xaa in position 30 is any amino acid
  Variant (31)..(31): Xaa in position 31 is Ile or Leu
  Variant (33)..(33): Xaa in position 33 is Ile or Leu
  Variant (34)..(34): Xaa in position 34 is Ala, Asp, Asn or Thr
  Variant (36)..(36): Xaa in position 36 is His, Lys or Arg
  Variant (37)..(37): Xaa in position 37 is Phe, Ile or Leu
  Variant (38)..(38): Xaa in position 38 is any amino acid
  Variant (40)..(40): Xaa in position 40 is Leu or Met
EXIXIXXXWXXXLXYXDXXIXXKXXXXXXXXPXXFXXXPX

SEQ ID NO: 8066 - protein, 30 aa, Artificial sequence
  protein pattern
  Variant (3)..(3): Xaa in position 3 is Phe or Tyr
  Variant (5)..(5): Xaa in position 5 is Ile or Val
  Variant (6)..(6): Xaa in position 6 is any amino acid
  Variant (11)..(11): Xaa in position 11 is Ile, Leu or Met
  Variant (12)..(12): Xaa in position 12 is His or Arg
  Variant (13)..(13): Xaa in position 13 is Ile or Val
  Variant (15)..(17): Xaa in position 15 to 17 is any amino acid
  Variant (18)..(18): Xaa in position 18 is Ala, Cys or Ser
  Variant (19)..(19): Xaa in position 19 is Ala or Ser
  Variant (21)..(21): Xaa in position 21 is Ala, Asn or Val
  Variant (27)..(27): Xaa in position 27 is any amino acid
  Variant (29)..(29): Xaa in position 29 is Asp or Glu
  Variant (30)..(30): Xaa in position 30 is Asp, Glu, Gly, Ser or Thr
KHXEXXIDSPXXXLXXXXXHXNTLLPXYXX

SEQ ID NO: 8067 - protein, 55 aa, Artificial sequence
  protein pattern
  Variant (3)..(3): Xaa in position 3 is Asp or Thr
  Variant (5)..(5): Xaa in position 5 is any amino acid
  Variant (6)..(6): Xaa in position 6 is Phe or Tyr
  Variant (7)..(7): Xaa in position 7 is Ala, Asn, Pro, Ser or Thr
  Variant (10)..(10): Xaa in position 10 is any amino acid
  Variant (11)..(11): Xaa in position 11 is Ala, Leu or Pro
  Variant (12)..(12): Xaa in position 12 is Ile or Leu
  Variant (13)..(16): Xaa in position 13 to 16 is any amino acid
  Variant (17)..(17): Xaa in position 17 is Leu or Pro
  Variant (19)..(19): Xaa in position 19 is Ser or Thr
  Variant (20)..(21): Xaa in position 20 to 21 is any amino acid
  Variant (22)..(22): Xaa in position 22 is Ala, Leu or Val
  Variant (23)..(23): Xaa in position 23 is Asp, Glu, Asn, Gln or Thr
  Variant (24)..(24): Xaa in position 24 is Phe or Tyr
  Variant (26)..(26): Xaa in position 26 is any amino acid
  Variant (27)..(27): Xaa in position 27 is Thr or Val
  Variant (28)..(28): Xaa in position 28 is any amino acid
  Variant (29)..(29): Xaa in position 29 is Trp or Tyr
  Variant (30)..(30): Xaa in position 30 is any amino acid
  Variant (31)..(31): Xaa in position 31 is Ile or Leu
  Variant (32)..(33): Xaa in position 32 to 33 is any amino acid
  Variant (34)..(34): Xaa in position 34 is Asp, Asn, Ser or Val
  Variant (35)..(35): Xaa in position 35 is Ile, Leu or Val
  Variant (36)..(36): Xaa in position 36 is any amino acid
  Variant (38)..(38): Xaa in position 38 is any amino acid
  Variant (40)..(40): Xaa in position 40 is Ala, Pro or Thr
  Variant (42)..(42): Xaa in position 42 is Lys or Arg
  Variant (43)..(43): Xaa in position 43 is any amino acid
  Variant (44)..(44): Xaa in position 44 is Gly, Asn or Thr
  Variant (45)..(45): Xaa in position 45 is Ile, Leu or Val
  Variant (46)..(46): Xaa in position 46 is any amino acid
  Variant (47)..(47): Xaa in position 47 is Ala, Gly or Thr
  Variant (48)..(50): Xaa in position 48 to 50 is any amino acid
  Variant (51)..(51): Xaa in position 51 is Ile or Val
  Variant (52)..(52): Xaa in position 52 is any amino acid
  Variant (53)..(54): Xaa in position 53 to 54 is Ile or Val
PGXYXXXFEXXXXXXXXEXXXXXXGXXXXXXXXXXXRXGXFXXXXXXXXXXXXXR

SEQ ID NO: 8068 - protein, 30 aa, Artificial sequence
  protein pattern
  Variant (2)..(3): Xaa in position 2 to 3 is any or no amino acid
  Variant (5)..(6): Xaa in position 5 to 6 is any or no amino acid
  Variant (11)..(11): Xaa in position 11 is Ile or Val
  Variant (12)..(12): Xaa in position 12 is Phe or Tyr
  Variant (13)..(13): Xaa in position 13 is Leu or Val
  Variant (14)..(14): Xaa in position 14 is Ser or Thr
  Variant (16)..(16): Xaa in position 16 is Asn, Ser or Thr
  Variant (17)..(17): Xaa in position 17 is Ile, Leu or Met
  Variant (18)..(18): Xaa in position 18 is Glu or Thr
  Variant (20)..(20): Xaa in position 20 is any amino acid
  Variant (21)..(21): Xaa in position 21 is Ala or Cys
  Variant (22)..(22): Xaa in position 22 is any amino acid
  Variant (23)..(23): Xaa in position 23 is Asp, Glu, Gly, Asn or Ser
  Variant (24)..(27): Xaa in position 24 to 27 is any amino acid
  Variant (28)..(28): Xaa in position 28 is Glu or Arg
  Variant (29)..(29): Xaa in position 29 is any amino acid
  Variant (30)..(30): Xaa in position 30 is Ala, Asp or Glu
KXXLXXHRIRXXXXEXXXYXXXXXXXXXXX

SEQ ID NO: 8069 - protein, 21 aa, Artificial sequence
  protein pattern
  Variant (5)..(5): Xaa in position 5 is Asn, Ser or Thr
  Variant (6)..(6): Xaa in position 6 is Phe or Tyr
  Variant (7)..(7): Xaa in position 7 is Asp, Glu or Gly
  Variant (8)..(8): Xaa in position 8 is any amino acid
  Variant (10)..(11): Xaa in position 10 to 11 is any amino acid
  Variant (12)..(12): Xaa in position 12 is any or no amino acid
  Variant (14)..(14): Xaa in position 14 is any or no amino acid
  Variant (16)..(16): Xaa in position 16 is Ile or Leu
  Variant (18)..(18): Xaa in position 18 is Ile or Val
  Variant (19)..(19): Xaa in position 19 is Ala, Cys or Ser
HPDTXXXXIXXXHXWXKXXLR

SEQ ID NO: 8070 - protein, 24 aa, Artificial sequence
  protein pattern
  Variant (2)..(4): Xaa in position 2 to 4 is any amino acid
  Variant (5)..(5): Xaa in position 5 is Ala, Ser or Thr
  Variant (6)..(6): Xaa in position 6 is Asn, Ser or Thr
  Variant (7)..(7): Xaa in position 7 is Gly, Asn, Ser or Thr
  Variant (8)..(8): Xaa in position 8 is Phe, Ile or Leu
  Variant (9)..(11): Xaa in position 9 to 11 is any amino acid
  Variant (12)..(12): Xaa in position 12 is Ile or Val
  Variant (13)..(14): Xaa in position 13 to 14 is any amino acid
  Variant (15)..(15): Xaa in position 15 is Ala, Ser or Val
  Variant (17)..(18): Xaa in position 17 to 18 is any amino acid
  Variant (19)..(19): Xaa in position 19 is Ile, Leu or Val
  Variant (21)..(21): Xaa in position 21 is Leu, Met or Val
  Variant (22)..(22): Xaa in position 22 is any amino acid
PXXXXXXXXXXXXXXEXXXFXXGF

SEQ ID NO: 8071 - protein, 28 aa, Artificial sequence
  protein pattern
  Variant (2)..(2): Xaa in position 2 is any or no amino acid
  Variant (5)..(5): Xaa in position 5 is any amino acid
  Variant (7)..(8): Xaa in position 7 to 8 is any amino acid
  Variant (9)..(9): Xaa in position 9 is Ala or Gly
  Variant (10)..(11): Xaa in position 10 to 11 is any amino acid
  Variant (12)..(12): Xaa in position 12 is Gly, Ile, Leu or Val
  Variant (13)..(14): Xaa in position 13 to 14 is any amino acid
  Variant (15)..(15): Xaa in position 15 is Ile, Leu or Pro
  Variant (16)..(17): Xaa in position 16 to 17 is any amino acid
  Variant (18)..(18): Xaa in position 18 is Ala, Asp, Glu, Gly or Ser
  Variant (19)..(27): Xaa in position 19 to 27 is any amino acid
  Variant (28)..(28): Xaa in position 28 is Asp or Gly
KXLLXEXXXXXXXXXXXXXXXXXXXXXX

SEQ ID NO: 8072 - protein, 24 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Ile or Leu
  Variant (7)..(7): Xaa in position 7 is Phe or Tyr
  Variant (8)..(8): Xaa in position 8 is any amino acid
  Variant (10)..(14): Xaa in position 10 to 14 is any amino acid
  Variant (15)..(18): Xaa in position 15 to 18 is any or no amino acid
  Variant (21)..(21): Xaa in position 21 is any amino acid
  Variant (22)..(22): Xaa in position 22 is Ala, Leu or Val
  Variant (23)..(23): Xaa in position 23 is any amino acid
  Variant (24)..(24): Xaa in position 24 is Ala, Pro or Ser
HXXXNXXXPXXXXXXXXXSPXXXX

SEQ ID NO: 8073 - DNA, 876 bp, Saccharomyces cerevisiae
  CDS (1)..(876)
atgaatacactattatttaagcgaaaaggtggcaattgtgggaacgaaagtaacatagtttcgcagggatcgccctcaagtagcaatcttcctgaatcacctggcactttagatgaaaagaatcttcccagattgcctactccattcgctagaagcctttctaccattcctagttatgagcagatgaaacgtacaaacaaactgccagattatcacctaaagattgttgttgtgggagatggcgctgtagggaagacgtgcctgctgatatcttatgtccaaggaacatttccgactgattatattcctactattttcgaaaattatgtcacaaacatagaaggacccaacggtcaaattatagaattggcattatgggacactgccggccaagaagagtatagtagacttagaccgctttcatatacgaatgcagatgtgctgatggtgtgctattctgttggtagtaagacatcgcttaaaaatgtggaagatctctggttcccagaggttaagcatttttgtccttccactccaatcatgctagtcggccttaaatcagatctatatgaagctgataacctttcagatctggtggaaccaagttcagcagaatccttggccaagcgtctgggggcatttgcacatattcaatgctcagcacgattgaaagaaaatatcgatgaagtatttgaaactgccatacacacgttactttccgattcattatatgctcccagagagcctacacatacaatcaaaaatccctttaaaagaaataccaccagatcagatatcgattcttctactggagataccagcgtctctatttccggaacgaaaagattaagaaaaaacaagtgtattataatgtaa

SEQ ID NO: 8074 - protein, 291 aa, Saccharomyces cerevisiae
MNTLLFKRKGGNCGNESNIVSQGSPSSSNLPESPGTLDEKNLPRLPTPFARSLSTIPSYEQMKRTNKLPDYHLKIVVVGDGAVGKTCLLISYVQGTFPTDYIPTIFENYVTNIEGPNGQIIELALWDTAGQEEYSRLRPLSYTNADVLMVCYSVGSKTSLKNVEDLWFPEVKHFCPSTPIMLVGLKSDLYEADNLSDLVEPSSAESLAKRLGAFAHIQCSARLKENIDEVFETAIHTLLSDSLYAPREPTHTIKNPFKRNTTRSDIDSSTGDTSVSISGTKRLRKNKCIIM

SEQ ID NO: 8075 - DNA, 588 bp, Oryza sativa (japonica cultivar-group)
  CDS (1)..(588)
atgagcgcgtctcggttcatcaagtgcgtcaccgtgggggacggcgccgtgggcaagacctgcatgctcatctcctacacctccaacaccttccccacggactatgttccaactgtttttgataacttcagtgcaaatgttgtggtcgatgggagcactgtgaacttggggttgtgggatacagcagaggactacaataggctacgcccgttgagctatcgtggcgctgatgttttcctgctggccttttctctgatcagcaaagcaagctatgagaatgtttctaaaaagtggatacctgaattaaggcattatgctcctggtgtgccaataattctcgttggaacaaagcttgatctgcgggatgataagcaatttttcgtagatcaccctggtgctgtacctatttccactgctcagggcgaagagctgaggaaactcattggtgcagcggcatacattgaatgcagttcaaaaacacagcaaaacatcaaggcagttttcgatgctgcgattaaggtggttctccagcctccaaagcaaaagaagaagaagaaaaaggcgcagaaaggatgtgccatcttgtaa

SEQ ID NO: 8076 - protein, 195 aa, Oryza sativa (japonica cultivar-group)
MSASRFIKCVTVGDGAVGKTCMLISYTSNTFPTDYVPTVFDNFSANVVVDGSTVNLGLWDTAEDYNRLRPLSYRGADVFLLAFSLISKASYENVSKKWIPELRHYAPGVPIILVGTKLDLRDDKQFFVDHPGAVPISTAQGEELRKLIGAAAYIECSSKTQQNIKAVFDAAIKVVLQPPKQKKKKKKAQKGCAIL

SEQ ID NO: 8077 - DNA, 879 bp, Magnaporthe grisea 70-15
  CDS (1)..(879)
atggcttcgcaataccagtatcgtaactcccagtacaacagcaaccaggtcagcaacgagaaatacgagccgtcgatgcagcgaaggtcgacaattgagcgacgagagccccgtggaactaggtcgagcgatggtactgtcagcacaatgatgagcgcatcgactggaagggaatcatcagcaaccgcaatgaccgaggcaccggcctactcgaagaagattgtcgtcgttggtgatggcggctgcggcaagacgtgtctgctcatcagctacagccaaggctactttccagagaaatacgtgccgaccgtcttcgaaaactacatcacctatcccacacacggctccagcggtaagacggttgagctcgccctttgggataccgccgggcaggaggaatacgaccgtctacgacccctctcctaccccgaaaccgatttgatctttgtttgctttgccatcgactgcccaaactctctcgagaatgtcatggacaagtggtacccggaagtcctccacttctgcccctacacgccgctcatcctcgttggcctcaagtcagacctccgcttcaagaagacatgcatcgacatgctcaagacacaagggttgacgcccgtcaccaccgaacaagggcaagccgtggctcgcaagatgaacgcccagtacatggagtgcagcagcaaggagatgcgcggtgttgacgagatcttcgagcgcgccctcgacaccgtcattgcaaacgaccgcaaaactctcgaggctcaggcggcagccagcgggggcgggggcggcagctactcaagccacggcggccatggcatcccaggcgttgggggcatgcccaagaagaggaagacgaggtgcaatatcttgtga

SEQ ID NO: 8078 - protein, 292 aa, Magnaporthe grisea 70-15
MASQYQYRNSQYNSNQVSNEKYEPSMQRRSTIERREPRGTRSSDGTVSTMMSASTGRESSATAMTEAPAYSKKIVVVGDGGCGKTCLLISYSQGYFPEKYVPTVFENYITYPTHGSSGKTVELALWDTAGQEEYDRLRPLSYPETDLIFVCFAIDCPNSLENVMDKWYPEVLHFCPYTPLILVGLKSDLRFKKTCIDMLKTQGLTPVTTEQGQAVARKMNAQYMECSSKEMRGVDEIFERALDTVIANDRKTLEAQAAASGGGGGSYSSHGGHGIPGVGGMPKKRKTRCNIL

SEQ ID NO: 8079 - DNA, 813 bp, Gibberella zeae PH-1
  CDS (1)..(813)
atggcatcatctcattcgcaccgtacctcttactttgaacccaacgagcagtttcgacgtcaagagcgcactcgttccagcgaaggcaccgtcagcaccactatgagctcgtcgacgggccgcgagtcggcagcgacccacgtcaccgacgcgcccaccttttccaagaagattgttgttgtcggcgacggtggttgcggcaagacctgcttgctcattagctacagccagggttatttcccagagaaatatgtaccaaccgtctttgagaactacatcacctatcccatccactctgctaccggtaagactgtggagcttgcattgtgggataccgccggccaagaggaatatgaccgtctccgaccgctctcataccccgagaccgacctaatctttgtatgcttcgctattgattgcccgaactctctcgataatgtacttgataagtggtatcctgaggttctacacttctgcccatacactcctctggtcctcgtcggcctcaagtcagatctccgccacaagaaggcctgtattgatatgctcaagacacaaggtctcacaccagttactaccgagcagggcatgggactggccaagaagatgaacgctcagtacatggaatgcagtagtaaggagatgcgaggcgtcgacgagatctttgagcaggctatcaacaccgtcgttgccaacgaccggaaaacaatcgaggcagcagcagcctcgggttcttccaaggagagcaagtcatcatcaacacccggggtggggcaaattaagaggaagaagagaaggtgtccaatcctctaa

SEQ ID NO: 8080 - protein, 270 aa, Gibberella zeae PH-1
MASSHSHRTSYFEPNEQFRRQERTRSSEGTVSTTMSSSTGRESAATHVTDAPTFSKKIVVVGDGGCGKTCLLISYSQGYFPEKYVPTVFENYITYPIHSATGKTVELALWDTAGQEEYDRLRPLSYPETDLIFVCFAIDCPNSLDNVLDKWYPEVLHFCPYTPLVLVGLKSDLRHKKACIDMLKTQGLTPVTTEQGMGLAKKMNAQYMECSSKEMRGVDEIFEQAINTVVANDRKTIEAAAASGSSKESKSSSTPGVGQIKRKKRRCPIL

SEQ ID NO: 8081 - DNA, 972 bp, Candida glabrata CBS 138
  CDS (1)..(972)
atgatgcaagttgattatttcagtggcataggtgggattcctagaggaggtggaagatcaaatagtcgagtatccagtaccactctacccgaatcattagtcagtggccagtctgatgacactttgaatacatatggagcaacatcgttaaaacttagtcgtagtcgcataaatccatttgatagaacattatcccaagtagagagttttgagcacatgaagagagctcacaaaattcctgactaccatttaaagattgttgttgtaggtgatggtgcagttgggaagacttctttactgatatcatatgtggagaaagtgtttaaacatgagaatataccgactatatttgaaaattatgtgacaaatatacaagggccaaaggggcagataatagaattggctttgtgggatacagcgggacaggaagagtatagtaggctacgacccctttcatatacaggagcagacgttttgatgatttgttatgctatagatagtatcacctccttaaagaacgtagaagatgtctggtttccggaggtaagacatttctgcccaggtacacctgtgatgttagtgggattgaaatcagacttgtatgaagaagaatcgtgtgatagtaaggttgatccagctgaggcggattccatagcgaagaagaatggcgcatttgctcatattcagtgttccgcgaaattgagggttaaagtggataatgtgttctacgctgccatcaatgagctacttgctgagcagttaattagtcaaaatcataatgccccaattctcaaaagtatttttaaattaaagaagcttaaacttagtgagcctattgatattgaggagcaatattatgatggggaaaatggtggtgatgataatgatggtagctcttctggaaatgttgctgctttaccaagtactattgttaagaaaaatataaggaaatcgaaatgtatcgtaatgtaa

SEQ ID NO: 8082 - protein, 323 aa, Candida glabrata CBS 138
MMQVDYFSGIGGIPRGGGRSNSRVSSTTLPESLVSGQSDDTLNTYGATSLKLSRSRINPFDRTLSQVESFEHMKRAHKIPDYHLKIVVVGDGAVGKTSLLISYVEKVFKHENIPTIFENYVTNIQGPKGQIIELALWDTAGQEEYSRLRPLSYTGADVLMICYAIDSITSLKNVEDVWFPEVRHFCPGTPVMLVGLKSDLYEEESCDSKVDPAEADSIAKKNGAFAHIQCSAKLRVKVDNVFYAAINELLAEQLISQNHNAPILKSIFKLKKLKLSEPIDIEEQYYDGENGGDDNDGSSSGNVAALPSTIVKKNIRKSKCIVM

SEQ ID NO: 8083 - DNA, 657 bp, Kluyveromyces lactis NRRL Y-1140
  CDS (1)..(657)
atggcattaatagttgacaactttcgtagaaccctaggtgatattcctcattattcccaatgtggtgttaagggtagaagcgcacagtatcatttgaaaatagtagtagttggtgacggtgctgtggggaagacttcgttacttatttcctatacacaaggtaaatttcctgaagattatgtacccacgatatttgaaaactacgtgactaatttagagggaccaaatggtaagatagttgaattggcattgtgggacacagcaggacaagaagagtacagtcgacttagaccactgtcgtacaccgacgttgatgtattgatgatatgctatgcgattaacagtaaagtatccttttacaacattgaagaaatgtggttacctgaggtgaaacatttctgtcctgacgttccaataatgatcgtaggtttgaagagtgatctgtacgctgaagataacatttcagactttgtcgatgcatttaaagctgaagaaacagcgaaaagaatcggagcattcgtacatctgcaatgttcctcaaaatctcaacaaaaggtacgtgaagtcttcgatacagctatcactgctgccttgtatgacgaattgaaaccaaagaagaagaaactaaattcacgtcggaaatgtgtgattatttag

SEQ ID NO: 8084 - protein, 218 aa, Kluyveromyces lactis NRRL Y-1140
MALIVDNFRRTLGDIPHYSQCGVKGRSAQYHLKIVVVGDGAVGKTSLLISYTQGKFPEDYVPTIFENYVTNLEGPNGKIVELALWDTAGQEEYSRLRPLSYTDVDVLMICYAINSKVSFYNIEEMWLPEVKHFCPDVPIMIVGLKSDLYAEDNISDFVDAFKAEETAKRIGAFVHLQCSSKSQQKVREVFDTAITAALYDELKPKKKKLNSRRKCVII

SEQ ID NO: 8085 - DNA, 765 bp, Kluyveromyces lactis NRRL Y-1140
  CDS (1)..(765)
atgaggtctattaagtgtgtgatcgtaggcgatggtgcggtcggtaagacatcgttattaatttcgtacactacgaatactttcccacaggattatatcccaactgtttttgataactattcgactaccattgctcttccggatccatataatccggattctgagcctcagattttcaagttaaacctgtgggataccgctggtcaagaagaatatgacagactgagacctttatcgtaccctcaaactgacatattcctaatatgtttctcggtaaatgaacctaacagttttgagaacgtttacgataaatggttccctgagattaaacacagtacaaatttcgagaacttggatctttatcatcaaagcgggaaattgccaatcttattggttggtaccaaggccgatttgagagatgatgaccatgaacgtgaccgtttacaagagtctaactccgactttgtttcccaacaacaaattcaggaattggttaacaaattggggttaatgggttacgttgaatgttctgctgccactcaggtaggtgtccgtgaagttttcgagaaggctgtcgactgcgttgtatttgaaccggacagattagtcagagaatctctacaacaaaagcaacaggcacaagattctcaacaaaaaccaaaaacaaaacaagttaacaagaaaaacaccactgctcaacctgaaagcagtacaaaacctcaaaagtcaaagagatcaatcaagcgtaaatgtactattttatag

SEQ ID NO: 8086 - protein, 254 aa, Kluyveromyces lactis NRRL Y-1140
MRSIKCVIVGDGAVGKTSLLISYTTNTFPQDYIPTVFDNYSTTIALPDPYNPDSEPQIFKLNLWDTAGQEEYDRLRPLSYPQTDIFLICFSVNEPNSFENVYDKWFPEIKHSTNFENLDLYHQSGKLPILLVGTKADLRDDDHERDRLQESNSDFVSQQQIQELVNKLGLMGYVECSAATQVGVREVFEKAVDCVVFEPDRLVRESLQQKQQAQDSQQKPKTKQVNKKNTTAQPESSTKPQKSKRSIKRKCTIL

SEQ ID NO: 8087 - DNA, 975 bp, Debaryomyces hansenii CBS767
  CDS (1)..(975)
atgtctaaacgattttcagtgttgagtaagcctacggaggcagaagaaccgtcgttcaatccatatgataatgtcaagagaatatcgcagattgagaagcagaagaaagaatttaaccaacgatacaactcaccaaaaattatcatcagggatgatcctgtgatacctgattatcgtctcgtagacggatttaagaagcacgcgaattataatatgaaaatcgtagtcgtgggcgatggtggttgcggtaagacatgcttgcttgtatcatacgtccaacagaagtttcccgagatatatgtacccacagtgttcgaaaattatgtcgctcatatttccactccgactaataagataatagaattggcgctttgggatacagcaggacaggaggaatacgacaggttgaggccgttgtcgtacccggatgtcgatgtgttgttgatttgtttttctttggataatttgacgtctttgcaaaatgtcaaagataactggttccctgaggtatcgcacttttgtcctggaatcccaatagtattggttggaaccaaggcagatttgccaactactatagaccccgatttacccatccaattggccacagagatcaatgccgtagggtatatccaatgttcggccaagaccatgtttaacatcaaagctgtgtttaactttgcattggaccatttccagaagcaaatggagtaccacgaacaagtagagaaatcgcaaaagaataggttatcgaaagcctttggccattccagaagtcaatcagggaactcatataaaaagcaccactacaaaaactcatcgttggactctgccatgttattggatgggcctttaaccgaagataattttaccgaaaacccttatggaaactttggcaatgaaagcaagtataatgaagatgaatttgcatttacaaggacgctgaaaaagaaaaagagaaagtgcattattttgtaa

SEQ ID NO: 8088 - protein, 324 aa, Debaryomyces hansenii CBS767
MSKRFSVLSKPTEAEEPSFNPYDNVKRISQIEKQKKEFNQRYNSPKIIIRDDPVIPDYRLVDGFKKHANYNMKIVVVGDGGCGKTCLLVSYVQQKFPEIYVPTVFENYVAHISTPTNKIIELALWDTAGQEEYDRLRPLSYPDVDVLLICFSLDNLTSLQNVKDNWFPEVSHFCPGIPIVLVGTKADLPTTIDPDLPIQLATEINAVGYIQCSAKTMFNIKAVFNFALDHFQKQMEYHEQVEKSQKNRLSKAFGHSRSQSGNSYKKHHYKNSSLDSAMLLDGPLTEDNFTENPYGNFGNESKYNEDEFAFTRTLKKKKRKCIIL

SEQ ID NO: 8089 - DNA, 795 bp, Yarrowia lipolytica CLIB122
  CDS (1)..(795)
atgtcgtccctcaagcgactcagctactaccgcacatccgagtccgccaacccgagcagcttcgagttcatcgaaacggcggaatccgcacaaccagacgtccacatcaaggtggtggtggtaggagatggaggctgtggaaaaacatgtctgctggtgtcgtactcgcagggtgtctttcccgagcgatatataccgacggtctttgagaactacataaccacgctcaaggggcccaaaggagagattatcgagctggcgttatgggacacagcaggacaggaggagtacgaccggctcagaccactctcgtacccagacgtggatgtgctgctggtgtgctacagcgtggactcgccgtcatcgtttgaaaacgtggccgaaaagtggttccctgaggtgacgcatttctgtccagacacgccagtggtgctggtatgtctcaaaaccgatctcagagccgattccacatccgcccattatctcaaagctcagggactgagccacatcacgccgacgcagggcaaatccatggcacagagactcggagtgtacaaatacatggagtgctcatcaaaggacatgtctggcgttagagaggtgtttgcagtcgccatgggagcggtgctgaaggaaaaagggagatcaaagagaaccaaacctgtgcgatcacaaagtaaaggggcagcggcagcagcagcgtcagccacacgtccaaaattacaatccagaccagcctcggaaccgatcgagaagaagaagaagaagaaacgacaccagtgcttggtgttgtag

SEQ ID NO: 8090 - protein, 264 aa, Yarrowia lipolytica CLIB122
MSSLKRLSYYRTSESANPSSFEFIETAESAQPDVHIKVVVVGDGGCGKTCLLVSYSQGVFPERYIPTVFENYITTLKGPKGEIIELALWDTAGQEEYDRLRPLSYPDVDVLLVCYSVDSPSSFENVAEKWFPEVTHFCPDTPVVLVCLKTDLRADSTSAHYLKAQGLSHITPTQGKSMAQRLGVYKYMECSSKDMSGVREVFAVAMGAVLKEKGRSKRTKPVRSQSKGAAAAAASATRPKLQSRPASEPIEKKKKKKRHQCLVL

SEQ ID NO: 8091 - DNA, 843 bp, Aspergillus nidulans FGSC A4
  CDS (1)..(843)
atgtctggctcaatgtacgatgaccaatattatgcgacgtcgcgccgccattctctcgtcactcctccgccgtcagtggctccgcggcagaaccgaatgcgcagccagagtgttagagtgagcaacggcacagtcagtacagataacagcatgtccagtgggagggtatcggaagcgacaaatatcacccagccgccagcctattccaagaagttcgtggtggtgggagacggaggttgtgggaagacctgtctgttgattagttattcgcagggttactttccagaaaaatatgtcccgacggtatttgaaaactatatcacacaaacgcttcatagaaggtctgggaaaactgtggagttggcgctctgggatactgctggccaggaggaatacgaccgattgcgccctctctcatatcccgagaccgaccttctctttgtttgttttgctattgattgtcctgcatctcttgagaacgttatggataagtggtatcccgaggtgttgcatttctgccctacgaccccaattatcctcgttgggctgaaatcagacctgcgcaacaagcgaacgtgtatcgagctcctaaagacacaaggcttgacgcccgtcacgccggagcaaggtcaggcggtggccggccggatgaatgcatcgtatgtagagtgcagcagtaaggagatgcgaggtgtcgactctgtttttcaactggcagtggacactgtcgtgtccctcgaggagcaaaactgggacactcgcctaccgtcatcctccggaaaacctggtggcaagcccatcggtggtaagaagatcaagaagcgcagctgcaagattctgtga

SEQ ID NO: 8092 - protein, 280 aa, Aspergillus nidulans FGSC A4
MSGSMYDDQYYATSRRHSLVTPPPSVAPRQNRMRSQSVRVSNGTVSTDNSMSSGRVSEATNITQPPAYSKKFVVVGDGGCGKTCLLISYSQGYFPEKYVPTVFENYITQTLHRRSGKTVELALWDTAGQEEYDRLRPLSYPETDLLFVCFAIDCPASLENVMDKWYPEVLHFCPTTPIILVGLKSDLRNKRTCIELLKTQGLTPVTPEQGQAVAGRMNASYVECSSKEMRGVDSVFQLAVDTVVSLEEQNWDTRLPSSSGKPGGKPIGGKKIKKRSCKIL

SEQ ID NO: 8093 - DNA, 1041 bp, Candida albicans SC5314
  CDS (1)..(1041): transl_table=12
atgacacccaacggcagtaggagacattcggcgtacatggggtcgcccagaagccagcatagttccacaatggaaacaggttacaatccttacgaagcagtgcagaagaaacaggaattataccaaaataacaacggcaattcaccaaccgtcatcattgaagaagatccatacatcccaaattataaagagctgtctctagcaaataagaaaacaaattataacatgaaaattgtcgttgtcggtgacggtgggtgtggtaagacgtgtttattattagcatacacacaaaacaaatttccttcaatctatgttcccacagtttttgagaattatgtgacggcagtacagtcgcctaatggtaaaaccgtagaattggctctctgggatactgctggccaagaagaatacgataggttacgaccactaagctatcctgacgttgatattttattggtgtgttttgccgtggacaatgaagttagtttggagaatgtcaaggatatgtggttccccgaagtgaatcattattgtcctggtattcccattattttggttggtaccaagagtgatttactgtctgatatgaatcacgatgcatctatacgagtagccaaagaaattggcgccattggattgattttcacatcagccaagaccatgttcaatgtacggactgtttttaattttgcattaaaccattttcaaagaaatatggaattacaggaacaatatgaaaagacattgggttcaagaaagagaataagtagagtattgggtggtagtaatggaggcagtgggaaccattccagacatcattctagaaactactccaacgtttcgaacaacagaaggggccatttgaagaacacatcatacgattccacggcattgttggatcaaccgttgacagaagacacctatgtgaaaaatccttatgggaactttggctataaagcaaatgttgaaagtccgtataatcaggatgagtttgcatttacaagagaaagaaagaagaaaaaaaagtgtgtaatattgtag

SEQ ID NO: 8094 - protein, 346 aa, Candida albicans SC5314
MTPNGSRRHSAYMGSPRSQHSSTMETGYNPYEAVQKKQELYQNNNGNSPTVIIEEDPYIPNYKESSLANKKTNYNMKIVVVGDGGCGKTCLLLAYTQNKFPSIYVPTVFENYVTAVQSPNGKTVELALWDTAGQEEYDRLRPLSYPDVDILLVCFAVDNEVSLENVKDMWFPEVNHYCPGIPIILVGTKSDLSSDMNHDASIRVAKEIGAIGLIFTSAKTMFNVRTVFNFALNHFQRNMELQEQYEKTLGSRKRISRVLGGSNGGSGNHSRHHSRNYSNVSNNRRGHLKNTSYDSTALLDQPLTEDTYVKNPYGNFGYKANVESPYNQDEFAFTRERKKKKKCVIL

SEQ ID NO: 8095 - DNA, 727 bp, Musa acuminata
  CDS (24)..(614)
ggtggaggagatcggcggaggagatgagcgcgtcgaggtttataaagtgcgtcacggtgggggacggtgccgtcggcaagacttgcatgcttatctcctacaccagcaacactttccccacggattatgttcctaccgtttttgacaatttcagcgcaaatgtagtggtggatggtaacacagttaacttaggtttgtgggatactgcaggccaagaggattacaatagattaagacctttgagctaccgtggtgcagatgttttcttgcttgctttctctctcattagtaaagccagctatgaaaatgttgccaagaagtggattcctgagctaaggcactatgcacctggtgtgcccataattcttgttggaacaaagcttgatcttcgggatgagcagcagttctttatagatcacccaggtgctgttcccataagtaccgctcagggggaggagctgcggaagcaaataggtgctgcttcgtacatagagtgcagttcaaagactcagcaaaatgtcaaggcggtattcgatgcggccatcaaggtcgtgcttcagccacccaagcagaagaagaaaaaaaagcaacagaaaggttgctccatattgtgataatctagcatgcaaaaggtggtagccagcgatttattcgagcgactcgttcaaattcagggaatttggtaccagcgcacaaccaacaaatgcagcatcattatcagtgcgtc

SEQ ID NO: 8096 - protein, 196 aa, Musa acuminata
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVAKKWIPELRHYAPGVPIILVGTKLDLRDEQQFFIDHPGAVPISTAQGEELRKQIGAASYIECSSKTQQNVKAVFDAAIKVVLQPPKQKKKKKQQKGCSIL

SEQ ID NO: 8097 - DNA, 1139 bp, Arabidopsis thaliana
  CDS (66)..(875)
tcgacccacgcgtccggtctagtcttttatattgtagataatatttctatctggacataacaacaatggcagatgcaaacgaagtagtggaatgggccaacaatttaaagtgggataaatatgctggaaataaagaaattgttgatggattggccgctttgagacaaaaaatcacagctttggacggcgctgaaggaggctctggtggcaatcaaagagttaaattagtagttgtcggtgatggtgccgtcggcaaaacatctctgttgatttcattcgctgaaaacaaattccctgaggattacgtccctacagtcttcgaaaactacacttctaaaatcactcgcgacgatggtacacttgttctgttgcatttgtgggatacagccggtcaagaggactacgaccgattgagacctttgagttatcctggcgctgatgtcatcctgctctgtttctccaccgtcactgcctcgtcattcgcctccattaaagaaaagtggtaccccgaagtcaaccactacgtgcccgatgctccttatattttggtcggcaccaagctcgacttgcgtgaggctggtctgcccgatccctccactggtgagtcagatcccgtcacccccgagaaggctgaggagatgcgaaagcaaatcaaagcgttgaagtatattgaagtctctgccaagacacgaaagaacttgcagactctgttttcagaagccgtggacattgtcttggctgaacgacgcgcacacgagcctcccaagcccaccgctgcttcatcgacgaacggcactaacggcactaagactgagcacactcctcgcgaagagcccatccgaaagaagaaggagcgtcgctgcttgttgatgtaagagccctgtgattggtcactctaacatcgactcgagatctgcactattactattttatttgtcgtttttaactttatttaatcaaaaaaccctttcaaccaataagccacgataagagtcgtgcagtcaaatttattttggtagcccttggatctgctatcaagattttcttgtattatcgacttgtaattaataggactgtagcgatatcgtgcttctttatttatttcaataaaaacaaaaaattaaaaaaaaaaaaaaaaa

SEQ ID NO: 8098 - protein, 269 aa, Arabidopsis thaliana
MADANEVVEWANNLKWDKYAGNKEIVDGLAALRQKITALDGAEGGSGGNQRVKLVVVGDGAVGKTSLLISFAENKFPEDYVPTVFENYTSKITRDDGTLVLLHLWDTAGQEDYDRLRPLSYPGADVILLCFSTVTASSFASIKEKWYPEVNHYVPDAPYILVGTKLDLREAGLPDPSTGESDPVTPEKAEEMRKQIKALKYIEVSAKTRKNLQTLFSEAVDIVLAERRAHEPPKPTAASSTNGTNGTKTEHTPREEPIRKKKERRCLLM

SEQ ID NO: 8099 - DNA, 950 bp, Nicotiana tabacum
  CDS (44)..(637)
ccccccccccccccccaaaaaaaaaaaaaaaaaaaaaaaaaaaatgagtgctccaaggtttatcaagtgtgttacggttggtgatggtgccgttgggaaaacttgtcttttgatttcatacaccagcaatactttccctatggattatgtgcccactgtgtttgacaatttcagtgcaaatgttgttgtcaatgggagcactgtcaacctagggttgtgggatactgccggacaggaggattacaataggttaagacctctgagttaccgtggagccgatgtcttcattttggcattctctctcattagtaaagccagctatgagaatgtatccaagaagtggattcctgagttgaagcactatgctcctggtgtcccaatagttcttgttggaacaaaacttgatcttcgggatgataagcaattcttcatagaccaccccggtgctgtgccaattactactgctcagggtgaggagctaaggaaaactataggtgcacctgcttacatcgaatgtagttcaaaaacacaacagaatgtgaaagcagtctttgatgcagccattaaggtcgtcctccagccgcctaaaacaaagaaaaagaaggggaaatcacaaaagtcctgctcgatattgtgatcaaactgtaggtccaagcgatattgctggccacaattctcgttgtaatccctcactcgtatccttttatcttcctcgtctcagaggaagtacgaggtcatcgtttgtcttatatttgaaactactaaccatctcttggaaatatcaggtggcttggtttttctgtatcattctggtctctaattatttaagtcacagcaccttgtagtaggccactctagtgtgtcctttgttttgatttgctttatgtattaactactgaatgatccagttagggagcaatttttttcttttcgaaaaaaaaaaaaaaaaa

SEQ ID NO: 8100 - protein, 197 aa, Nicotiana tabacum
MSAPRFIKCVTVGDGAVGKTCLLISYTSNTFPMDYVPTVFDNFSANVVVNGSTVNLGLWDTAGQEDYNRLRPLSYRGADVFILAFSLISKASYENVSKKWIPELKHYAPGVPIVLVGTKLDLRDDKQFFIDHPGAVPITTAQGEELRKTIGAPAYIECSSKTQQNVKAVFDAAIKVVLQPPKTKKKKGKSQKSCSIL

SEQ ID NO: 8101 - DNA, 942 bp, Brassica campestris
  CDS (59)..(655)
ggatcccccaaaaatccccaaatcttgaaaagtttaggttttgaagtttgagagagagatgagtgcttcgaggtttatcaagtgtgtcaccgtcggcaacggcgctgtcggaaagacttgtctgctcatttcctacactagcaacactttccccacggactatgtgccaactgtgttcgataatttaagcgccaatgtgattgtggatgggaacactatcaacttgggattgtgggatactgcaggacaagaggactacaatagactaagaccattgagctatcgcggcgcagatgtcttcttacttgccttctctctcgtcagcaaagctagctatgaaaatgtttctaaaaagtgggtgcctgaactgagacattatgcacctggtgttcccatcatcctcgttggaaccaagcttgatcttcgagatgacaagcaattctttgttgagcaccctggtgctgttcctatctctactgctcagggtgaagaactgaagaagctgattggggcacctgcttatatcgaatgcagtgcaaaaacacaacagaatgtaaaagcggtgtttgatgcggctatcaaggtagttctccagccacccaaaaacaagaagaggaagaagagaaagtctcagaaaggttgttctatattgtgattcaatagagagagagagagagagagagagagagagagagaaggaatcaacatgaggattgaagtagctccacctgtttgtttccttcaagaaaggaaggaactgttgtttgtagcctttaaaaatattcttgttttcattttgatctgtaaatataccatggatccttttatttctttgcttcctagactcacgacttgtttagagattaatctccaataacgttttatgtggtttcagccacatataatcagttatgaacaagtatattaaaaaaaaaaaaaaaa

SEQ ID NO: 8102 - protein, 198 aa, Brassica campestris
MSASRFIKCVTVGNGAVGKTCLLISYTSNTFPTDYVPTVFDNLSANVIVDGNTINLGLWDTAGQEDYNRLRPLSYRGADVFLLAFSLVSKASYENVSKKWVPELRHYAPGVPIILVGTKLDLRDDKQFFVEHPGAVPISTAQGEELKKLIGAPAYIECSAKTQQNVKAVFDAAIKVVLQPPKNKKRKKRKSQKGCSIL

SEQ ID NO: 8103 - DNA, 636 bp, Gossypium hirsutum
  CDS (1)..(636)
atggcttcaagcgcttcaagatttatcaaatgtgtaacagttggagatggagctgttggcaagacttgcatgcttatttgctatacaagtaacaagttcccgacagattacataccaacagtttttgataacttcagtgccaacgttgtagttgaaggcacaactgtgaacttaggtctttgggacacggctggacaagaggattacaacagactaaggccattgagctacagaggtgcagatgtctttgtcctagctttctcattagttagtcgagcaagctatgagaacatactaaaaaagtggattcctgaacttcagcattatgccccaggcgtccctgtggttctggttggcaccaaattggatcttcgtgaggataaacattatctggctgatcatcctggcttgctgccggttagcactgcacagggtgaggagctctgcaaacagataggtgctgcttattacattgagtgcagctcaaaaactcagcagaacgtgaaagcagtttttgatgctgcaatcaaagttgtgatcaagccaccccaaaaacagaaggagaagaagaaaaagccaagtcgaggatgtctaataaatgtcttctgcgggaggaactttgtgcctgctaaatga

SEQ ID NO: 8104 - protein, 211 aa, Gossypium hirsutum
MASSASRFIKCVTVGDGAVGKTCMLICYTSNKFPTDYIPTVFDNFSANVVVEGTTVNLGLWDTAGQEDYNRLRPLSYRGADVFVLAFSLVSRASYENILKKWIPELQHYAPGVPVVLVGTKLDLREDKHYLADHPGLLPVSTAQGEELCKQIGAAYYIECSSKTQQNVKAVFDAAIKVVIKPPQKQKEKKKKPSRGCLINVFCGRNFVPAK

SEQ ID NO: 8105 - DNA, 834 bp, Phaeosphaeria nodorum
  CDS (1)..(834)
atgtcgacggcgccttcgcaaaactacgactatctgcgtcgcaagcagagcacaaaggccgcctacacgtcgtccatcacacccgtccgcaagccagtgcgaacccccagcgaacggaacagcaatggcaccgtgagctcctacagcaccaccaacacacgcgacacaaacatcaccgagccgccgacgtactcgaaaaagctggtcgtggtcggtgatggtggatgcggcaagacttgtctgctgatcagctacagctctggcaacttcccagagaaatatgtgcccaccgtcttcgagaactacatcacccacacaccgcaccctcccacaggcaagatggtcgagcttgccctctgggacacagccggacaggaagagtacgatcgcttacggccgctctcctaccccgagaccgacatcatctttgtgtgcttcgccatcgactgccccaactcgctagaaaacgtcatggacaagtggtaccccgaggtcctccacttctgccccacgacccctctgatgctcctcggtctcaagtcggacctgcgcaacaagaagaactgcatcgagctactcaagacacaaggcctcacaccagtgacgcccgaccaaggccgcgcagttgccaagaagatgggtgccatctacatggagtgcagtagtaaagagcaggatggcgtagaggaaatcttcgacctcgcagtcacaatggccgttggcgacgagtataagacaccagagcaacggggccaacctgcacaaagagggcaccaggaagccctcgccacagccggcaagaagaagaagcgcagcggctgcaaggttctgtag

SEQ ID NO: 8106 - protein, 277 aa, Phaeosphaeria nodorum
MSTAPSQNYDYLRRKQSTKAAYTSSITPVRKPVRTPSERNSNGTVSSYSTTNTRDTNITEPPTYSKKLVVVGDGGCGKTCLLISYSSGNFPEKYVPTVFENYITHTPHPPTGKMVELALWDTAGQEEYDRLRPLSYPETDIIFVCFAIDCPNSLENVMDKWYPEVLHFCPTTPLMLLGLKSDLRNKKNCIELLKTQGLTPVTPDQGRAVAKKMGAIYMECSSKEQDGVEEIFDLAVTMAVGDEYKTPEQRGQPAQRGHQEALATAGKKKKRSGCKVL

SEQ ID NO: 8107 - DNA, 597 bp, Solanum chacoense
  CDS (1)..(597)
atgagtgcttctaggtttataaagtgtgttactgtgggcgatggagctgtgggtaaaacttgtcttctcatttcgtataccagcaacacttttcccactgattatgtcccaactgtatttgacaattttagtgcaaatgtggtcgtcgatggaagcactgttaatctggggctctgggatactgcaggtcaggaggattacaatagattaagacctttgagctatcgtggggcagatgtatttatactggcattttctctcattagcaaggcgagctatgaaaatgtctccaaaaagtggattcctgaattgaggcattatgctcctggagttccaattattcttgttggaacaaagctagatctccgagaggataaacaattctttgtggaccatccaggtgctgttccacttagcacagctcagggtgaggagctgagaaagtcgattggtgctgctgcttacattgaatgtagtgcaaaaacacaacagaacattaaggctgtttttgatgctgccattaaggtggtcctacaaccaccccagcaaaagaagaagaagaagagaaagggtcagaaagcctgctctatcttgtga

SEQ ID NO: 8108 - protein, 198 aa, Solanum chacoense
MSASRFIKCVTVGDGAVGKTCLLISYTSNTFPTDYVPTVFDNFSANVVVDGSTVNLGLWDTAGQEDYNRLRPLSYRGADVFILAFSLISKASYENVSKKWIPELRHYAPGVPIILVGTKLDLREDKQFFVDHPGAVPLSTAQGEELRKSIGAAAYIECSAKTQQNIKAVFDAAIKVVLQPPQQKKKKKRKGQKACSIL

SEQ ID NO: 8109 - DNA, 947 bp, Medicago truncatula
  CDS (144)..(773)
gataccaaaatccagaacaccctttcttcatttacttcacactcttcaaatctcaatcaaaacttttgaggttgtttctttctacattaagaacacacaaacactgttgtgtttcaacaaaaccttagttccatttatacaatatgagtgcatcaaagttcattaaatgtgtcactgttggtgatggtgctgttggaaaaacttgcatgctcatttgttacaccagtaacaaattccccactgattatataccaacagtatttgataattttagtgcaaatgtagctgtggatggaagcattgtgaatttggggctatgggacactgcaggccaggaagactatagcaggttgaggccactgagctatagaggagctgatatatttgtcttagcattctcattgattagtagagctagctatgaaaatgttcttaagaagtggatgccagaattgcgcagattcgcccctaatgtaccaattgttcttgttggcacaaagttggatcttcgtgaagatcgtggatatttcgctgatcacacgggatataatgttataacatctgctgagggagaagaactgaggaaacaaattggggctgcagcgtacattgagtgcagctcaaagactcaacagaatgtgaaagctgtttttgatactgccattaaggttgttctccaacctccaaggaggaaagaaatgccgaggaagaaaaggcaaagaaggtccggttgctcgtttgccggtattgtgtgtggaggttgtgctgcttaatacacacatcaattgtaccatcactttcttttgcttcaaggtcaaatgtggaattctgacatctgattagtgattacatggctaaaaatgtattcttattatgcttgtattgtagtgtaagttagtatatctagctattttcagttaacaaaagaccctattggattctgaagg

SEQ ID NO: 8110 - protein, 209 aa, Medicago truncatula
MSASKFIKCVTVGDGAVGKTCMLICYTSNKFPTDYIPTVFDNFSANVAVDGSIVNLGLWDTAGQEDYSRLRPLSYRGADIFVLAFSLISRASYENVLKKWMPELRRFAPNVPIVLVGTKLDLREDRGYFADHTGYNVITSAEGEELRKQIGAAAYIECSSKTQQNVKAVFDTAIKVVLQPPRRKEMPRKKRQRRSGCSFAGIVCGGCAA

SEQ ID NO: 8111 - DNA, 588 bp, Fusarium oxysporum
  CDS (1)..(588)
atggctgagatccgccgaaagctcgtcattgtcggcgatggtgcttgtggtaaaacctgtttgttgattgttttctccaagggcactttccctgaggtctacgtccccaccgttttcgagaactacgtcgccgatgtcgaggttgatggcaagcacgtcgagctcgcactatgggatactgctggtcaggaggattacgaccgtcttcgacccctgtcttaccccgactcccacgttatcctgatctgcttcgctgttgactctcccgactctcttgacaacgtccaggagaagtggatctctgaggttctgcacttctgccaaggtctccctatcattcttgtcggctgcaagaaggatttgcgatacgaccagaagaccatcgaggagctccgaaagaccagtcagaagcctgtctcccccgaggagggtgaggaggttcgcaagaagatcgctgcctacaagtaccttgagtgctcagccaagaccaacgagggtgtccgcgaggtgttcgagcacgctactcgcgctgctctgctgtcgcgaagcaccagtggtagcaagcacaagaagtgccttgttctgtaa

SEQ ID NO: 8112 - protein, 195 aa, Fusarium oxysporum
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRYDQKTIEELRKTSQKPVSPEEGEEVRKKIAAYKYLECSAKTNEGVREVFEHATRAALLSRSTSGSKHKKCLVL

SEQ ID NO: 8113 - DNA, 1149 bp, Capsicum annuum
  CDS (256)..(849)
ttacggccggggaatacaaaacacttctcttcttcatccctttgtctcacacacaaacatacatagtttttttttttcaggcaacaacctattcaacagcagtattttcaggcaacaaaaaagatggggtattgaaaggaagcattacattgtttgttttattgagcaggtcttctaaagaagatctgataagaagtgggtcattgttagtttaccgttttatccccctacaacagcaagaagaagaggagaattatgagtgcttccaggtttattaagtgtgttacagtgggtgatggtgctgttggcaagacttgtttattgatttcttacacaagcaatactttccctacggactatgtgcccaccgtgttcgacaatttcagcgcaaatgtggttgtcaatggagccactgtcaacctagggttgtgggatactgctggacaggaggactacaataggttaagacccctgagttaccgtggggccgatgttttcattttggcattctctctcattagtaaagccagctatgagaatgtctccaagaagtggattcctgagttgaagcactatgctcctggtgtcccaatagttcttgttggaacaaaacttgatcttcgggatgacaagcaattcttcgtagaccatcctggtgctgtgccaattgctactgctcagggcgaggagctaaggaaaacaatcggtgcaccatcttacgttgaatgtagttcaaaaacacagcagaatgtgaaagcagtctttgatgctgccattaagggtcgtcctccagcctcccaagacgaagaaaagaaggggaaatctcaaaaggcctgctcgatattgtgatcaactgtagtaggaccaaccaacgatatggctcgtcacaattcccgttgtaacatccccccgtaatatcctttgtcttctttcgtcctcggaggaagtagaggtcttcgtcttgttcttttcgactactacgatcctcctcgaaagtgtcaggtggctgatttatgtataattgtgtcatccacttgtaagccactctaagttgccatttgtttgatcgtttatgtattaacactggatgatccagtagaagcgtcttccgcagagatgacaaaactgtggggcctcttggtaagttat

SEQ ID NO: 8114 - protein, 197 aa, Capsicum annuum
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFVDHPGAVPIATAQGEELRKTIGAPSYVECSSKTQQNVKAVFDAAIKGRPPASQDEEKKGKSQKACSIL

SEQ ID NO: 8115 - DNA, 727 bp, Medicago varia
  CDS (1)..(579)
atgcagagcatcaagctcgttgtcgtcggtgacggtgccgtcggcaagacctgcctgctcatcgcctacacctccaactccttccctcaggagtatgtgcccaccgtgtttgacaactactctgccaacgtcatggtcgatggtcgcatggtttccctcggtctttgggacacggccggccaggaggattacgaccgtctccgccccctgtcttaccctggcaccgacgtgttcctcctctgcttctccgtgatctcccccacctctttctcgaacgtgaagagcaagtggtggcctgaggtctctcaccactgccccaacgccaagatgatcctcgtgggcaccaagatggatctccgcgacgaccgtgacaccctcgacggtctcaagcgcaagggcctctcccccatctctcagactgatggtgagggcctcgcccgcgatatcggcgccgtcgcctacatggagtgctctgccctcacccaggctggcctcaagcaggtgttcgacgaggccatcaaggccgtggtcgtcaaaaaaaccccatccccgcaagaaaaaaattgcaccctcttctaaacgggactctcgatgtattggagcgacagggctgcctcttggccttctgctctccttttcggtgacatgcaaaggctctagctaacttgtggcgctgttgtatttttgtaagtgaggaatggctcaaaaaaaaaaaaaaaaactcgag

SEQ ID NO: 8116 - protein, 192 aa, Medicago varia
MQSIKLVVVGDGAVGKTCLLIAYTSNSFPQEYVPTVFDNYSANVMVDGRMVSLGLWDTAGQEDYDRLRPLSYPGTDVFLLCFSVISPTSFSNVKSKWWPEVSHHCPNAKMILVGTKMDLRDDRDTLDGLKRKGLSPISQTDGEGLARDIGAVAYMECSALTQAGLKQVFDEAIKAVVVKKTPSPQEKNCTLF

SEQ ID NO: 8117 - DNA, 594 bp, Medicago varia
  CDS (1)..(594)
atgagtggttccaggttcatcaagtgtgtcactgttggtgatggtgccgttggaaagacttgtttgcttatctcttacaccagtaacactttccctacggactatgtgccgactgtctttgacaatttcagtgcaaatgtagttgtggatgggagcactataaatctcgggttgtgggatactgctggccaagaagattacaatagattaagacccttaagctatcgtggagcagatgtttttctgcttgctttttctctcataagcaaggccagctatgaaaatattgccaaaaaatggattcctgagttgaggcattatgctcctggtgttccaattattctcgttggaacaaaacttgatcttcgggatgatagccagttctttcaagaccatcctggtgcagcaccaataaccacagcacagggtgaggaactgaaaaaacttatcggtgctccaatttacattgaatgttattccaaaacacaaaagaatgtgaaggctgttttcgattcggccatcaaagtagttctacaaccgccaaagcaaaagaaaacaaagagaaaggggcaaaaagcatgttccattttgtga

SEQ ID NO: 8118 - protein, 197 aa, Medicago varia
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELKKLIGAPIYIECYSKTQKNVKAVFDSAIKVVLQPPKQKKTKRKGQKACSIL

SEQ ID NO: 8119 - DNA, 1106 bp, Medicago varia
  CDS (194)..(787)
tgccttcttctctcacagggttagggtttcctcatttccttctttttttccccaaatttcccaattctgcattttctcaattaggatgtgtgatagtaattgaaagagaagaagaataagaagaaagtactggaggaggggaactgtcctcaggtgaagatctgaggctattttgggtatttcatttttcaagatgagtgcttctaggtttattaaatgtgttactgttggtgatggagctgttggaaaaacttgtttgttgatttcttacaccagcaatactttccccacggattatgtgccgacagtttttgacaatttcagtgcgaatgtggttgttaatggaagtattgtgaatctgggtttgtgggatactgctgggcaagaggattataacagattaagacctttgagttaccgtggtgccgatgttttcatattggctttctctctcataagcaaagccagttatgaaaatgtctccaaaaagtggattccagagttgaagcattatgcacctggtgtccccataattctggttggaacaaagcttgaccttcgggatgatcagcagttctgcatagaccatcctggtgccgttcccattaccacagctcagggagaagagctgaggaagctgattaatgcaccagcttacattgaatgcagttcaaaatcacaggagaacgtgaaggcggtgtttgacgcagccataagagttgtccttcaaccaccaaagcagaagaaaaagaagaataaagcacaaaaggcctgttcaatattgtaattcactaggtgtaaacatttgattgtcctttgttctacctgtattcccctccccttcttttcatcattttctttgttattgaagaagttggagagtctgtgtgggtgttctttcagacaaatactctagatctccttgaagcataaggtggcttaatgttttgctttctatgaattattattgtcaactctaatagttaaatttgcatttcatgcttcccatatttttttaagtttttattgatgtactattaaattgaaatatactagttagtacaaacgacatttcttgtcatttggttaaaaaaaaaaaaaaaaaa

SEQ ID NO: 8120 - protein, 197 aa, Medicago varia
MSASRFIKCVTVGDGAVGKTCLLISYTSNTFPTDYVPTVFDNFSANVVVNGSIVNLGLWDTAGQEDYNRLRPLSYRGADVFILAFSLISKASYENVSKKWIPELKHYAPGVPIILVGTKLDLRDDQQFCIDHPGAVPITTAQGEELRKLINAPAYIECSSKSQENVKAVFDAAIRVVLQPPKQKKKKNKAQKACSIL

SEQ ID NO: 8121 - DNA, 1104 bp, Medicago varia
  CDS (177)..(770)
taaagaacgaacgcttcaacggcaaaatttcccgggttccttgtctctctttcatgcgcgacaatttccattttctcacgctcctaaaggatgcgtaattgaagcgaataattggaggtgtgtgtgagtgatttggagtgataaaggtgaaagatctggatagggtttgaaagaagatgagcgcttctaggttcatcaagtgtgttactgttggggatggagctgttggtaaaacttgtttgttgatttcatacaccagcaataccttccccactgattatgtgccaactgtcttcgacaatttcagtgcaaatgtggttgtgaatggaagcactgtgaatctgggtttatgggacactgcaggacaagaggattataacagattaagacctttgagttatcgtggtgctgatgttttcattctcgctttctcactcataagcaaggccagttatgaaaatgtttctaaaaagtggattcgagagttgaagcattatgcacctggtgttcccattattctggttggcacaaagcttgaccttcgggatgacaagcagttctttgtcgaccatcctggtgctgttcccattaccaccgctcagggagaagagctcaggaagctgatcaatgcacctgcttatattgaatgcagttcaaaatcacagcagaacgtcaaagcagtctttgatgcagccataagagttgtccttcaaccaccaaagcaaaagaaaaagaagagtaaagctcaaaaggcctgttcgatattgtgatttgctaggtcggtctaaagaaatttgacaaccattctccaacatgtatttctctcctcttcttcctattcttcattcctattatattgaagaagttggagtctatgtgggtgttctttcgtctaacagactctcttgttgaagcataaggtggttggtgctttgctttcttggaattattgtgaattctaattgtcaaatttgtatttcatggttcccacctttttcttaacttaagtttatgtattaatagactggaatatcccagttaggatgactaccttgtttgcttgaagatatatataatatctacattattttgcatttcaaaaaa

SEQ ID NO: 8122 - protein, 197 aa, Medicago varia
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIRELKHYAPGVPIILVGTKLDLRDDKQFFVDHPGAVPITTAQGEELRKLINAPAYIECSSKSQQNVKAVFDAAIRVVLQPPKQKKKKSKAQKACSIL

SEQ ID NO: 8123 - DNA, 877 bp, Gossypium hirsutum
  CDS (1)..(636)
atggcttcaagcgcttcaagatttatcaaatgtgtaacagttggagatggagctgttggcaagacttgcatgcttatttgctatacaagtaacaagttcccgaccgattacataccaacagtttttgataacttcagtgccaacgttgtagttgaaggcacaactgtgaacttaggtctttgggacacggctggacaagaggattacaacagactaaggccattgagctacagaggtgcagatgtctttgtcttagctttctcattagttagtcgagcaagccatgagaacgtactaaaaaagtggattcctgaacttcagcattatgccccaggcgtccctgtggttctggttggcaccaaattggatcttcgtgaggataaacattatctggctgatcatcctggcttgctgccggttagcaccgcacagggcgaggagctccgcaaacagataggtgctgcttattacattgagtgcagctcaaaaactcagcagaacgtgaaagcagtttttgatgatgcaatcaaagttgtaatcaagccaccccagaaacagaaggagaagaagaaaaagccaagtcgaggatgtctaataaatgtcttctgcgggaggaacttcgtgcctgctaaatgagacggattggcttcagtcaaaaatcaaatgcttgtgttcctcttgctacctagagattctttttagacaaacaggatcaagtcggcttgtttatcatgcaacgcttttagcatacagatttatttctaatcttacgctttaattcggatgctaatttaccatagtgatttcttgtatagagttaaagcttaatggacttgtggttttatgcatgaaaaaaaaaaaaaaaaaaaaaaaaaaa

SEQ ID NO: 8124 - protein, 211 aa, Gossypium hirsutum
MASSASRFIKCVTVGDGAVGKTCMLICYTSNKFPTDYIPTVFDNFSANVVVEGTTVNLGLWDTAGQEDYNRLRPLSYRGADVFVLAFSLVSRASHENVLKKWIPELQHYAPGVPVVLVGTKLDLREDKHYLADHPGLLPVSTAQGEELRKQIGAAYYIECSSKTQQNVKAVFDDAIKVVIKPPQKQKEKKKKPSRGCLINVFCGRNFVPAK

SEQ ID NO: 8125 - DNA, 839 bp, Gossypium hirsutum
  CDS (1)..(588)
atgagcgcctcgagattcataaagtgcgtcaccgtcggcgatggagccgtcggaaagacctgcttgctgatttcctacaccagcaacactttccctacggactatgtcccgactgttttcgacaatttcagtgcaaatgtcgtcgtcgatggcagcactgtcaacttaggtttatgggacactgctggtcaggaggattacaatagactacgaccactgagctatcgtggggctgatgtgtttattcttgcattttctctcatcagcaaggccagttatgaaaacgttgccaagaagtggattcctgaactaaagcattatgcccctggtgttccgatagttcttgttggaactaagcttgatctccgagatgatcaacaattcttaacagaccatcctaacgcagtgcccatttctacagctcagggagaggaattaaagaaacagattgcggctcctgcatacattgagtgtagctcaaaaacacagcagaatgtgaaggcagtgtttgatgcagccattaaggtagtgctgcagcctccgaataaaaataagaagaaaaagtcaggtggttgctcaatattatgatcagatgaagattcttcaagtctgaaaaagatggaaccaactgccagcttctcgctgctcgtatctctatatcaattttactcttattttttttctagttcaaggaaaacagcaagccatcatgtttagcatcaagtcttaacctgactttctatggactttctgtgaaagcatcaggtgattttgtttcgtgttttttacttagatgacaagtattccttgttaaaaaaaaaaaaaaaaaaaaaaaaaaa

SEQ ID NO: 8126 - protein, 195 aa, Gossypium hirsutum
MSASRFIKCVTVGDGAVGKTCLLISYTSNTFPTDYVPTVFDNFSANVVVDGSTVNLGLWDTAGQEDYNRLRPLSYRGADVFILAFSLISKASYENVAKKWIPELKHYAPGVPIVLVGTKLDLRDDQQFLTDHPNAVPISTAQGEELKKQIAAPAYIECSSKTQQNVKAVFDAAIKVVLQPPNKNKKKKSGGCSIL

SEQ ID NO: 8127 - DNA, 600 bp, Aspergillus niger
  CDS (1)..(600)
  misc_feature (108)..(108): s is g or c
atggccactggtccagctactcaatccctcaagtgtgtggtgacgggtgatggtgcggtaggaaagacatgtctcctgatttcgtacacgaccaacgctttccccggsgaatatatccctaccgtatttgataactacaccgctagtgtcatggtagatggccgaccgattagcttgggactctgggatactgctggacaggaagattacgaccgtcttcgcccattgtcctacccgcaaaccgacgtcttcctgatctgcttctccatcgttagcccgccgtcctttgacaacgttaaagccaagtggttcccggagattgaacaccatgcccccaacgtccccattatcttggtcggcaccaagctcgaccttcgagacgaccgtggtaccatagatgctctccgacagcggaagatggagcccgtctcctacgaacaagctctggccgtggccaaggaaatccgggcacacaagtacctcgaatgttcggccctgacgcagcgcaacctgaagagtgtattcgacgaggcgattcgcgccgtgctcaatccccggcctgcggccaaaccgaagaacaagaaatgcgtgattctgtag

SEQ ID NO: 8128 - protein, 199 aa, Aspergillus niger
MATGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKAKWFPEIEHHAPNVPIILVGTKLDLRDDRGTIDALRQRKMEPVSYEQALAVAKEIRAHKYLECSALTQRNLKSVFDEAIRAVLNPRPAAKPKNKKCVIL

SEQ ID NO: 8129 - DNA, 916 bp, Vigna radiata
  CDS (122)..(712)
aagactttcgttaagggatactcaccacccaccttttctttctttcactttcgttatttctacctcaaaacttgttcataaatattgttccactagtttctaagcattgcaacataaaagaatgagtacggccaggtttatcaagtgtgtaacagttggagatggtgctgtgggaaagacatgcatgctcatatcctataccagcaacacgtttcccacggattatgttccaactgtgtttgacaattttagtgctaatgtaactgtggacggtagtacggtgaatcttggtttatgggatactgcaggacaagaagattacaacaggctaaggcctttaagctatagaggagctgatgtgtttttgttgtgctattcgctcatcagcaaagccagttatgagaacatttccaaaaagtggatacctgagctcagacattatgctccaaatgtgcctatagtgctcgtgggaacaaaactagatttgcgagatgacaagcagtttctgattgatcatcccggaggcacacgaattacaactgctcagggtgaagaattgaagaaaatgattggtgcagtcacatatattgagtgcagctccaaaacacagcagaatgtgaagacagtttttgatgctgcaataaaggtcgcattgaggccaccaaagccaaagaagaaaccacgcaagaaaaggacctgttttttcctctaatatttcatattcatccaactcatttatatagcattattgaagccaatgcttttagtctttgtgatctatatatataaaaagcctatgaagtgtatggattattcctgagaagaactttagattccttttaagtgagaacttcagcactgcattgttcaattaattatttcattttgcaatgtccaaaaaaaaaaaaaaaaaaaa

SEQ ID NO: 8130 - protein, 196 aa, Vigna radiata
MSTARFIKCVTVGDGAVGKTCMLISYTSNTFPTDYVPTVFDNFSANVTVDGSTVNLGLWDTAGQEDYNRLRPLSYRGADVFLLCYSLISKASYENISKKWIPELRHYAPNVPIVLVGTKLDLRDDKQFLIDHPGGTRITTAQGEELKKMIGAVTYIECSSKTQQNVKTVFDAAIKVALRPPKPKKKPRKKRTCFFL

SEQ ID NO: 8131 - DNA, 931 bp, Arabidopsis thaliana
  CDS (45)..(692)
gcttccttttggtatttgctttgtatgtttgttttgagatcaaaatggcttcaagtgcttcaaagttcatcaagtgtgtgactgttggtgatggtgctgttggtaaaacctgtatgctcatctgctacaccagcaataaattccccactgactacataccaacagtttttgacaactttagtgcaaatgttgttgttgaaggcaccactgtcaatttggggctttgggacactgctgggcaagaagactataacagattaaggcctttaagttacaggggagcagatgttttcgtcttgtctttctcattagtcagccgagttagctacgagaatgtttttaaaaagtggatccctgaactccaacactttgctccaggagttccccttgtccttgttggtaccaaattagatcttcgtgaagataagcattatttggctgatcatcctggactatcccctgtaactactgcacagggagaggagttgcgtaagctaattggtgcgacgtattacattgagtgtagttcaaaaactcaacagaatgtgaaagcagtttttgattctgcgataaaggaagtgatcaaacctctggttaaacaaaaggagaagactaagaagaagaagaagcaaaagtcgaatcacggctgtttatcaaatgttctgtgtgggaggatagtgactcggcattgatgacgatgacccaactcagtctgatgattttaaactccacttttgagattgtgtgataaacgagagactttatattatatagattgaatcatgtaagagattattagcctctaatcaatcaatagttaccttgaagagagaaagagggggaggtagagagcttattattaattcaattgtgtttatttgtttcaaacctgttattgcaatatattagccattttgatacaaaaaaaaaa

SEQ ID NO: 8132 - protein, 215 aa, Arabidopsis thaliana
MASSASKFIKCVTVGDGAVGKTCMLICYTSNKFPTDYIPTVFDNFSANVVVEGTTVNLGLWDTAGQEDYNRLRPLSYRGADVFVLSFSLVSRVSYENVFKKWIPELQHFAPGVPLVLVGTKLDLREDKHYLADHPGLSPVTTAQGEELRKLIGATYYIECSSKTQQNVKAVFDSAIKEVIKPLVKQKEKTKKKKKQKSNHGCLSNVLCGRIVTRH

SEQ ID NO: 8133 - DNA, 594 bp, Medicago sativa
  CDS (1)..(594)
atgagtggttccaggttcatcaagtgtgtcactgttggtgatggtgccgttggaaagacttgtttgcttatctcttacaccagcaacactttccctacggactatgtgccgactgtctttgacaatttcagtgcaaatgtagttgtggatgggagcactataaatctcgggttgtgggatactgctggccaagaagattacaatagattaagacccttaagctatcgtggagcagatgtttttctgcttgctttttctctcataagcaaggccagctatgaaaatattgccaaaaaatggattcctgagttgaggcattatgctcctggtgttccaattattctcgttggaacaaaacttgatcttcgggatgatagccagttctttcaagaccatcctggtgcagcaccaataaccacagcacagggtgaggaactgagaaaacttatcggtgctccagtttacattgaatgtagttccaaaacacaaaagaatgtgaaggcagttttcgattcggccatcaaagtagttctacaaccgccaaagcaaaagaaaacaaagagaaaggggcaaaaagcatgttccattatgtga

SEQ ID NO: 8134 - protein, 197 aa, Medicago sativa
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELRKLIGAPVYIECSSKTQKNVKAVFDSAIKVVLQPPKQKKTKRKGQKACSIM

SEQ ID NO: 8135 - DNA, 657 bp, Hordeum vulgare var
  CDS (1)..(657)
atgagcggcggagcgggggcggcgacggcggtgagcaggttcatcaagtgcgtggccgtgggcgacggcgccgtgggcaagacctgcatgctcatctgctacacctgcaacaagttccccaccgactacatccccaccgtgttcgacaacttcagcgccaatgtctccgtggacgggagcatcgtcaacctcggcctctgggacaccgcaggtcaggaggattacagcaggctgaggcctctgagctacaggggagccgatgtcttcatcctctccttctccctcaccagcagagcaagctatgagaatgtgcacaagaagtggatgccggagcttcgccggtacgcccccggcattcctgtactgcttgttggaaccaagttggatctccgggaggatagagcttatcttgctgatcatgcagctgattccatcataacaactgagcagggtgaggatcttaggagacaaataggtgctgtggcatacatagaatgcagctccaagacacaaaggaacattaaggctgttttcgacaccgcaatcaaggcggttcttcaacctcaaaggcacaaggaggtagccagaaaggaaactcggacacgctctagtcggtcagtaaggcagtacttctgtgggagttcttgtttcgcgtag

SEQ ID NO: 8136 - protein, 218 aa, Hordeum vulgare var
MSGGAGAATAVSRFIKCVAVGDGAVGKTCMLICYTCNKFPTDYIPTVFDNFSANVSVDGSIVNLGLWDTAGQEDYSRLRPLSYRGADVFILSFSLTSRASYENVHKKWMPELRRYAPGIPVLLVGTKLDLREDRAYLADHAADSIITTEQGEDLRRQIGAVAYIECSSKTQRNIKAVFDTAIKAVLQPQRHKEVARKETRTRSSRSVRQYFCGSSCFA

SEQ ID NO: 8137 - DNA, 642 bp, Hordeum vulgare var
  CDS (1)..(642)
atggcgtccagcgcctcccggttcatcaagtgcgtcacggtgggcgacggcgccgtcggcaagacctgcatgctcatctgctacaccagcaacaagttccccaccgactacatacccacggtgttcgacaatttcagcgcgaacgtggtggcggacggcaccacggtgaatttgggcctttgggacaccgccgggcaggaggattacaaccggctgaggcctctaagctaccgcggcgccgacgttttcgtgcttgccttctcccttgtgagccgagctagctatgagaatatcatgaagaagtggataccggagcttcagcattacgcgcccggcgtacctgttgtgctggtaggcacaaaactggatcttcgtgaagataagcactatttgctggaccaccctgggatgatacccgttaccacagcacagggggaggaacttcgtaagcaagttggtgctttatattacatagagtgcagctcaaagacacaacagaatgtcaaagctgtgtttgatgctgctatcaaggtagtaatccagcccccaactaaacaaagagaaaagaagaaaaagaaacagcgtcggggatgttctatgatgaacttcagcggaaggaaaatgctatgcttcaaatcctga

SEQ ID NO: 8138 - protein, 213 aa, Hordeum vulgare var
MASSASRFIKCVTVGDGAVGKTCMLICYTSNKFPTDYIPTVFDNFSANVVADGTTVNLGLWDTAGQEDYNRLRPLSYRGADVFVLAFSLVSRASYENIMKKWIPELQHYAPGVPVVLVGTKLDLREDKHYLLDHPGMIPVTTAQGEELRKQVGALYYIECSSKTQQNVKAVFDAAIKVVIQPPTKQREKKKKKQRRGCSMMNFSGRKMLCFKS

SEQ ID NO: 8139 - DNA, 677 bp, Hordeum vulgare
  CDS (27)..(668)
ggatccttctcgtccatttagccggcatggcgtccagcgcctcccggttcatcaagtgcgtcaccgtcggggacggcgccgtcggcaagacctgcatgctcatctgctacaccagcaacaagttccccaccgactacgtgcccaccgtgttcgacaatttcagcgcgaacgtggtggtggacggcaccaccgtgaacctgggcctctgggacactgcagggcaggaggactacaacagattgagaccgctgagctaccggggagccgacgtcttcgtgctctccttctcgctcgtcagccgagccagctacgagaatgtcatgaagaagtggctaccggagcttcagcaccatgcacccggcgtgccaacagtgctggttggtacaaagctagatctacgtgaagacaagcaatacttacttgaccaccccggcgtggtgcctgttactacagctcagggggaggaactccgcaagcacatcggtgcaacttgttatgtcgaatgcagctcaaagacacagcagaatgtcaaagctgtgtttgatgctgccatcaaggtagtgatcaaacctccaacaaagcagagggaaaggaggaagaagaaagcacggcaaggatgtgcatcattgggtaccctgtcaagaaggaagctggcatgcttcaagtgatcagtcgac

SEQ ID NO: 8140 - protein, 213 aa, Hordeum vulgare
MASSASRFIKCVTVGDGAVGKTCMLICYTSNKFPTDYVPTVFDNFSANVVVDGTTVNLGLWDTAGQEDYNRLRPLSYRGADVFVLSFSLVSRASYENVMKKWLPELQHHAPGVPTVLVGTKLDLREDKQYLLDHPGVVPVTTAQGEELRKHIGATCYVECSSKTQQNVKAVFDAAIKVVIKPPTKQRERRKKKARQGCASLGTLSRRKLACFK

SEQ ID NO: 8141 - DNA, 699 bp, Hordeum vulgare
  CDS (67)..(660)
  misc_feature (55)..(55): n is a, g, c or t
ggatcccgattccatcaggaaagcatatagactagcccagtaaatagaaataagnaaagatcggcgatgagcgcatctcggttcatcaagtgcgtgacggtgggggacggcgccgtgggaaagacatgcctcctcatctcatacacatccaacaccttccccacagactatgtcccaacagttttcgacaacttcagcgctaacgtcgtggttgacggcagcaccgtcaacctcggattatgggatactgcaggacaagaagactataatcgactacgcccactaagctaccgtggtgccgatgtcttcctgctcgccttttctctcatcagcaaagcaagctacgagaatgtcactaagaagtggattccagagttacggcactatgctcctggcgtgcccataattcttgttggaacaaagcttgatctgcgggatgacaagcagttttttgtggatcaccctggggcggttcctatttccactgctcagggtgaagagctgaagaaggtgattggcgcgactgcctacatcgagtgcagctcaaaaacacagcagaacatcaaggcggtgtttgatgcggcgatcaaggtggtcctccagcctccgaagcagaagcggaagaagaggaagtcacagaaaggatgcagcatcttgtaaagctaaaatcccttttgttttgcagtgtctcgcgtcgac

SEQ ID NO: 8142 - protein, 197 aa, Hordeum vulgare
MSASRFIKCVTVGDGAVGKTCLLISYTSNTFPTDYVPTVFDNFSANVVVDGSTVNLGLWDTAGQEDYNRLRPLSYRGADVFLLAFSLISKASYENVTKKWIPELRHYAPGVPIILVGTKLDLRDDKQFFVDHPGAVPISTAQGEELKKVIGATAYIECSSKTQQNIKAVFDAAIKVVLQPPKQKRKKRKSQKGCSIL

SEQ ID NO: 8143 - DNA, 721 bp, Hordeum vulgare
  CDS (38)..(676)
gtggaggcgcggcgagagcggcggaggcggaggagagatgagcgtgaccaagttcatcaagtgcgtcacggtgggggacggcgccgtcggcaagacctgcatgctcatctgctacaccagcaacaggttccccagtgattacatccccacggtgttcgacaacttcagcgccaacgtctccgtcgacggcaacatcgtcaacctcggcctatgggacaccgccgggcaagaagactacagccggctgaggccgctgagctacagaggcgccgacgtgttcgtgctcgccttctccctcatcagcagcgccagctacgagaatgttcttaagaagtggatgccagagctccgccggttcgcgccgaatgtccccattgttcttgttgggaccaagctagatctgcgtgaccacagagcctacctcgccgaccaccccggtgcttcagcaatcacaactgcacagggtgaagaacttaggaagcagatcggcgccgcggcttacatcgagtgcagctccaagacacagcagaacgtcaaggctgtgtttgacaccgccataaaggtggtcctccagccgccgaggagaagggaggtgatgtccgccaggaagaaaaccaggcgaagctctggatgctccatcaagcacttgatctgcgggagtacgtgcgctgcttgaattagcaccatggaggcctggactgactatggagatgaagcatgg

SEQ ID NO: 8144 - protein, 212 aa, Hordeum vulgare
MSVTKFIKCVTVGDGAVGKTCMLICYTSNRFPSDYIPTVFDNFSANVSVDGNIVNLGLWDTAGQEDYSRLRPLSYRGADVFVLAFSLISSASYENVLKKWMPELRRFAPNVPIVLVGTKLDLRDHRAYLADHPGASAITTAQGEELRKQIGAAAYIECSSKTQQNVKAVFDTAIKVVLQPPRRREVMSARKKTRRSSGCSIKHLICGSTCAA

SEQ ID NO: 8145 - DNA, 789 bp, Brassica napus
  CDS (193)..(786)
gagtacgcggggtctacgagtcgggttgttcgggaatgcagccccaatcgggcggtaaattccgtccaaggctaaatatgggcgagagaccgatagcgaacaagtaccgcgaggtaaagatgaaaaggactttgaaaagagagtcaaagagtgcttgaaattgtcgggagggaagcggatgggggggggacaatgagcgcatcgagattcgcaaagtgtgtgacggttggtgatggagctgtcggaaaaacatgtttgttgatttcttacacaagcaacactttccctacggattatgtgccaactgttttcgataatttcagtgcaaatgttgtggttaatggagccaccgttaatcttggattgtgggatactgcagggcaagaggattacaacagattaagaccactaagctaccgtggagctgatgttttcatattggccttctctcttatcagtaaagccagttatgaaaacgtctccaaaaagtggatcccggagttgaagcattacgcgcctggtgtccccatcatccttgttggatcaaagcttgatcttcgagatgataagcaattcttcgtcgaccatcctggcgctgtcccgattacaactgctcagggagaggagctgaggaagctaatagatgcacctacttacatcgaatgcagttccaaatctcaagagaatgtgaaagctgtctttgacgcagccatacgagtggtgttgcaaccgcctaagcagaagaagaaaaagagcaaaacgcagaaggcatgctccatccaatgattt

SEQ ID NO: 8146 - protein, 197 aa, Brassica napus
MSASRFAKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVPITTAQGEELRKLIDAPTYIECSSKSQENVKAVFDAAIRVVLQPPKQKKKKSKTQKACSIQ

SEQ ID NO: 8147 - DNA, 757 bp, Brassica napus
  CDS (164)..(757)
cgatacaccgattcatttcattcttcattgatcgcttcctctcacatacccgatttcgtttagggttaacattttctagggttttagagataggcgaaactgaaattgagaagaagacgggtgttgtttcctcatagatctgaggggttgaatttttcgatttatgagcgcatctcggttcataaagtgcgtgacggttggggacggagcagtgggcaaaacatgtctcctcatctcttacaccagcaacactttccctacggattatgttccaactgttttcgataacttcagcgctaatgttgttgttaacggagccactgtcaacttaggactctgggataccgcagggcaggaggattataacagattgagacccttgagttaccgcggtgctgacgttttcatcttggccttctctctcatcagtaaggctagttatgagaatgtctccaagaagtggatccctgagctgacccactatgcccctggtgtccctatcgttcttgttggtaccaaactagatcttagggatgacaaacagttcttcgttgaccaccctggtgctgtacctattaccacttctcagggagaggaactaatgaagctaattggagctccttcgtacatcgagtgcagttcaaaatctcaagagaacgtgaaaggggtgtttgatgcagcgatcagagtggtacttcaacctccaaagcagaagaaaaagaagagcaaggcacaaaaggcctgctccattttgtaa

SEQ ID NO: 8148 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELTHYAPGVPIVLVGTKLDLRDDKQFFVDHPGAVPITTSQGEELMKLIGAPSYIECSSKSQENVKGVFDAAIRVVLQPPKQKKKKSKAQKACSIL

SEQ ID NO: 8149 - DNA, 865 bp, Brassica napus
  CDS (270)..(863)
ggagtaatgattaacagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtttttgggttccgggggggggacaatgagcgcatcgagattcgtaaagtgtgtgacggttggtgatggagctgtcggaaaaacatgtttgctgatttcttacacaagcaacactttccctacggattatgtgccaaccgttttcgataatttcagtgcaaatgttgtggttaatggagccaccgttaatcttggattgtgggatactgcagggcaagaggattacaacagattaagaccactaagctaccgtggagcagatgttttcatattggccttctctcttattagtaaagccagttatgaaaacgtctccaaaaagtggatcccggagttgaaacattacgcgcctggtgtcccaatcattcttgttggatcaaagcttgatcttcgagatgataagcaattcttcgtcgaccatcctggcgctgtcgcgattacaactgctcagggagaggagctgaggaagctaatagatgcacctacttacatcgaatgcagttccaaatctcaagagaatgtgaaagccgtctttgatgcagccatacgagtggtgttgcaaccgcctaagcagaagaagaaaaagagcaaagcgcaaaaggcatgctccatccaatgatt

SEQ ID NO: 8150 - protein, 197 aa, Brassica napus
MSASRFVKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVAITTAQGEELRKLIDAPTYIECSSKSQENVKAVFDAAIRVVLQPPKQKKKKSKAQKACSIQ

SEQ ID NO: 8151 - DNA, 834 bp, Brassica napus
  CDS (238)..(831)
tttctgtcaccttcctctctctctctctctctctttttgggctaacgggtttctcatttctgggacaaagtctgttcctttcgatccgcaatgtccagatggttgattgaatttgagcatcaagaagaagaacaaaactaacagagatagatagagagagagcaaaggatctgaagttcaacgcctgtttcaaagagatctgaaagctcaaatatcttcgagctttgagcggggacaatgagcggcttcagattcgtaaagtgtgtgacagttggtgatggagctgtcggaaaaacatgtttgttgatttcttacacaagcaacactttccctacggattatgtgccaactgttttcgataatttcagtgcaaatgttgtggttaatggagccaccgttaatcttggattgtgggatactgcagggcaagaggattacaacagattaagaccactaagctaccgtggagctgatgttttcatattggccttctctcttatcagtaaagccagttatgaaaacgtctccaaaaagtggatcccggagttgaagcattacgcgcctggtgtccccatcatccttgttggatcaaagcttgatcttcgagatgataagcaattcttcgtcgaccatcctggcgctgtcccgattacaactgctcagggagaggagctgaggaagctaatagatgcacctacttacatcgaatgcagttccaaatctcaagagaatgtgaaagctgtctttgacgcagccatacgagtggtgttgcaaccgcctaagcagaagaagaaaaagagcaaagcgcagaaggcatgctccatccagtgattt

SEQ ID NO: 8152 - protein, 197 aa, Brassica napus
MSGFRFVKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVPITTAQGEELRKLIDAPTYIECSSKSQENVKAVFDAAIRVVLQPPKQKKKKSKAQKACSIQ

SEQ ID NO: 8153 - DNA, 779 bp, Brassica napus
  CDS (183)..(776)
ggctcatagggtttctagttttcgggagaaagttctttcatttttcaagaatgcccagatgctcgattgaggttgagcatccagacaacgaagaagaaaattaacaaaatctttgagcttttctttttatttttggtttttcccccctgaaagtattaacaaataatcttcgagtagagaaaatgagcgcatctcggttcataaagtgtgtaacggttggtgatggagctgtcggaaaaacatgtttgttgatttcttacacaagcaacactttccctacggactatgtgcccaccgttttcgataatttcagtgctaatgtggtggttaacggagccaccgttaatcttggattgtgggatactgcagggcaagaggattacaacagattaagaccactaagctaccgtggagctgatgttttcatattggccttctctcttatcagtaaagccagttatgaaaacgtctccaaaaagtggatcccggagttgaagcattacgcgcctggtgtccccgtcatccttgttggatcaaagcttgatcttcgagatgataagcaattcttcgtcgaccatcctggcgctgtcccgattacaactgctcagggagaggagctgaggaagctaatagatgcacctacttacatcgaatgcagttccaaatctcaagagaatgtgaaagctgtctttgacgcagccatacgagtggtgttgcaaccgcctaagcagaagaagaaaaagagcaaagcgcagaaggcatgctccatccagtgatat

SEQ ID NO: 8154 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPVILVGSKLDLRDDKQFFVDHPGAVPITTAQGEELRKLIDAPTYIECSSKSQENVKAVFDAAIRVVLQPPKQKKKKSKAQKACSIQ

SEQ ID NO: 8155 - DNA, 1015 bp, Zinnia elegans
  CDS (170)..(763)
ggtttgttcttggggtttggctggaaaaagattcaatttttcggtgtgtttttgggaaaaagatttggtgaaatttgtgggtgttgaagaaagattgttggggattattgggtgtgagtgatttggtggtgatcaggtcttctgggtgtggaagaagatctgaagaaatatgagtgcatcaagatttataaagtgtgttactgttggtgatggggctgttggaaagacttgtttgttgatttcttacaccagtaataccttccctacggattacgtcccaacggtatttgataatttcagtgctaatgtagttgtcaatggaagcacagttaatctaggcttgtgggacactgctggacaggaggactataacagattaagaccgttgagttatcgtggagctgatgttttcattttggcgttctcactcattagcaaggctagctatgagaacgtttccaagaagtggattccagaattgaagcattatgctcctggtgttccaatcgttcttgttgggacgaaactagatctccgagatgataagcagttttttgtagatcaccctggtgcaactcctattaccactgcacagggagaggaattaaagaagacaatcggtgctcctgagtacattgaatgtagttcaaaaacacaattgaatgtgaagcaagttttcgatgctgccattaaagtcgttctggcgcctccaaaggcgaagaaaaagaagggaaaagctcaaaaggcatgctcaatattgtgatgaagaagatgaaaaccagttgttcaacgcttatctcgtcttgaattcaattccatatgttggttgatttgtattttgatctttgagtactcgaaaatcttggtgtactaattctgtatcttggtcaaaaatttgtatttccatgctcgttttctgtttgcgactgttttactactttgttcttctaagttgaaaaatcggtatctatcgttgaatcaatgaattccattctaatgaaaaaaaaaaaaaaaa

SEQ ID NO: 8156 - protein, 197 aa, Zinnia elegans
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFVDHPGATPITTAQGEELKKTIGAPEYIECSSKTQLNVKQVFDAAIKVVLAPPKAKKKKGKAQKACSIL

SEQ ID NO: 8157 - DNA, 600 bp, Penicillium marneffei
  CDS (1)..(600)
atggcgtctgggcctgcgactcaatcgttgaagtgtgtggtgaccggtgatggtgctgtcggcaagacatgtctcctgatatcatacaccaccaatgcctttcccggcgaatacattcccaccgtattcgacaactactccgctagtgtcatggtcgacggcaggcccatcagcctcggactctgggatacagctggtcaagaggattatgaccgtctccgccccttatcctaccctcaaaccgacgtcttcttgatctgcttctctatcgtctctccaccatcctttgacaacgtaaaagccaagtggtttcccgaaatcgagcaccatgcacccggcgtgcccatcattcttgtcggcacaaagcttgatttgagagaagatagagctaccgctgaggcgctgcgagccaaaaagatggagccggtgtcgtatgagcaggcgcttgcagttgcaaaggagattagggcgcataagtatctggagtgttcggccttgacccagaggaatttgaagagcgtgtttgatgaagctattcgggccgtcctcaatcctcgccctcaacccaagaacaaggcaaaacgatgcactattctgtaa

SEQ ID NO: 8158 - protein, 199 aa, Penicillium marneffei
MASGPATQSLKCVVTGDGAVGKTCLLISYTTNAFPGEYIPTVFDNYSASVMVDGRPISLGLWDTAGQEDYDRLRPLSYPQTDVFLICFSIVSPPSFDNVKAKWFPEIEHHAPGVPIILVGTKLDLREDRATAEALRAKKMEPVSYEQALAVAKEIRAHKYLECSALTQRNLKSVFDEAIRAVLNPRPQPKNKAKRCTIL

SEQ ID NO: 8159 - DNA, 594 bp, Hordeum vulgare
  CDS (1)..(594)
atgagcgcgtccaggttcataaagtgcgtcaccgtgggggacggcgccgtcggcaagacctgcatgctcatctcctacacctccaacaccttccccaccgactatgtgcccacggtgtttgacaacttcagtgctaatgttgtggttgatggcaacactgtcaaccttgggctatgggatactgcaggtcaggaagactacaacagactgagaccgctgagttatcgtggagctgatgtcttccttctggccttctcgcttatcagcaaggctagctatgagaatgtttcaaagaagtggatacctgaactgaagcattatgcaccaggtgtgcctattatcctcgtgggaacaaagcttgatcttcgagatgacaagcagttctttgtggaccatcctggtgctgttcctatcactactgctcagggggaggaactaaaaaagttaataggcgcaccctactacatcgaatgcagctcgaagacccaactaaatgtcaagggtgtatttgatgcggcaataaaggtggtactgcagccaccaaaggcaaagaagaagaaaaaggcgcagaggggggcttgctccatcttgtga

SEQ ID NO: 8160 - protein, 197 aa, Hordeum vulgare
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELKKLIGAPYYIECSSKTQLNVKGVFDAAIKVVLQPPKAKKKKKAQRGACSIL

SEQ ID NO: 8161 - DNA, 985 bp, Medicago truncatula
  CDS (143)..(736)
gttcaacgctaaaatcacactctcatcttccaaatagatgtgtgatagtaattgaaagagaagaagaagaagaaagtactggaggagggggactgtcctcaggtgaagatctgaggctattttgggtatttcatttttcaagatgagtgcttctaggtttattaaatgtgttactgttggtgatggagctgttggcaaaacttgtttgttgatttcttacaccagcaatactttccccacggattatgtgccgacagtttttgacaatttcagtgcgaatgtggttgttaatggaagtattgtgaatctgggtttgtgggatactgctggacaagaggattataacagattaagacctttgagttaccgtggtgccgatgttttcatattggctttctctctcataagcaaagccagttatgaaaatgtctccaaaaagtggattccagagttgaagcattatgcacctggtgtccccataattctggttggaacaaagcttgatcttcgggatgataagcagttctgcatagaccatcctggtgccgttcccattaccacagctcagggagaagagctgaggaagctgattaatgcaccagcttacattgaatgcagttcaaaatcacaggagaacgtgaaggcggtgtttgatgcagccataagagttgtccttcaaccaccaaagcagaagaaaaagaagaataaagcacaaaaggcctgttcaatattgtaattcactaggtgtaaacatttgattgtcctttgttctacctgtattcccctccccttcttttcatcattttctttgttattgaagaagttggagagtctttgtgggtgttctttcagacaaatactctagatctccttgaagcataaggtggcttaatgtttttgctttctatgaattattattgtcaactctaatagttaaatttgcatttcatgcttcccatctttttaaaaaaaaaaaaaaaaaaaa

SEQ ID NO: 8162 - protein, 197 aa, Medicago truncatula
MSASRFIKCVTVGDGAVGKTCLLISYTSNTFPTDYVPTVFDNFSANVVVNGSIVNLGLWDTAGQEDYNRLRPLSYRGADVFILAFSLISKASYENVSKKWIPELKHYAPGVPIILVGTKLDLRDDKQFCIDHPGAVPITTAQGEELRKLINAPAYIECSSKSQENVKAVFDAAIRVVLQPPKQKKKKNKAQKACSIL

SEQ ID NO: 8163 - DNA, 579 bp, Saccharomyces cerevisiae
  CDS (1)..(579)
atgtctgaaaaggccgttagaaggaaacttgttattattggtgatggtgcttgtggcaagacctctttactatatgtatttacattaggaaaattccctgaacaatatcatccgacagtgttcgagaattatgtcactgattgcagagttgacggaataaaagtgtccttaacgctctgggatacagcgggacaagaggaatatgaacgtttacgtccattctcatattcaaaagcagatataatattaattgggtttgctgtagacaattgtgaatcactaattaacgcaaggacgaaatgggcggatgaagcattacgatattgtcctgacgcaccaatcgttcttgtaggcttgaaaaaagatttgaggcaagaagcccattttaaagagaatgctaccgatgaaatggttcccattgaagatgcgaaacaagttgcaagggccattggggccaagaaatacatggaatgtagtgcactgactggtgagggtgtggatgatgtctttgaagtagctacaagaaccagtttgcttatgaagaaggaaccaggggctaactgttgcataattttataa

SEQ ID NO: 8164 - protein, 192 aa, Saccharomyces cerevisiae
MSEKAVRRKLVIIGDGACGKTSLLYVFTLGKFPEQYHPTVFENYVTDCRVDGIKVSLTLWDTAGQEEYERLRPFSYSKADIILIGFAVDNCESLINARTKWADEALRYCPDAPIVLVGLKKDLRQEAHFKENATDEMVPIEDAKQVARAIGAKKYMECSALTGEGVDDVFEVATRTSLLMKKEPGANCCIIL

SEQ ID NO: 8165 - DNA, 588 bp, Mucor rouxii
  CDS (1)..(588)
atggctgaaatcagacgaaaacttgtgattgttggagatggtgcttgtggtaaaacctgtttgttgattgtcttttcaaagggtacttttcctgagttctatgttcccaccgtttttgaaaattacgtagctgatgtcgaagtcgatggaaaacacgtggaattagctttatgggatacagcaggccaagaagattatgatcgtctccgtcccttgtcttaccctgattctcatgttatcttgatttgttttgctgttgattcacccgattcattggaaaacgttcaagagaagtggatctctgaagtactccacttctgtcaaggtttacctattgttttagttggttgtaagaaagatttaagaaatgatcctggaacaattgaagaacttagaagaaactctcaaaaacctgtcagttcagaagagggtgcttctattgctcaaagaattagtgcttacaagtaccttgaatgttctgccaagactggtgaaggtgtacgtgaagtatttgaacacgcaacaagagctgcattaatggtttctaagaagaaaaagtcaaagagtggtgtctgcaaccttttgtaa

SEQ ID NO: 8166 - protein, 195 aa, Mucor rouxii
MAEIRRKLVIVGDGACGKTCLLIVFSKGTFPEFYVPTVFENYVADVEVDGKHVELALWDTAGQEDYDRLRPLSYPDSHVILICFAVDSPDSLENVQEKWISEVLHFCQGLPIVLVGCKKDLRNDPGTIEELRRNSQKPVSSEEGASIAQRISAYKYLECSAKTGEGVREVFEHATRAALMVSKKKKSKSGVCNLL

SEQ ID NO: 8167 - DNA, 1014 bp, Neurospora crassa
  CDS (259)..(1014)
atgtcgtcgtcaagcaagttccgcagctcacaccactatcattcgcagtcggtgtcgtcaatcctaggcaggcacgatagcaccagccccggcgcagaactccaacgacgaccgaccaccacctcgtcctacacatcctctggtagcgccagccgacgagtaccacgcgacaacgggacgagatcgagcgatgggacagtgagtaccatgatgagcaccacatcgtcgaccggaagagaatcagcagcaactacggccatgaccgagggcccggcctactccaagaaggtggtggtcgtgggcgatggcggttgcggaaagacatgtctcctgatcagttatagtcagggatacttcccagagaaatatgtcccaaccgtctttgagaactacatcacctacccaacgcatccaccgaccggtaagaccgtcgagctcgccctgtgggataccgccggccaagaggaatacgaccgcttgcgaccgctttcatacccagaaaccgaccttatttttgtctgcttcgccattgactgccccaactccctcgagaatgtcatggacaagtggtaccccgaagtcctccacttctgtccgtatacaccccttatcctcgtcggcctcaagtccgacctccgcaataagaagacgtgcatcgacatgctcaagacacaaggtctcacccccgtcaccaccgaacaaggactcgccgtcgctaagaagatgggcgctcagtacatggagtgctcatcaaaggagatgaagggtgtagaggagatttttgagcaggccatcctcacagtagtcgccaacgacaggaaaacactggaacaggaagccgcgaacggcatgctgggtgttggcgcgggctcgggaagcggaaagggcagcggaatctcgttcagcagtggtgacaaggccggttccgggatagggcccgtcaaggcggccggtgtgggtggcacgattgtcccgaaaacgaggaagaagaagagaaagtgtggtatgatgtga

SEQ ID NO: 8168 - protein, 251 aa, Neurospora crassa
MTEGPAYSKKVVVVGDGGCGKTCLLISYSQGYFPEKYVPTVFENYITYPTHPPTGKTVELALWDTAGQEEYDRLRPLSYPETDLIFVCFAIDCPNSLENVMDKWYPEVLHFCPYTPLILVGLKSDLRNKKTCIDMLKTQGLTPVTTEQGLAVAKKMGAQYMECSSKEMKGVEEIFEQAILTVVANDRKTLEQEAANGMLGVGAGSGSGKGSGISFSSGDKAGSGIGPVKAAGVGGTIVPKTRKKKRKCGMM

SEQ ID NO: 8169 - DNA, 1025 bp, Nicotiana tabacum
  CDS (103)..(696)
ttcttgtatccgcccagctcccccatacccatttcaatctttttttttgtttataatttttttctgggaatcaggtcttctcaagaagatctgagaagaaaaatgagtgcttcgaggtttataaaatgtgtgacggtgggtgatggtgccgttggaaaaacgtgtctcttgatttcttacaccagcaacacctttcctacggattatgtgcctactgtgttcgataatttcagtgcaaatgtggtcgtcaatgggagtactgtcaacctagggttgtgggatacagctggacaggaggattacaataggttaagacctctgagttaccgtggagctgatgttttcatcttggcattctctctcattagtaaagccagctatgaaaatgtttccaagaagtggattcctgagttgaagcattatgctcccggtgttccaatagtgcttgttggaacaaaacttgatcttcgggatgataagcagttcttcatagaccatcctggtgctgtgccaattactactgctcagggcgaggagctgaggaaaacgattggggcccctgcttacattgaatgtagttcaaaaacacaacagaatgtgaaagcagtctttgatgctgctattaaggtcgtgctccagccacccaagcagaaaaaaaagaaggggaaggcccaaaaggcatgttcgattttgtgatcaacagtaggtccaacaatattactggtcacagttctccttgtaatctctccctcatattcctttgtttttcctttgtctcggagaaagtaggaggtccatgtatgtctctttaaaattacttgtgatctcttgaattgcaggtggctcggtttttatactgctgtcatctctagttgttgagtcacagcaccttgttgtaggccactgattgggccctctctggtttcatttgctttatgattaatgactgaaagatccagttggaaaaaaaaaaaaaaaaaaaaaaaaaactcggggggggccgggcccaatcccctataggggtg

SEQ ID NO: 8170 - protein, 197 aa, Nicotiana tabacum
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFIDHPGAVPITTAQGEELRKTIGAPAYIECSSKTQQNVKAVFDAAIKVVLQPPKQKKKKGKAQKACSIL

SEQ ID NO: 8171 - DNA, 579 bp, Penicillium marneffei
  CDS (1)..(579)
atggttgtggctacaattaaatgtgtcgtcgttggtgacggtgcggtcggaaagacttgcttattgatttcgtatacgacaaataaatttccatcggaatatgttcctactgttttcgataattatgccgtgactgtcatgatcggcgatgagccttataccctcggcctcttcgataccgccggacaagaagattacgaccgcctgcgccctctctcctaccctcaaaccgatgtcttccttgtctgcttctccgtcacttccccagcctcatttgagaacgtgcgagagaaatggtttccagaagtccatcatcactgtcccggtgttccctgcctgattgtcggcacccagaccgatttgcgagatgatcctgcggtgcgcgagaagctggcgaaacagaagatgcagcccgtgcgtaaggaggatggtgatcggatggcaaaggagttgggtgccgtcaagtacgtggaatgttcagctttgacgcagtataagctgaaggatgtttttgatgaggctatcgttgctgctctcgaacccgccccaaagaagagacccaagtgcgttgttctataa

SEQ ID NO: 8172 - protein, 192 aa, Penicillium marneffei
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDPAVREKLAKQKMQPVRKEDGDRMAKELGAVKYVECSALTQYKLKDVFDEAIVAALEPAPKKRPKCVVL

SEQ ID NO: 8173 - DNA, 624 bp, Trichoderma reesei
  CDS (1)..(624)
atgcctctctgcggcggctccaagacggtgcagcgcaagctggttcttctgggcgatggtgccagcggaaagacgtcgctgctcaacgtcttcacaagaggttactttcccaccgtctacgaacctaccgtctttgaaaattacgtccacgacatctttgtcgacaacgtccacatcgagctctccctctgggatacggcgggacaggaggaattcgatcggctgcgatcgctctcctacgatgacaccgatttgatcgtgctctgttactcggtcgatagcaaagactcgctagaaaacgtcgaatccaaatgggtcggagagattgccgacaactgccccggcgtcaagctggtcctcgtcgccctcaagtgcgacctgcgccagcaagaggacgacgagcccgaggaccaggcagcggccgacggcaacgcacagcgcgagaaaccgcccacgatttcctacgacgagggccttgaggtcgccaagcggataggcgcctcgcgctacctggagtgctcggcgatgaagaaccgcggcgtcaacgaggcctttaccgaggcggcccgcgtagcgctaagcgtcaagaaggagagggaagacaacaagtgcacaatcatgtaa

SEQ ID NO: 8174 - protein, 207 aa, Trichoderma reesei
MPLCGGSKTVQRKLVLLGDGASGKTSLLNVFTRGYFPTVYEPTVFENYVHDIFVDNVHIELSLWDTAGQEEFDRLRSLSYDDTDLIVLCYSVDSKDSLENVESKWVGEIADNCPGVKLVLVALKCDLRQQEDDEPEDQAAADGNAQREKPPTISYDEGLEVAKRIGASRYLECSAMKNRGVNEAFTEAARVALSVKKEREDNKCTIM

SEQ ID NO: 8175 - DNA, 615 bp, Yarrowia lipolytica
  CDS (1)..(615)
atgccccaaccaacggatctgcgaagaaaactcgtcattgtcggcgacggagcctgcggcaagacctgtctgctgattgtcttcgcgaagggcaccttcccggaggtgtacgtgcccaccgtgtttgagaactacgtggccgacgtggagattgacggccgacgagtggagctggccctgtgggataccgccggccaggaggattacgaccgactgcgacccctgtcctaccccgacgccaacgtcatcatcatctgcttcgccatcgacagccccgactcgctcgacaacgtgcaggagaagtggatctccgaggtgctgcacttttgccagggcgtgcctattctgctggtcggttgcaaggtcgacctgcgaaacgaccccaagaccatcgaggagctgagaagaacgtcccagcgacccgtcacgaccgaggagggaaatgccgtggcccagaagattggcgccggcaagtacctggagtgctctgcccgaacccacgacggagtgagagaggtcttcgagcatgccacccgagctgccctgactgcccacggccagaagggctccaagagctccagcagagagggcaagaaaaagtgtttgattttgtaa

SEQ ID NO: 8176 - protein, 204 aa, Yarrowia lipolytica
MPQPTDLRRKLVIVGDGACGKTCLLIVFAKGTFPEVYVPTVFENYVADVEIDGRRVELALWDTAGQEDYDRLRPLSYPDANVIIICFAIDSPDSLDNVQEKWISEVLHFCQGVPILLVGCKVDLRNDPKTIEELRRTSQRPVTTEEGNAVAQKIGAGKYLECSARTHDGVREVFEHATRAALTAHGQKGSKSSSREGKKKCLIL

SEQ ID NO: 8177 - DNA, 834 bp, Zea mays
  CDS (187)..(834)
atgacgaggcgaccccagcagacaagagacagacgagagagagcgagcaagccgagcatcgtgacctctctctgtttctctctctcttcccttctcgtcttctgcaagaagccagtgaccgtctctgtttctctcattccctttcatcactctgctggtctccctcttccacctctggtcttggccatggcctccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtagtcgacggtaccacggtgaatttgggcctttgggatactgcagggcaggaagattacaacagactgaggccactgagctaccgcggagcagatgtgttcgtgctcgccttctcgcttgtcagccgagctagctacgagaatgttatgaagaagtggctaccggagcttcagcattatgcaccgggtgtccccatagtgttggccggaactaaattggatcttcgtgaagacaggcactacttagttgaccatcctggtgcggtacctgttactacagcacagggggaggaactgcgcaagcacattggcgcaacttgctacatcgaatgcagctcaaaaactcagcagaatgtgaaagctgtgtttgatgctgccatcaaggtagtaatcaggcctccgacgaagcagcgagaaaggaagaaaaagaaagaacggcgaggatgctcaatattctgcagccgtatcatgcacgcaagaagactaggatgcttcaagtga

SEQ ID NO: 8178 - protein, 215 aa, Zea mays
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENVMKKWLPELQHYAPGVPIVLAGTKLDLREDRHYLVDHPGAVPVTTAQGEELRKHIGATCYIECSSKTQQNVKAVFDAAIKVVIRPPTKQRERKKKKERRGCSIFCSRIMHARRLGCFK

SEQ ID NO: 8179 - DNA, 639 bp, Zea mays
  CDS (1)..(639)
atgagcgtgaccaagttcatcaagtgcgtcacggtgggcgacggcgcggtgggcaagacctgcatgctcatctgctacaccagcaacaagttccccacggactacatccccacggtgttcgacaacttcagcgccaacgtctccgtggacggcagcatcgtcaacctgggcctctgggacaccgcggggcaagaggactacagcaggctgcggccgctgagctacaggggcgcggacgtgttcgtgctggccttctccctgatcagcagggcgagctacgagaacgttcttaagaagtgggtgccagagcttcgcagattcgcgcccaacgtcccggtcgttcttgttgggaccaagttagatctccgcgaccacagagcctacctcgccgaccatcctggagcttcagcagtcaccacggcgcagggtgaggaactgaggaagcagatcggcgctgcggcctacatcgagtgcagttccaaaacccagcagaacgtcaagtctgtcttcgatacggccatcaaagtggtccttcagcccccacggaggagggaggcagtgcctgccaggaagaagaacaggcgtggctccggatgctctataatgaaccttgtgtgtggcagcacatgtgctgcttga

SEQ ID NO: 8180 - protein, 212 aa, Zea mays
MSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPNVPVVLVGTKLDLRDHRAYLADHPGASAVTTAQGEELRKQIGAAAYIECSSKTQQNVKSVFDTAIKVVLQPPRRREAVPARKKNRRGSGCSIMNLVCGSTCAA

SEQ ID NO: 8181 - DNA, 789 bp, Zea mays
  CDS (151)..(789)
atggaagataagcaaagcaaggcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacaagttccccacggattacatccccacggtgttcgacaacttcagcgccaacgtctccgtggacggcagcatcgtcaacctgggcctctgggacactgcaggacaagaggactacagcagattgcggccactgagctacaggggcgcggacgtgttcgtgctggccttctccttgatcagcagggcgagctatgagaacgtccttaagaagtgggtgccagagcttcgcagattcgcgcccgacgtcccggtcgttcttgtcgggaccaagttagatctccgtgaccacagggcctaccttgctgaccatcctggagcgtcgacgatcacgacggcacagggcgaagaactgaggaggcagatcggcgctgcggcttacatcgagtgcagttccaaaacgcagcagaatgtcaagtcggtcttcgacacagccatcaaagtggtccttcagcccccgcggaggagggaggcgacgcctgccaggaggaagaacaggcgtggctccgggtgctctatcatgaacctcatgtgtggcagcacgtgcgctgcttga

SEQ ID NO: 8182 - protein, 212 aa, Zea mays
MSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPDVPVVLVGTKLDLRDHRAYLADHPGASTITTAQGEELRRQIGAAAYIECSSKTQQNVKSVFDTAIKVVLQPPRRREATPARRKNRRGSGCSIMNLMCGSTCAA

SEQ ID NO: 8183 - DNA, 576 bp, Yarrowia lipolytica
  CDS (1)..(576)
atgcagaccataaaatgtgttgttgtcggcgatggtgccgtcggaaagacttgtctcctcatctcatacacaacaaacaagttcccctctgaatacgttcccaccgtttttgacaactatgccgtgactgtcatgattggagacgagccctacacactcggactgttcgacaccgccggtcaggaggattacgaccgactgcgacctctttgttaccctcagaccgatgttttcctcgtctgcttttccgtcacctctcccgcctcctttgagaacgtcaaggagaagtggttccctgaggtccaccaccactgccccggcgtgccttgcctcattgttggtacccaggttgatccgcgaagtgacaggatgattcttgacaagctttcccgacacaagctgcgacccatgaccactgagcaaggctaccagctcgcccgagaactcggtgccgtcaagtacgtcgagtgttctgcccttactcagaagggtctcaaggacgttttcgacgaggccatcgtggcagctcttgagcctccagtggtcaagaagaacaaaaagtgcattgtgctctag

SEQ ID NO: 8184 - protein, 191 aa, Yarrowia lipolytica
MQTIKCVVVGDGAVGKTCLLISYTTNKFPSEYVPTVFDNYAVTVMIGDEPYTLGLFDTAGQEDYDRLRPLCYPQTDVFLVCFSVTSPASFENVKEKWFPEVHHHCPGVPCLIVGTQVDPRSDRMILDKLSRHKLRPMTTEQGYQLARELGAVKYVECSALTQKGLKDVFDEAIVAALEPPVVKKNKKCIVL

SEQ ID NO: 8185 - DNA, 803 bp, Nicotiana tabacum
  CDS (49)..(642)
aaaaaaaaaaaaaaaaaaaaaaaaaaaaaaaaaagaaaaaagaaaaaaatgagtgcttcaaggtttatcaagtgtgttacggttggtgatggtgctgttgggaaaacttgtcttttgatttcatacaccagcaatactttccctacggattatgtgcccactgtgtttgacaatttcagtgcaaatgttgttgtcaatgggagcactgtcaacctagggttgtgggatactgctggacaggaggattacaataggttaagacctctgagttaccgtggagccgatgttttcattttggcattctctctcattagtaaagccagctatgagaatgtttccaagaagtggattcctgagttgaagcactatgctcctggtgtcccaatagttcttgttggaacaaagcttgatcttcgggatgataagcaattcttcatagaccatcccggtgctgtgccaattactactgctcagggcgaggagctaaggaaaactattggtgcacctgcttacattgaatgtagttcaaaaacacaacagaatgtgaaagcagtctttgatgctgccattaaggtcgtcctccagccgcctaagacgaagaaaaagaaggggaaatctcaaaaatcctgctcgatattgtgatcaaactgtaggtccaacgatagtgctggtcacaattctcgttgtaatccctcactcactcgtatccctttatcttccttcgtctcagaggaagtacgaggtcatcgtttgtcttatatttgaaactactaaccatctcttggaaatatcaggtggcttgg

SEQ ID NO: 8186 - protein, 197 aa, Nicotiana tabacum
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFIDHPGAVPITTAQGEELRKTIGAPAYIECSSKTQQNVKAVFDAAIKVVLQPPKTKKKKGKSQKSCSIL

SEQ ID NO: 8187 - DNA, 917 bp, Medicago sativa
  CDS (30)..(623)
  misc_feature (261)..(261): k is g or t
  misc_feature (357)..(357): n is a, g, c or t
gaggctattttgggtatttcattttcaagatgagtgcttctaggtttattaaatgtgttactgttggtgatggagctgttggaaaaacttgtttgttgatttcttacaccagcaatactttccccacggattatgtgccgacagtttttgacaatttcagtgcgaatgtggttgttaatggaagtattgtgaatctgggtttgtgggatactgctgggcaagaggattataacagattaagacctttgagttaccgtggtkccgatgttttcatattggctttctctctcataagcaaagccagttatgaaaatgtctccaaaaagtggattccagagttgaagcattatgcacctngtgtccccataattctggttggaacaaagcttgaccttcgggatgataagcagttctgcatagaccatcctggtgccgttcccattaccacagctcagggagaagagctgaggaagctgattaatgcaccagcttacattgaatgcagttcaaaatcacaggagaacgtgaaggcggtgtttgacgcagccataagagttgtccttcaaccaccaaagcagaagaaaaagaagaataaagcacaaaaggcctgttcaatattgtaattcactaggtgtaaacatttgattgtcctttgttctacctgtattcccctccccttcttttcatcattttctttgttattgaagaagttggagagtctgtgtgggtgttctttcagacaaatactctagatctccttgaagcataaggtggcttaatgttttgctttctatgaattattattgtcaactctaatagttaaatttgcatttcatgcttcccatatttttttaagttttttattgatgtactattaaattgaaatatactagttagtacaaacaacatttcttgtc

SEQ ID NO: 8188 - protein, 197 aa, Medicago sativa
  misc_feature (78)..(78): The Xaa at location 78 stands for Ala, or Ser.
  misc_feature (110)..(110): The Xaa at location 110 stands for Arg, Cys, Gly, or Ser.
MSASRFIKCVTVGDGAVGKTCLLISYTSNTFPTDYVPTVFDNFSANVVVNGSIVNLGLWDTAGQEDYNRLRPLSYRGXDVFILAFSLISKASYENVSKKWIPELKHYAPXVPIILVGTKLDLRDDKQFCIDHPGAVPITTAQGEELRKLINAPAYIECSSKSQENVKAVFDAAIRVVLQPPKQKKKKNKAQKACSIL

SEQ ID NO: 8189 - DNA, 640 bp, Gossypium hirsutum
  CDS (17)..(613)
cacgcgtggcgtaagtatgagtgcttccaggttcataaaatgcgtcacggtcggtgacggtgccgtcggcaagacttgtctgctcatttcctacactagcaatactttccctaccgattatgtgccaactgtctttgacaactttagtgctaatgtggttgtggatgggaacactgttaatctgggattgtgggatactgctggacaggaagattacaatagattaagaccattgagctatcgtggagcagatgtcttcttgctggcattttctctcattagcaaagctagctatgaaaatgttgctaagaaatggattccagaattgagacattatgcacccggtgttccaattattcttgttgggactaagcttgatcttcgagaagataagcagttcttcatagatcaccctggtgcggtgcccattaccacagcacagggtgaggaattgagaaagctaattggagcgcatttttacattgagtgtagttcaaaaacacaacagaatgtgaaagcggtctttgatgcggccatcaaagtagttctccagcctccaaagaagaagaagaaaaagaagagaaaggcacaaaaagcttgctcaatattgtgatcatgcaaagaagtgatattggtgcag

SEQ ID NO: 8190 - protein, 198 aa, Gossypium hirsutum
MSASRFIKCVTVGDGAVGKTCLLISYTSNTFPTDYVPTVFDNFSANVVVDGNTVNLGLWDTAGQEDYNRLRPLSYRGADVFLLAFSLISKASYENVAKKWIPELRHYAPGVPIILVGTKLDLREDKQFFIDHPGAVPITTAQGEELRKLIGAHFYIECSSKTQQNVKAVFDAAIKVVLQPPKKKKKKKRKAQKACSIL

SEQ ID NO: 8191 - DNA, 594 bp, Zea mays
  CDS (1)..(594)
atgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaatactgtcaacctcggcctctgggacactgcaggtcaagaggattacaacagactgagaccactgagctatcgtggagctgatgtttttcttctggctttctcactgatcagtaaggccagctatgagaatgtttcgaagaagtggatacctgaactgaagcattatgcacctggtgtgccaattattctcgtagggacaaagcttgatcttcgagacgacaagcagttctttgtggaccatcctggtgctgtccctatcactactgctcagggagaggagctaagaaagcaaataggcgctccatactacatcgaatgcagctcgaagacccaactaaacgtgaagggcgtctttgatgcggcgataaaggttgtgctgcagccgcctaaggcgaagaagaagaaaaaggtgcagaggggggcgtgctccattttgtga

SEQ ID NO: 8192 - protein, 197 aa, Zea mays
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELRKQIGAPYYIECSSKTQLNVKGVFDAAIKVVLQPPKAKKKKKVQRGACSIL

SEQ ID NO: 8193 - DNA, 1045 bp, Zea mays
  CDS (45)..(707)
gaattcggcacgagctggctcgtgcagcggcggcagtgagagcgatgagcgcggcggcagcggcggcggcgagctcggtcaccaagttcatcaagtgcgtcacggtcggcgatggggccgtcgggaagacctgcatgctcatctgctacacctgcaacaagttccccacggattacatccccaccgtatttgacaacttcagcgccaatgtctccgtgggtgggagcatcgtcaacttgggcctctgggacacggcaggccaggaggattacagcaggttgaggcctctcagctacaggggtgctgatgtgttcatcctctccttctccctggtcagcagggcgagctatgagaacgtcctgaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagataggtgctgtggcgtacatagaatgcagctcaaagacacagaggaacgtaaaggctgtgttcgacactgcaattaaagtagtgctgcaaccaccgaggagaagagaagttaccaggaagaaaatgaagacaagttcgaatcagtctctgagaagatacctctgtggaagcggatgtttcacatcgtaaagcacagactcttctgcgactgttgtactggacttgctagatggttgcagctctatgaatgagtagtcccctccgcagccactgggaacttctggttctctgctaccttccgatagagtgctcttttgcgttcaccagctgagaaaaatgaagcgaggttctagtttataaattccctacgaggtgtaccttctttagtatgaatggtgggctatttagcagttcagcaaagtgtgaagtgacccttctatgcatgttttgtttccaaaaactgatgttgctaaatggctaatgaatggttatggtcgcaccggaagaaaaaaaaaaaaaaaaaaaaa

SEQ ID NO: 8194 - protein, 220 aa, Zea mays
MSAAAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLQPPRRREVTRKKMKTSSNQSLRRYLCGSGCFTS

SEQ ID NO: 8195 - DNA, 1058 bp, Zea mays
  CDS (176)..(769)
gaattcggcacgagagctctcaagacggccgacggccggcttgcctacctgctcccatccttcccgagggaccgagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagattacaatagactgcgtccgttgagctatcgtggtgctgatgtttttctgctcgccttttctcttatcagcaaagcaagctatgagaatgtctctaagaagtgggttcctgaattaaggcactatgctcctggcgtgcccataatccttgttgggacaaaacttgatctgcgtgatgataagcagttttttgttgatcaccctggtgctgttccaatttccactgcccagggcgaagagctgaggaagctaattggtgctgccgcctacatcgaatgcagttcaaaaatccagcagaacataaaagcagtgtttgacgcagcaattaaggtggttctccagccaccaaagcaaaagaagaggaagaagaaggtgcagaagggatgcaccattttgtaactacaaacggtagagggcaacagtctggctgcggcgctgctgccaatgataaccatcgcctccttgctgtataatatatcgcctgatcatgccaccagcatgcacaagggagatggtggttttaggatccttgtcctactgtgttgtgtagaccaccgggtgtagttgactgtatctggttgtttgtatgtatggacaagacaaaactagcactgcagatggtatggtaaggcgtaagcaaatacaatatgacattggtccagttccaggaaaaaaaaaaaaaaaaaaa

SEQ ID NO: 8196 - protein, 197 aa, Zea mays
MSASRFIKCVTVGDGAVGKTCMLISYTSNTFPTDYVPTVFDNFSANVVVDGSTVNLGLWDTAGQEDYNRLRPLSYRGADVFLLAFSLISKASYENVSKKWVPELRHYAPGVPIILVGTKLDLRDDKQFFVDHPGAVPISTAQGEELRKLIGAAAYIECSSKIQQNIKAVFDAAIKVVLQPPKQKKRKKKVQKGCTIL

SEQ ID NO: 8197 - DNA, 993 bp, Nicotiana tabacum
  CDS (29)..(625)
ggcacgagggagatttgggttttgtagaatgagtgcgtctaggttcataaagtgtgtcaccgttggcgacggagctgtgggtaaaacttgtcttctcatttcctataccagcaacacatttcccactgattacgtcccaactgtattcgacaattttagtgcaaatgtggttgtcgatgggagcactgtcaatctggggctgtgggatactgcaggtcaggaggattacaatagattaagaccgttgagctaccggggggcagatgtatttatactggcattttctctcattagcaaagcgagctatgaaaatgtctccaaaaagtggattcctgaattgaggcattatgctcctggagttccaattattcttgttggaacaaagctagatctccgagaggataagcaattcttcctggaccatccaggtgctgttccacttaccacagctcagggtgaagagctgagaaagtcgattggtgcttccgcttacattgaatgtagtgcaaaaacacaacagaatgtgaaggctgtttttgatgctgccattaaggtggttctacaaccacccaaacaaaagaagaaaaagaagagaaagggtcaaaaagcctgctctatcttgtgattgctgaaataatagacaagtgatggagatgtagattgttatcaatgtcttccaagttcaaagaatgcagtgtaaggttcaacgttggtagtcctgactgactatgataggaaagcatgaatctgccttgtccgtaacattggaggccaagatgtatatttgtgatccgcatatggttggggatacagatgtgcaaaattctctgtttcgcgttgattctgtgtaatatattatgtaacacttgtgtgatgattccttgaatttgcatctactatgtgttgttaaaatgtaaccgaacatactgatttagattgtccaagaagttgaatttgctatgtcataaaaaaaaaaaaaaaaaaaaaaaaaaa

SEQ ID NO: 8198 - protein, 198 aa, Nicotiana tabacum
MSASRFIKCVTVGDGAVGKTCLLISYTSNTFPTDYVPTVFDNFSANVVVDGSTVNLGLWDTAGQEDYNRLRPLSYRGADVFILAFSLISKASYENVSKKWIPELRHYAPGVPIILVGTKLDLREDKQFFLDHPGAVPLTTAQGEELRKSIGASAYIECSAKTQQNVKAVFDAAIKVVLQPPKQKKKKKRKGQKACSIL

SEQ ID NO: 8199 - DNA, 576 bp, Candida albicans
  CDS (1)..(576): transl_table=12
atgcaaactataaaatgtgttgttgtcggtgatggtgccgttggtaaaacttgcttattaatctcgtataccactagtaaatttccagctgattatgttcctactgtttttgataattatgctgtaaccgtgatgataggagacgaaccatttaccttgggattatttgatactgctggtcaagaagattacgacagattaaggcctttgtcatatccatcgactgatgtattccttgtttgtttttccgtcatttctcccgcttcgtttgaaaatgttaaagaaaaatggttcccagaagttcatcaccattgtcccggtgtgccaataattattgtcggtacccaaactgatttacgaaacgatgatgttattttacagagattgcacagacaaaaattgtccccaatcacccaggaacagggtgaaaaattggctaaggaattgagagctgtcaagtatgttgagtgttctgcattgactcaaagaggattgaaaacagtgtttgacgaggctatagtagctgcattagaacctcctgtaattaaaaaatcgaaaaagtgtactattttatag

SEQ ID NO: 8200 - protein, 191 aa, Candida albicans
MQTIKCVVVGDGAVGKTCLLISYTTSKFPADYVPTVFDNYAVTVMIGDEPFTLGLFDTAGQEDYDRLRPLSYPSTDVFLVCFSVISPASFENVKEKWFPEVHHHCPGVPIIIVGTQTDLRNDDVILQRLHRQKLSPITQEQGEKLAKELRAVKYVECSALTQRGLKTVFDEAIVAALEPPVIKKSKKCTIL

SEQ ID NO: 8201 - DNA, 579 bp, Schizosaccharomyces pombe
  CDS (1)..(579)
atgcccaccattaagtgtgtcgtagtaggagacggtgctgtaggaaagacctgtctgcttatttcctatactacaaacaagtttcctagtgactatgtgccaactgtattcgataattatgctgtcactgtcatgatcggtgatgaaccatacactcttggtttattcgataccgctggtcaggaggattatgatcgcttgcgtcctttatcctatcctcaaacagacgtctttttggtttgttttagtgtaacttctcctgccagttttgaaaatgtgaaagaaaagtggtttcccgaagttcatcatcattgtccgggcgtcccgtgcttaattgttggtacccaaattgatttacgtgatgacccttctgtgcaacagaaactagctcgccagcatcagcatccccttacacatgagcaaggtgaacgattagctcgtgagttgggtgctgtcaagtatgttgagtgttccgctttgacccaaaaagggttaaagaatgtttttgatgaagctattgtagccgctcttgatcctcctgttcctcacaagaaaaagtcaaagtgtttggtactgtaa

SEQ ID NO: 8202 - protein, 192 aa, Schizosaccharomyces pombe
MPTIKCVVVGDGAVGKTCLLISYTTNKFPSDYVPTVFDNYAVTVMIGDEPYTLGLFDTAGQEDYDRLRPLSYPQTDVFLVCFSVTSPASFENVKEKWFPEVHHHCPGVPCLIVGTQIDLRDDPSVQQKLARQHQHPLTHEQGERLARELGAVKYVECSALTQKGLKNVFDEAIVAALDPPVPHKKKSKCLVL

SEQ ID NO: 8203 - DNA, 576 bp, Saccharomyces cerevisiae
  CDS (1)..(576)
atgcaaacgctaaagtgtgttgttgtcggtgatggtgctgttgggaaaacgtgccttctaatctcctatacaacgaatcaatttccagccgactatgttccaacagtgttcgataactatgcggtgactgtgatgattggtgatgaaccatatacgttaggtttgtttgatacggccggtcaagaagattacgatcgattgagacccttgtcatatccttctactgatgtatttttggtttgtttcagtgttatttccccaccctcttttgaaaacgttaaagaaaaatggttccctgaagtacatcaccattgtccaggtgtaccatgcctggtcgtcggtacgcagattgatctaagggatgacaaggtaatcatcgagaagttgcaaagacaaagattacgtccgattacatcagaacaaggttccaggttagcaagagaactgaaagcagtaaaatatgtcgagtgttcggcactaacacaacgcggtttgaagaatgtattcgatgaagctatcgtggccgccttggagcctcctgttatcaagaaaagtaaaaaatgtgcaattttgtag

SEQ ID NO: 8204 - protein, 191 aa, Saccharomyces cerevisiae
MQTLKCVVVGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLVVGTQIDLRDDKVIIEKLQRQRLRPITSEQGSRLARELKAVKYVECSALTQRGLKNVFDEAIVAALEPPVIKKSKKCAIL

SEQ ID NO: 8205 - DNA, 1041 bp, Candida albicans; identical to SEQ ID NO: 8093
  CDS (1)..(1041): transl_table=12

SEQ ID NO: 8206 - protein, 346 aa, Candida albicans
MTPNGSRRHSAYMGSPRSQHSSTMETGYNPYEAVQKKQELYQNNNGNSPTVIIEEDPYIPNYKELSLANKKTNYNMKIVVVGDGGCGKTCLLLAYTQNKFPSIYVPTVFENYVTAVQSPNGKTVELALWDTAGQEEYDRLRPLSYPDVDILLVCFAVDNEVSLENVKDMWFPEVNHYCPGIPIILVGTKSDLLSDMNHDASIRVAKEIGAIGLIFTSAKTMFNVRTVFNFALNHFQRNMELQEQYEKTLGSRKRISRVLGGSNGGSGNHSRHHSRNYSNVSNNRRGHLKNTSYDSTALLDQPLTEDTYVKNPYGNFGYKANVESPYNQDEFAFTRERKKKKKCVIL

SEQ ID NO: 8207 - DNA, 648 bp, Arabidopsis thaliana
  CDS (1)..(648)
atggcttcaagtgcttcaaagttcatcaagtgtgtgactgttggtgatggtgctgttggtaaaacctgtatgctcatctgctacaccagcaataaattccccactgactacataccaacagtttttgacaactttagtgcaaatgttgttgttgaaggcaccactgtcaatttggggctttgggacactgctgggcaagaagactataacagattaaggcctttaagttacaggggagcagatgttttcgtcttgtctttctcattagtcagccgagctagctacgagaatgtttttaaaaagtggatccctgaactccaacactttgctccaggagttccccttgtccttgttggtaccaaattagatcttcgtgaagataagcattatttggctgatcatcctggactatcccctgtaactactgcacagggagaggagttgcgtaagctaattggtgcgacgtattacattgagtgtagttcaaaaactcaacagaatgtgaaagcagtttttgattctgcgataaaggaagtgatcaaacctctggttaaacaaaaggagaagactaagaagaagaagaagcaaaagtcgaatcacggctgtttatcaaatgttctgtgtgggaggatagtgactcggcattga

SEQ ID NO: 8208 - protein, 215 aa, Arabidopsis thaliana
MASSASKFIKCVTVGDGAVGKTCMLICYTSNKFPTDYIPTVFDNFSANVVVEGTTVNLGLWDTAGQEDYNRLRPLSYRGADVFVLSFSLVSRASYENVFKKWIPELQHFAPGVPLVLVGTKLDLREDKHYLADHPGLSPVTTAQGEELRKLIGATYYIECSSKTQQNVKAVFDSAIKEVIKPLVKQKEKTKKKKKQKSNHGCLSNVLCGRIVTRH

SEQ ID NO: 8209 - DNA, 594 bp, Arabidopsis thaliana
  CDS (1)..(594)
atgagcgcttcgaggttcgtaaagtgcgtgacggttggtgatggagctgtcggaaaaacttgtttgttgatttcttacacaagcaacactttccctacggattatgtgcctaccgttttcgataatttcagtgccaatgttgtggttaatggaagcactgtgaatcttggattgtgggacactgcagggcaagaggattacaatagattaagaccactgagttaccgtggagcagatgttttcattttggccttctctcttatcagtaaagccagttatgaaaacgtctccaaaaagtggatcccggagttgaaacattacgcgcctggtgtccccatcgtccttgttggaacaaagcttgatcttcgagatgataaacagttctttatcgaccatcctggtgctgttccgattactactgctcagggagaggagctgaggaagcaaataggagcacctacttacatcgaatgcagttccaaaactcaagagaatgtgaaggcggtgtttgacgcagccatccgagtggtgttgcaaccgccaaagcagaagaagaagaagagcaaagcgcagaaggcatgctccattctatga

SEQ ID NO: 8210 - protein, 197 aa, Arabidopsis thaliana
MSASRFVKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFIDHPGAVPITTAQGEELRKQIGAPTYIECSSKTQENVKAVFDAAIRVVLQPPKQKKKKSKAQKACSIL

SEQ ID NO: 8211 - DNA, 913 bp, Gossypium hirsutum
  CDS (12)..(602)
gagaaaaaacaatgagcactgcaagatttatcaagtgtgtcacggtcggtgatggagctgtggggaaaacttgtatgctcatttcatataccagcaatactttcccaacggattatgttccaacagtatttgataactttagtgccaatgtggtggtggatggcagcacagtgaaccttggcctatgggacactgccgggcaagaagattataataggctaaggccactgagttatagaggagctgatgtgtttttgttggccttttctcttataagcaaggccagttatgaaaacatctacaaaaagtggatcccagagctaagacattatgctcataatgtaccagttgtgcttgttggaaccaaactagatttgcgagatgacaagcagttcctcattgatcaccctggagcaacaccaatatcaacatctcagggagaagaactaaagaagatgataggagcagttacttatatagaatgcagctccaaaacccaacagaatgtgaaggctgttttcgatgctgcaataaaagtagctttgaggccaccaaaaccaaagagaaagccttgcaaaaggagaacatgtgctttcctttgaatattggatcattattacagtcaaaaacagttaacaaaagctgttgcagataaacactgaatctgctatagtttgtttttggtttacatatgttccacgtgaaactatgaagcatctctaagaaaacccaaactatcatatcaacccatcgatcaatgaatcgatttcaattttcgcagtataagttccttttaatcctttctttttacttcattttataacgaattctatggataatgttccctacaaacatgtcattacaatgtttaattataaattccattcttctattttactaaaaaaaaaaaaaa

SEQ ID NO: 8212 - protein, 196 aa, Gossypium hirsutum
MSTARFIKCVTVGDGAVGKTCMLISYTSNTFPTDYVPTVFDNFSANVVVDGSTVNLGLWDTAGQEDYNRLRPLSYRGADVFLLAFSLISKASYENIYKKWIPELRHYAHNVPVVLVGTKLDLRDDKQFLIDHPGATPISTSQGEELKKMIGAVTYIECSSKTQQNVKAVFDAAIKVALRPPKPKRKPCKRRTCAFL

SEQ ID NO: 8213 - DNA, 594 bp, Arabidopsis thaliana
  CDS (1)..(594)
atgagcgcttcgaggttcataaagtgtgtcaccgttggcgacggagctgttggtaaaacctgtttgctgatttcttacaccagcaacacttttcctacggattatgtaccgactgttttcgataactttagcgcaaatgtggttgttaatggagccactgtgaatcttgggctatgggataccgcagggcaggaggattataacagattaagacctttgagttaccgcggtgctgatgttttcatcttagcattctctcttatcagtaaggctagttatgagaatgtctccaagaagtggatcccagagctgaagcattatgcccctggtgtccctatagttcttgttggaaccaaactagatcttcgggatgacaaacagttcttcattgaccaccctggcgctgtaccaattactactgctcagggagaggaactgaagaaactaattggagctcccgcatacatcgagtgcagttcaaaaacacaagagaacgtgaaaggagtatttgatgcagcgatccgagtggttcttcaacctccaaagcagaagaaaaagaaaagcaaagcacaaaaagcctgctccattttgtaa

SEQ ID NO: 8214 - protein, 197 aa, Arabidopsis thaliana
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFIDHPGAVPITTAQGEELKKLIGAPAYIECSSKTQENVKGVFDAAIRVVLQPPKQKKKKSKAQKACSIL

SEQ ID NO: 8215 - DNA, 710 bp, Beta vulgaris
  CDS (91)..(684)
ttgattgatcaagaggagaagagagagtgagaggttgtttgaatagaagatcgttagatatttttttttttaattttttttgttaaaaaaatgagtgcttcgaggttcataaaatgtgttacagttggtgatggtgccgttggtaaaacttgcttgttgatttcttacaccagcaacacctttcctacggactacgtgcccactgtttttgacaatttcagtgccaatgtcgtcgttaacggggccacagttaatctgggattatgggatactgcaggacaagaggattataacagattaagacctttgagttatcgtggagcagatgtttttattctcgctttctcccttattagcaaggctagttatgaaaatgtttctaagaagtggattcctgagttgaagcattatgctcctggtgtccccattgttcttgttggaacaaagctcgatcttcgggatgacaagcagttttttatcgaccaccctggtgcagttccaatcactacagctcagggagaggaattaaggaaactgattggggctcctgcttacatcgaatgcagttcaaaaacacagcagaatgtcaaggcagtttttgatgcagccattaaggtcgtgcttcaaccaccaaagacaaagaaaaagaagtcaaaggcacagaaggcttgctccatattgtaattgtgtaagttgtaaagagaaacaag

SEQ ID NO: 8216 - protein, 197 aa, Beta vulgaris
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFIDHPGAVPITTAQGEELRKLIGAPAYIECSSKTQQNVKAVFDAAIKVVLQPPKTKKKKSKAQKACSIL

SEQ ID NO: 8217 - DNA, 606 bp, Arabidopsis thaliana
  CDS (1)..(606)
atgagcacagcaagattcattaagtgtgtgactgtcggagatggagcagtgggaaagacttgtatgctcatttcatataccagcaatacgtttcctacggattatgttccaacagttttcgacaacttcagcgcaaatgtggtggtcgacgggagtaccgtgaaccttggcctgtgggatactgccggtcaggaagattataataggcttaggcctttgagttacagaggagcagatgtcttcttattagcattttcccttataagcaaggccagttacgagaatattcacaaaaagtggcttccggagctgaaacattatgctcctggcatccccattgtgctcgtcggaacaaaattagatttgagggatgacaagcagttcttgaaggatcatccaggagcagcttctataacaactgctcagggagaagaattaaggaaaatgattggagctgttaggtacttagagtgcagctccaaaacccaacagaatgtgaaggcagtgtttgatacagcgataagggtagctttgaggccaccaaaggcaaagaaaaagataaaaccattgaagactaagagatcaagaatatgctttttcctataa

SEQ ID NO: 8218 - protein, 201 aa, Arabidopsis thaliana
MSTARFIKCVTVGDGAVGKTCMLISYTSNTFPTDYVPTVFDNFSANVVVDGSTVNLGLWDTAGQEDYNRLRPLSYRGADVFLLAFSLISKASYENIHKKWLPELKHYAPGIPIVLVGTKLDLRDDKQFLKDHPGAASITTAQGEELRKMIGAVRYLECSSKTQQNVKAVFDTAIRVALRPPKAKKKIKPLKTKRSRICFFL

SEQ ID NO: 8219 - DNA, 597 bp, Arabidopsis thaliana
  CDS (1)..(597)
atgagtgcttcaaggtttatcaagtgtgtcactgtcggcgacggtgctgttggaaagacttgtcttctcatctcctacactagcaacactttccccacggattatgtgccaactgtgttcgataatttcagtgccaatgtgattgttgatggcaacactatcaacttgggattgtgggatactgcagggcaagaggactacaatagactaagacctttgagctatcgcggtgcagatgtcttcttacttgcattctcacttgtcagcaaagctagctatgaaaatgtttctaaaaagtgggttcctgaactgagacattatgctcctggtgttcccatcatcctcgttggaacaaagcttgatcttcgagatgataagcaattctttgccgagcaccctggtgctgtgcctatctctaccgctcagggtgaagaactaaagaagctgattggggcgcctgcttatatcgaatgcagtgcaaaaactcaacagaatgtgaaagcagtgtttgatgcggctatcaaggtcgttctccagccaccaaaaaacaagaagaagaagaagagaaaatctcagaaaggttgttctatactctga

SEQ ID NO: 8220 - protein, 198 aa, Arabidopsis thaliana
MSASRFIKCVTVGDGAVGKTCLLISYTSNTFPTDYVPTVFDNFSANVIVDGNTINLGLWDTAGQEDYNRLRPLSYRGADVFLLAFSLVSKASYENVSKKWVPELRHYAPGVPIILVGTKLDLRDDKQFFAEHPGAVPISTAQGEELKKLIGAPAYIECSAKTQQNVKAVFDAAIKVVLQPPKNKKKKKRKSQKGCSIL

SEQ ID NO: 8221 - DNA, 588 bp, Arabidopsis thaliana
  CDS (1)..(588)
atggcgtcaaggtttataaagtgtgtgaccgtcggagatggtgccgtcggaaaaacttgcatgctcatttcttacactagcaatacttttcctactgattatgtgccaactgttttcgacaacttcagtgctaatgtggttgttgatggcaacactgtcaatcttggattgtgggatactgctggtcaagaggactacaacaggttacgacctttgagttaccgtggtgctgatgttttcattcttgctttctctcttattagcaaggctagctatgagaatatagccaagaagtggattcctgagctcaggcattatgctcctggtgttcccattatccttgttgggacaaaactcgatcttcgagatgacaagcaattctttatagatcatcctggtgctgtgccaattactacaaaccagggagaggaactgaagaaactgattggatctgctgtctacattgaatgtagttcaaagacacagcagaacgtgaaggcagtgtttgatgcagctataaaagtggtgcttcagccaccaaagcagaagaagaagaaaaagaataagaaccgttgcgcgttcttgtga

SEQ ID NO: 8222 - protein, 195 aa, Arabidopsis thaliana
MASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPITTNQGEELKKLIGSAVYIECSSKTQQNVKAVFDAAIKVVLQPPKQKKKKKNKNRCAFL

SEQ ID NO: 8223 - DNA, 591 bp, Arabidopsis thaliana
  CDS (1)..(591)
atgagtgcttcgaggtttataaagtgtgtcaccgtcggcgatggtgccgtcggaaaaacttgtatgctgatttcttacacaagcaacactttccctacggactatgttccaactgttttcgacaacttcagtgctaatgtggttgtagatgggaacacggtgaatcttggattgtgggatacagctggtcaagaagactataacaggttaagaccgttgagttaccgtggtgccgatgtcttcattcttgcattctcgcttattagcaaagctagctacgagaatgtagccaagaagtggattcctgagcttaggcattatgcccctggtgttcctataatcctcgttggaacgaaactcgatcttcgagatgacaagcaattcttcatagaccatcctggtgcagtgcctattactacaaaccagggagaggaactaaagaaactgataggatcaccaatctacattgaatgtagttcaaagactcagcagaatgtgaaagcagtctttgacgcagccataaaagtggtgcttcagccaccgaaacagaagaagaagaaaaagaacaagaaccgctgcgtgttcttgtga

SEQ ID NO: 8224 - protein, 196 aa, Arabidopsis thaliana
MSASRFIKCVTVGDGAVGKTCMLISYTSNTFPTDYVPTVFDNFSANVVVDGNTVNLGLWDTAGQEDYNRLRPLSYRGADVFILAFSLISKASYENVAKKWIPELRHYAPGVPIILVGTKLDLRDDKQFFIDHPGAVPITTNQGEELKKLIGSPIYIECSSKTQQNVKAVFDAAIKVVLQPPKQKKKKKNKNRCVFL

SEQ ID NO: 8225 - DNA, 594 bp, Arabidopsis thaliana
  CDS (1)..(594)
atgagcgcatcaaggttcataaagtgcgtcaccgttggtgatggagctgttggtaaaacctgtttgctgatttcttataccagcaacacctttcccacggattatgttccgactgttttcgataactttagtgcaaatgtggttgttaatggagccacggtgaatcttggattgtgggatactgcagggcaagaggactataacagattaagacctttgagttaccgtggtgctgatgttttcattcttgccttctctctcattagtaaggctagttatgagaatgtttccaagaagtggattcctgagttgaagcactatgctcctggtgtcccaattgtccttgttggaaccaaactagatcttcgagatgacaaacagtttttcatcgaccatcctggtgctgtccctattaccactgttcagggagaggagctgaagaagctaattggagcgccagcttacatcgagtgcagttcaaaatcacaagagaacgtgaagggcgtgtttgatgcagcgatcagagtggtccttcaacctccaaagcagaagaaaaagaagaacaaagcacaaaaggcctgctccatcttgtaa

SEQ ID NO: 8226 - protein, 197 aa, Arabidopsis thaliana
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFIDHPGAVPITTVQGEELKKLIGAPAYIECSSKSQENVKGVFDAAIRVVLQPPKQKKKKNKAQKACSIL

SEQ ID NO: 8227 - DNA, 630 bp, Arabidopsis thaliana
  CDS (1)..(630)
atgagtgcttcgaagttcataaaatgtgttactgttggagatggggctgttgggaagacatgtatgcttatctgttacactagcaacaagtttcctactgattatataccgactgtgttcgacaatttcagtgccaatgtagctgtggatggacaaatcgttaatttagggctatgggacactgccggtcaagaagattacagtaggttaagaccattgagttatagaggagctgatatcttcgtcttagccttttcgcttattagcaaggcgagttacgaaaatgtactcaagaagtggatgcctgaacttcgtcggtttgcgccaaatgttcccatagttcttgttggtacaaagctagatctccgggatgacaagggatacctcgcggatcacaccaatgtcattacctctactcagggagaggaattgaggaagcaaattggtgcagctgcttatattgagtgtagttccaagactcaacaaaatgtgaaagcagtgtttgatacagcgatcaaggtggttcttcagcctccaaggaggaaagaggtcccgaggaggaggaagaatcatagaagatccggttgctccattgcgagtattgtctgtggaggttgcaccgctgcttaa

SEQ ID NO: 8228 - protein, 209 aa, Arabidopsis thaliana
MSASKFIKCVTVGDGAVGKTCMLICYTSNKFPTDYIPTVFDNFSANVAVDGQIVNLGLWDTAGQEDYSRLRPLSYRGADIFVLAFSLISKASYENVLKKWMPELRRFAPNVPIVLVGTKLDLRDDKGYLADHTNVITSTQGEELRKQIGAAAYIECSSKTQQNVKAVFDTAIKVVLQPPRRKEVPRRRKNHRRSGCSIASIVCGGCTAA

SEQ ID NO: 8229 - DNA, 627 bp, Arabidopsis thaliana
  CDS (1)..(627)
atggcttcgagtgcttcaaaattcatcaaatgtgtgactgttggagatggtgccgttggaaaaacttgtatgctcatctgctacactagcaacaaattccctactgactacataccaacagtttttgacaactttagtgttaatgttgtggttgaaggcatcactgtgaacttaggcctttgggacactgccgggcaagaagactataacagactaaggcctttaagttacagaggagcagatgtttttgtgttggctttctcattgatcagccgagctagctatgagaatgtgtttaaaaagtggatccctgaactccaacactttgcaccaggagtccccattgtgcttgttggtaccaaaatggatcttcgtgaagatagacattacttgtctgatcatcctggactgtccccggtaactacatcacagggagaggaactccgcaagcatatcggagcgacttattacattgaatgtagctcaaaaactcaacagaatgtgaaagccgtatttgatgctgctattaaagtagtaattaaaccagcagtgaaacaaaaggagaagaagaagaagcagaagcctcgcagcggatgtctctcaaacattctgtgtgggaagaattga

SEQ ID NO: 8230 - protein, 208 aa, Arabidopsis thaliana
MASSASKFIKCVTVGDGAVGKTCMLICYTSNKFPTDYIPTVFDNFSVNVVVEGITVNLGLWDTAGQEDYNRLRPLSYRGADVFVLAFSLISRASYENVFKKWIPELQHFAPGVPIVLVGTKMDLREDRHYLSDHPGLSPVTTSQGEELRKHIGATYYIECSSKTQQNVKAVFDAAIKVVIKPAVKQKEKKKKQKPRSGCLSNILCGKN

SEQ ID NO: 8231 - DNA, 630 bp, Arabidopsis thaliana
  CDS (1)..(630)
atgtcagcttcaatggctgcaacatcaacatcatcagcaacagctacaacgtttataaagtgtgtcactgttggcgatggagctgtgggcaaaacttgtcttcttatttcctacaccagcaacacgttccccactgattatgttccaacagtgttcgacaatttcaatgctaatgttttagtcgatggtaaaactgtcaatctgggtctctgggatactgctggtcaagaagactacaatagggttagaccattgagttacagaggagcagatgttttcattcttgccttctcacttattagcaggcctagctttgagaacattgctaaaaagtgggtacccgagctgagacattatgccccgactgtgcctattgttcttgtgggaaccaaatcagatctaagagacaacatgcagttcccaaagaattatccaggtgcttgcacaatcttcccagaacagggtcaagaactaagaaaggaaataggagcattagcatacatagagtgcagctcaaaagcacaaatgaacgtaaaagccgtgtttgatgaagcgatcaaagtagttttacatcctccttcaaagactaagaagcgaaagagaaagatcggtttatgccatgttctttga

SEQ ID NO: 8232 - protein, 209 aa, Arabidopsis thaliana
MSASMAATSTSSATATTFIKCVTVGDGAVGKTCLLISYTSNTFPTDYVPTVFDNFNANVLVDGKTVNLGLWDTAGQEDYNRVRPLSYRGADVFILAFSLISRPSFENIAKKWVPELRHYAPTVPIVLVGTKSDLRDNMQFPKNYPGACTIFPEQGQELRKEIGALAYIECSSKAQMNVKAVFDEAIKVVLHPPSKTKKRKRKIGLCHVL

SEQ ID NO: 8233 - DNA, 840 bp, Gossypium hirsutum
  CDS (9)..(599)
gagagatgatgaatacgtcgaggtttatcaagtgtgtcacagtaggtgatggagcagtggggaagacttgcatgcttatttcgtatactagcaatacgttcccaacggactatgttcccacagtgtttgacaactttagtgctaatgtggtggtggatggcagcacagtgaaccttggcctatgggatactgccggccaagaagattacaataggttaagacctttgagttataggggagctgatgtgtttttgttggccttttctcttattagcagggccagttatgaaaatgttcacaaaaagtggatccccgagcttagacattatgctcctaatgtgccaattgtgcttgttggaaccaaactagatttaagagatgacaagcaattcttgagtgataaccccggagcaatatcaataacaacatctcagggtgaggagttgaagaagatgataggtgcagttacttacattgagtgcagctccaaaacccaacagaatgtgaaggctgtttttgatgttgcaataaagatagcattgaggccaccaaaaccaaagagaaaacctataaaaagaagatcatgtgctttcctttgaacctcaattctacattacaatcaaattattatttgctatatactttttgttttttatttttatttttttcacataaaatttcatatgtaaccatgaaggatctctaaaaggggattagattgaaattgcaatggtatttgtaatgtataaaaagaaaaaaaatatatatttttgtaatagtttaaactcattcattgttattaccttatttctttccatttaaaaaaaaaaaaaaaaaaaa

SEQ ID NO: 8234 - protein, 196 aa, Gossypium hirsutum
MNTSRFIKCVTVGDGAVGKTCMLISYTSNTFPTDYVPTVFDNFSANVVVDGSTVNLGLWDTAGQEDYNRLRPLSYRGADVFLLAFSLISRASYENVHKKWIPELRHYAPNVPIVLVGTKLDLRDDKQFLSDNPGAISITTSQGEELKKMIGAVTYIECSSKTQQNVKAVFDVAIKIALRPPKPKRKPIKRRSCAFL

SEQ ID NO: 8235 - DNA, 597 bp, Candida albicans
  CDS (1)..(597): transl_table=12
atggttaacggtccagctgaacttcgtagaaaattagtcattgtcggtgatggtgcttgtggtaagacttgtttattaattgttttttcaaaaggtactttcccagaagtttatgtcccaacagtttttgaaaattacgttgctgatgttgaagttgatggtagaaaagttgaattggcattatgggatactgctggtcaagaagattatgatagattaagaccattatcttatccagattctaatgttattttgatttgtttttcagttgattcaccagattctttagataacgttttagaaaaatggatttctgaagttttacatttctgtcaaggtgttccaatcattttagttggttgtaaatctgatttaagagatgatcctcatactattgaagccttgagacaacaacaacaacaaccagtctcaacttctgaaggccaacaagttgctcaaagaattggtgctgctgattacttggaatgttctgctaaaaccggtagaggtgttagagaagtgtttgaagctgctactagagcttctttaagagttaaagaaaagaaggaaaagaagaagaaatgtgttgtcttgtaa

SEQ ID NO: 8236 - protein, 198 aa, Candida albicans
MVNGPAELRRKLVIVGDGACGKTCLLIVFSKGTFPEVYVPTVFENYVADVEVDGRKVELALWDTAGQEDYDRLRPLSYPDSNVILICFSVDSPDSLDNVLEKWISEVLHFCQGVPIILVGCKSDLRDDPHTIEALRQQQQQPVSTSEGQQVAQRIGAADYLECSAKTGRGVREVFEAATRASLRVKEKKEKKKKCVVL

SEQ ID NO: 8237 - DNA, 594 bp, Pisum sativum
  CDS (1)..(594)
atgagcgcttctaggttcatcaagtgtgttactgttggggatggagctgtgggtaaaacgtgtttgctaatttcctacacaagcaataccttccctactgattacgtgccaactgtcttcgacaatttcagtgcaaatgtggttgtgaatggaagcaccgttaatctgggattgtgggatactgcaggacaagaggattataacagattaagacctttgagttatcgtggtgccgatgttttcattctggctttctccctcattagcaaggccagttatgaaaatgtttccaaaaagtggattccagagttaaagcattatgcacctggtgttcccattatactggttggcactaagcttgatcttcgggatgacaagcagttctttgttgaccatcctggtgctgtgcccattaccactgctcagggagaagagcttaggaagctgatcaatgcacctgcttatattgaatgcagttcgaaatcacagcagaatgtgaaagcagtgtttgatgcagccataagagttgtccttcaaccacctaagcaaaagaaaaagaagagtaaagcacaaaaggcctgttcgatattgtga

SEQ ID NO: 8238 - protein, 197 aa, Pisum sativum
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIILVGTKLDLRDDKQFFVDHPGAVPITTAQGEELRKLINAPAYIECSSKSQQNVKAVFDAAIRVVLQPPKQKKKKSKAQKACSIL

SEQ ID NO: 8239 - DNA, 609 bp, Schizosaccharomyces pombe
  CDS (1)..(609)
atggcgacagaacttcgcagaaagctcgttattgtgggagatggtgcatgtggtaaaacatgcttattaattgtattttctaaaggaacctttcccgaggtctatgttcccactgtttttgaaaattatgtagctgatgttgaggttgatggacgccacgttgagttggctctttgggatacggctggacaagaagattacgaccgtctacgtcccttgtcatatcctgactcacatgttatccttatttgctttgctgttgattctcccgattctcttgacaatgttcaagaaaaatggatttccgaggttctccatttctgttccagtcttcctattttgcttgtcgcttgcaaggctgatctccgtaacgacccaaaaattattgaggagttatccaagactaatcagcatcccgtcaccacagaagaaggtcaagcagtagctcagaagattggtgcttacaaataccttgagtgttctgccaagacgaatgaaggtgttcgtgaggtttttgaatcagccactcgtgctgctatgctcaaacacaagcccaaagtgaagccctctagtggaactaagaagaagaagcgttgtatcttgttgtaa

SEQ ID NO: 8240 - protein, 202 aa, Schizosaccharomyces pombe
MATELRRKLVIVGDGACGKTCLLIVFSKGTFPEVYVPTVFENYVADVEVDGRHVELALWDTAGQEDYDRLRPLSYPDSHVILICFAVDSPDSLDNVQEKWISEVLHFCSSLPILLVACKADLRNDPKIIEELSKTNQHPVTTEEGQAVAQKIGAYKYLECSAKTNEGVREVFESATRAAMLKHKPKVKPSSGTKKKKRCILL

SEQ ID NO: 8241 - DNA, 630 bp, Saccharomyces cerevisiae
  CDS (1)..(630)
atgtcacaacaagttggtaacagtatcagaagaaagctggtaatcgttggtgatggtgcctgtggtaagacatgtttattaatcgtcttttccaagggccaatttccagaagtctacgtaccaactgtctttgaaaactatgtagcagatgttgaagttgatgggcgtcgtgtagagctagcgctatgggataccgctggtcaagaagattatgatagactaagaccattgtcatacccagactccaatgtcgtattaatttgtttctctatcgatcttccagattctttagagaatgtacaagaaaaatggattgccgaagtattacatttctgtcaaggtgtgccaattattcttgttggttgtaaagtggatttgagaaacgacccacaaaccattgaacaattaagacaagaaggtcaacaacccgttacatcacaggagggacaatctgtagcagaccagattggcgcaaccggatactacgaatgttcggccaagactggttatggtgtcagagaagtgtttgaggccgccactagagcttcattgatgggtaaatctaaaacgaatggtaaagctaagaagaacactactgaaaagaagaagaagaagtgtgtcttgttatag

SEQ ID NO: 8242 - protein, 209 aa, Saccharomyces cerevisiae
MSQQVGNSIRRKLVIVGDGACGKTCLLIVFSKGQFPEVYVPTVFENYVADVEVDGRRVELALWDTAGQEDYDRLRPLSYPDSNVVLICFSIDLPDSLENVQEKWIAEVLHFCQGVPIILVGCKVDLRNDPQTIEQLRQEGQQPVTSQEGQSVADQIGATGYYECSAKTGYGVREVFEAATRASLMGKSKTNGKAKKNTTEKKKKKCVLL

SEQ ID NO: 8243 - DNA, 618 bp, Schizosaccharomyces pombe
  CDS (1)..(618)
atgtcaagctgtttcggaagtaaaaagaagcctatttatcggaaaatcgtaattcttggtgatggtgctgctggtaaaaccagtttgttaaatgtatttactaagggttatttccctcaggtatacgagcctactatatttgaaaactacattcatgatatctttgtcgatggaaacagtatagaactgtctctatgggatacagctggtcaagaagagtatgatcaactgcgttcgttatcatattcagatacacatgttattatgatctgctttgccgtggattcacgagactcattagaaaatgtaatcacaaaatggcttccggaagtctctagtaattgccctggtgttaaattggttcttgttgctctaaaatgtgatttacgtggagctgatgaggagcaagttgatcacagtaaaattattgattacgaggaaggactggcagcggcaaaaaaaatcaacgctgtacgatatttagaatgcagcgctaaattaaatcgtggcgtaaatgaagctttcacggaagctgcacgcgttgcccttgccgcgcaaccaagaggtacaaaggatggtgctgatgaatcccatggtaccggatgtatcattgcttga

SEQ ID NO: 8244 - protein, 205 aa, Schizosaccharomyces pombe
MSSCFGSKKKPIYRKIVILGDGAAGKTSLLNVFTKGYFPQVYEPTIFENYIHDIFVDGNSIELSLWDTAGQEEYDQLRSLSYSDTHVIMICFAVDSRDSLENVITKWLPEVSSNCPGVKLVLVALKCDLRGADEEQVDHSKIIDYEEGLAAAKKINAVRYLECSAKLNRGVNEAFTEAARVALAAQPRGTKDGADESHGTGCIIA

SEQ ID NO: 8245 - DNA, 780 bp, Ashbya gossypii
  CDS (1)..(780)
atgagcgcagggccgttgcaagctgcgccaaagaagaattacggagcactgataggcgcggggccggcggtgggcggggcggcattcaaccggacgctgagcgaggttgcgagctacgagcgcagccggcgcgaccacgcgacgccggactaccggatcaagatcgtggtggtgggggacggcgcgacggggaagacgtctctgctgatgtcgtacacacagggccagttcccagaggactacgtgccgaccatcttcgagaactacgtgacgaacattgagggcccacgcgggaaggtgatcgagctggcgctgtgggacactgctgggcaggaggagtacagccggctgcggccgctgtcttacggggacgtggacatcgtgatggtgtgctacgcggcagacaaccgcacgtcgctgacgaacgcggaagagctgtggttcccggaggtgcgccacttctgcccgcacgcgccgatgatgctggtggggctcaagagcgacctgtactcgcttgatgcgctggaccggctcgtggacccgacggacgcggaactggtggcgcgcaagatgggcgccttcgtgcacctgcagtgctcggccaagacgcgacagtgcctggaggacgtgttcaacacggcgatacacacggcgctgtacgacgagctgcgcgcgcccccgcagcgcggggtgaagggcatgttcaagaagaagcagcagcgggacccgcaggcgcagtcttacaagcgggtgcgcaagcaccgctgtgtggtcctatag

SEQ ID NO: 8246 - protein, 259 aa, Ashbya gossypii
MSAGPLQAAPKKNYGALIGAGPAVGGAAFNRTLSEVASYERSRRDHATPDYRIKIVVVGDGATGKTSLLMSYTQGQFPEDYVPTIFENYVTNIEGPRGKVIELALWDTAGQEEYSRLRPLSYGDVDIVMVCYAADNRTSLTNAEELWFPEVRHFCPHAPMMLVGLKSDLYSLDALDRLVDPTDAELVARKMGAFVHLQCSAKTRQCLEDVFNTAIHTALYDELRAPPQRGVKGMFKKKQQRDPQAQSYKRVRKHRCVVL

SEQ ID NO: 8247 - DNA, 612 bp, Schizosaccharomyces pombe
  CDS (1)..(612)
atgtctgctttcaaaaagagtggatccaagtcagagacttcaaagaaacttgtggtcgtaggagatggcggttgtggaaagacatgtcttttaattgtattctcaagcggaacttttcccgagagatatgtgcctacagtgtttgaaaattatatcaccgatataacatatggaccgaacagcaaagttattgaacttgctttgtgggatactgctggtcaggaggaatatgatcgtttacgtcctctaagttacccgaatagcaacgttattttgttgtgtttctcaattgattgtccggcttctctgaataacgttacggagaagtggtatcctgaagttcaacacttttgccctagaactcccatcgttctcgtcgggctaaaagcggatttacgcaaagataggaatgctactgaagtactaagaacccagggtttaacaccagtaacctaccaacaagctcaatccgttgctttatcaatgaacgctccatatgtcgaatgctctgccaaagaaaacactggtgtaaatgaagtttttcaacttgctgttggcctcactataaaaaaatcattttcgttttctaaaaagtcttgcgtgattttataa

SEQ ID NO: 8248 - protein, 203 aa, Schizosaccharomyces pombe
MSAFKKSGSKSETSKKLVVVGDGGCGKTCLLIVFSSGTFPERYVPTVFENYITDITYGPNSKVIELALWDTAGQEEYDRLRPLSYPNSNVILLCFSIDCPASLNNVTEKWYPEVQHFCPRTPIVLVGLKADLRKDRNATEVLRTQGLTPVTYQQAQSVALSMNAPYVECSAKENTGVNEVFQLAVGLTIKKSFSFSKKSCVIL

SEQ ID NO: 8249 - DNA, 603 bp, Schizosaccharomyces pombe
  CDS (1)..(603)
atgactactgagctccgtcgtaaattggttattgttggcgatggtgcttgtggtaaaacatgcttgttgattgttttttccaaaggaacttttcctgaagtttacgtccctactgttttcgaaaattatgttgccgatgtcgaggttgatggaaggcatattgaattggcactatgggatacagctggtcaggaggattacgatcgtttacgccctctttcctatccagactctcacgtcgttttgatttgtttttcagttgatgctccagagagtttggacaatgttcaagaaaaatggatttctgaagttcttcacttctgctccaatttacccattttgctagttgggtgtaaagtggatttacgaaacgatccaaaaacaatcgaagagctctccaaaacctcacagaagcctatcacatttgaagaaggacaggtagtagctcaaaagattggcgcctataagtatctcgaatgttcagcgaaattgaacgaaggggtcaatgaggtttttgagactgcagctcgtgcttccatgcttaaatttaagcctgctagtgtaccgaagacaaaaaagaagaagcactgtatcttactctga

SEQ ID NO: 8250 - protein, 200 aa, Schizosaccharomyces pombe
MTTELRRKLVIVGDGACGKTCLLIVFSKGTFPEVYVPTVFENYVADVEVDGRHIELALWDTAGQEDYDRLRPLSYPDSHVVLICFSVDAPESLDNVQEKWISEVLHFCSNLPILLVGCKVDLRNDPKTIEELSKTSQKPITFEEGQVVAQKIGAYKYLECSAKLNEGVNEVFETAARASMLKFKPASVPKTKKKKHCILL

SEQ ID NO: 8251 - DNA, 1107 bp, Saccharomyces cerevisiae
  CDS (17)..(1012)
tatactaataagtctgatgaggtctattaaatgtgtgataattggtgatggtgcagtaggtaaaacgtcacttctaatatcatatactaccaattcgttcccaacagactatgttccaacggtttttgataattattctactacgatagctatcccgaacggaactgcgagtagccccctagagcttgacaatggtaatgataaaagaggttcactttcatctgccagttcttcaccaagtacggacagaaaactatataaaatcaatttatgggacactgcaggacaggaagattacgatcgtttaagaccgttatgttatccccaaacagatatttttttaatatgtttctcagtaagcgaacatgctagttttgccaatgtcacagaaaaatggctacctgaactgaagcagacttccaatattgaaggtacctctctttatactaaattagggaagtatccaattctattggtaggcaccaaaagtgacctaagagatgatccggcaactcagaaaaaattgcaggaagcaaactccgattacgtgtctcaagaggaaatagatgaactcgtacaaagatgtgggtttatgggctataccgaatgttcagctgctacccaagcaggtgtccgggaagtctttgaacaggcggtgaggtacgctatctacgaaccagaatcccctaaccaaaaatcagcaaatcatactctaactgatgaattaacgactgcaacaaccaacaccaatggagataaaaatattcgagaacaaaaacagcaaccacaccataataatagtacagatagtactcttccgaaaggaagcttacagcaggagaaggaagctctcaatatcaaacccacaaaaaagggacaaaaagacaaaattcacgagcaatcaaaaagcaaaggtagtaaaattgcctcaaataatcatcacaacaagcaagctaaaccaaagacgagaaacgacaagaagaaaaagaagtcaaagtgtgtaatactttaatatcaaggaggcagaaaaagtaaataaataattacatataccgatatcataaataagaaaaaaagaaatctacacatatatttacgttctcattt

SEQ ID NO: 8252 - protein, 331 aa, Saccharomyces cerevisiae
MRSIKCVIIGDGAVGKTSLLISYTTNSFPTDYVPTVFDNYSTTIAIPNGTASSPLELDNGNDKRGSLSSASSSPSTDRKLYKINLWDTAGQEDYDRLRPLCYPQTDIFLICFSVSEHASFANVTEKWLPELKQTSNIEGTSLYTKLGKYPILLVGTKSDLRDDPATQKKLQEANSDYVSQEEIDELVQRCGFMGYTECSAATQAGVREVFEQAVRYAIYEPESPNQKSANHTLTDELTTATTNTNGDKNIREQKQQPHHNNSTDSTLPKGSLQQEKEALNIKPTKKGQKDKIHEQSKSKGSKIASNNHHNKQAKPKTRNDKKKKKSKCVIL

SEQ ID NO: 8253 - DNA, 843 bp, Emericella nidulans; identical to SEQ ID NO: 8091
  CDS (151)..(843)

SEQ ID NO: 8254 - protein, 230 aa, Emericella nidulans
MSSGRVSEATNITQPPAYSKKFVVVGDGGCGKTCLLISYSQGYFPEKYVPTVFENYITQTLHRRSGKTVELALWDTAGQEEYDRLRPLSYPETDLLFVCFAIDCPASLENVMDKWYPEVLHFCPTTPIILVGLKSDLRNKRTCIELLKTQGLTPVTPEQGQAVAGRMNASYVECSSKEMRGVDSVFQLAVDTVVSLEEQNWDTRLPSSSGKPGGKPIGGKKIKKRSCKIL

SEQ ID NO: 8255 - DNA, 543 bp, Oryza sativa
  CDS (1)..(543)
atgagcggcgccaccaagttcatcaagtgcgtcaccgtcggcgacggcgccgtcggcaagacctgcatgctcatctgctacaccagcaacaagttccccaccgattacatccccaccgtgttcgacaacttcagtgctaatgtttcagtggatgggaacatcgtcaacttgggattatgggacactgctggacaagaggattacagcaggctgaggccactgagctacaggggagcggatatatttgtgctggcattctcactgatcagcagagcaagctatgagaatgttctcaagaagtggatgccggagcttcgccggttcgcaccgaatgttccaattgttcttgttgggaccaagttagatctacgtgaccacagatcttaccttgcggaccatcctgctgcttccgcaattacgactgcacagggtgaagaacttagaaagcagataggcgccgcggcttacatcgaatgcagttcgaaaacacaacaggtacaaaactgcaaacaatggattcaatcgattagttctttgtcatag

SEQ ID NO: 8256 - protein, 180 aa, Oryza sativa
MSGATKFIKCVTVGDGAVGKTCMLICYTSNKFPTDYIPTVFDNFSANVSVDGNIVNLGLWDTAGQEDYSRLRPLSYRGADIFVLAFSLISRASYENVLKKWMPELRRFAPNVPIVLVGTKLDLRDHRSYLADHPAASAITTAQGEELRKQIGAAAYIECSSKTQQVQNCKQWIQSISSLS

SEQ ID NO: 8257 - DNA, 648 bp, Hordeum vulgare
  CDS (1)..(648)
atggcgcaccgggtggacaacgagtacgactacctcttcaagatcgtgctcatcggcgactccggcgtcggcaagtccaacatcctctcccgcttcacccgcaacgagttctgcctcgagtccaagtccaccatcggcgtcgagttcgccacccgcaccctccagatagaaggcaagaccattaaagctcagatatgggatactgctggccaagagaggtaccgtgcaatcacaagtgcttactacaggggagctgtgggagcacttttggtgtatgacataacaaagaagcaaacttttgaaaacatcaataggtggcttcgtgagctccgtgaccatgctgactccaacatcgttataatgatggttggaaacaagtctgatctcaaccacctgaggtcagtcccagaggaagatggccaggcattagcagagaaggaagggctatccttcctcgagacctcagcactggaagccttgaatgtcgagaaggcgtttcagactatcctttccgacatccatcagatcataagcaagaaggcgcttgctgcccaggaggctgctggcagtggacctccgactcaaggaaccaccatcaatgttgccgattcatccggtaacacaaagaaagggtgctgctctacctag

SEQ ID NO: 8258 - protein, 215 aa, Hordeum vulgare
MAHRVDNEYDYLFKIVLIGDSGVGKSNILSRFTRNEFCLESKSTIGVEFATRTLQIEGKTIKAQIWDTAGQERYRAITSAYYRGAVGALLVYDITKKQTFENINRWLRELRDHADSNIVIMMVGNKSDLNHLRSVPEEDGQALAEKEGLSFLETSALEALNVEKAFQTILSDIHQIISKKALAAQEAAGSGPPTQGTTINVADSSGNTKKGCCST

SEQ ID NO: 8259 - DNA, 28 bp, Artificial sequence
  primer
atgaatacactattatttaagcgaaaag

SEQ ID NO: 8260 - DNA, 29 bp, Artificial sequence
  primer
ttacattataatacacttgttttttctta

SEQ ID NO: 8261 - protein, 332 aa, Artificial sequence
  consensus sequence
  Variant (2)..(2): Xaa in position 2 is any amino acid
  Variant (4)..(4): Xaa in position 4 is any amino acid
  Variant (10)..(10): Xaa in position 10 is any amino acid
  Variant (15)..(15): Xaa in position 15 is any amino acid
  Variant (18)..(18): Xaa in position 18 is any amino acid
  Variant (20)..(23): Xaa in position 20 to 23 is any amino acid
  Variant (26)..(27): Xaa in position 26 to 27 is any amino acid
  Variant (29)..(29): Xaa in position 29 is any amino acid
  Variant (34)..(34): Xaa in position 34 is any amino acid
  Variant (36)..(48): Xaa in position 36 to 48 is any amino acid
  Variant (49)..(78): Xaa in position 49 to 78 is any or no amino acid
  Variant (80)..(80): Xaa in position 80 is any amino acid
  Variant (89)..(89): Xaa in position 89 is any amino acid
  Variant (91)..(91): Xaa in position 91 is any amino acid
  Variant (99)..(101): Xaa in position 99 to 101 is any amino acid
  Variant (104)..(107): Xaa in position 104 to 107 is any amino acid
  Variant (110)..(111): Xaa in position 110 to 111 is any amino acid
  Variant (113)..(114): Xaa in position 113 to 114 is any amino acid
  Variant (116)..(116): Xaa in position 116 is any amino acid
  Variant (120)..(120): Xaa in position 120 is any amino acid
  Variant (121)..(121): Xaa in position 121 is any or no amino acid
  Variant (124)..(124): Xaa in position 124 is any amino acid
  Variant (127)..(128): Xaa in position 127 to 128 is any amino acid
  Variant (130)..(131): Xaa in position 130 to 131 is any amino acid
  Variant (132)..(142): Xaa in position 132 to 142 is any or no amino acid
  Variant (144)..(145): Xaa in position 144 to 145 is any amino acid
  Variant (147)..(148): Xaa in position 147 to 148 is any amino acid
  Variant (152)..(152): Xaa in position 152 is any amino acid
  Variant (154)..(154): Xaa in position 154 is any amino acid
  Variant (158)..(165): Xaa in position 158 to 165 is any amino acid
  Variant (166)..(186): Xaa in position 166 to 186 is any or no amino acid
  Variant (188)..(194): Xaa in position 188 to 194 is any amino acid
  Variant (195)..(195): Xaa in position 195 is any or no amino acid
  Variant (197)..(197): Xaa in position 197 is any amino acid
  Variant (198)..(198): Xaa in position 198 is any or no amino acid
  Variant (200)..(200): Xaa in position 200 is any amino acid
  Variant (204)..(204): Xaa in position 204 is any amino acid
  Variant (206)..(208): Xaa in position 206 to 208 is any amino acid
  Variant (209)..(209): Xaa in position 209 is any or no amino acid
  Variant (211)..(212): Xaa in position 211 to 212 is any amino acid
  Variant (215)..(216): Xaa in position 215 to 216 is any amino acid
  Variant (218)..(231): Xaa in position 218 to 231 is any amino acid
  Variant (232)..(331): Xaa in position 232 to 331 is any or no amino acid
KXVXVGDGAXGKTCXLIXYXXXXFPXXYXPTVFXNXXXXXXXXXXXXXXXXXXXXXXXXXXXXXXXXXXXXXXXXXXXLXLWDTAGQEXYXRLRPLSYXXXDVXXXXFSXXSXXSXENVXXKWXPEXXHXXXXXXXXXXXXXPXXPXXLVGXKXDLRXXXXXXXXXXXXXXXXXXXXXXXXXXXXXGXXXXXXXXAXXYXECSXKXXXXVXXVFXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXC

SEQ ID NO: 8262 - protein, 17 aa, Artificial sequence
  protein pattern
  Variant (2)..(2): Xaa in position 2 is Ile, Leu or Val
  Variant (3)..(3): Xaa in position 3 is any amino acid
  Variant (4)..(4): Xaa in position 4 is His or Arg
  Variant (5)..(5): Xaa in position 5 is Phe, His or Tyr
  Variant (6)..(6): Xaa in position 6 is Ala, Cys or Val
  Variant (7)..(9): Xaa in position 7 to 9 is any amino acid
  Variant (11)..(11): Xaa in position 11 is any amino acid
  Variant (12)..(12): Xaa in position 12 is Ile, Leu, Met or Val
  Variant (16)..(16): Xaa in position 16 is any amino acid
EXXXXXXXXPXXLVGXK

SEQ ID NO: 8263 - DNA, 1014 bp, Saccharomyces cerevisiae
  CDS (1)..(1014)
atgagtcagtcttacgaagcaggaaatgccaatatgggccaaggggaggatgatgaatttgatggctatttcgaagactttgacaacgatatcatgccaaatagtaataatggacaaagggttggtactaatgctggattgtcattcaatgacgaagtaaatgttaatgatgatgattttttagacatttataatatgtcccctagagagagattgatgcataatatcaggaagaatgttcaaaaattacagttttatttttattcactacgcttatggcaacagattatcattgtcctcctcggcataatgctaatgataatgggtatattgttgctcgtcttccataatgcgattttacataaagttgttgttacttcgaacgatttgagagaaaagatgtcaacacattttatattaatggttctgatattctttgtcgcatttcctcctatgattggctactccttattatccaccactactgggttgatctatggtgtcagttttgagggatgggttacgctagctttgggatctgtaacaggttccattgcctctttcgttgtgttcaagacgatcttgcattcaagagcagaaaagcttgtgcatttgaatagaagatttgaagcattggcttcaattttacaagaaaacaatagctattggattctagctctactgagattatgtcccttcccatattctttgactaatggtgccatagctggtgtttacggtatctcggtacgcaacttttccattgccaacataataaccacaccaaagctgttcatctatctatttataggttctcgtgtaaagagtctcgcagaatctgaatctacaggatctagggtatttgacttggtaagcattattatcacattattaatcctaagtcttacagcatggctcttatacttcaagactaagaagagatatttagaactacaaaaccgcgaccgtcaagtgtccactgatcaactacctgaattgtcttttgaggtctaa

SEQ ID NO: 8264 - protein, 337 aa, Saccharomyces cerevisiae
MSQSYEAGNANMGQGEDDEFDGYFEDFDNDIMPNSNNGQRVGTNAGLSFNDEVNVNDDDFLDIYNMSPRERLMHNIRKNVQKLQFYFYSLRLWQQIIIVLLGIMLMIMGILLLVFHNAILHKVVVTSNDLREKMSTHFILMVLIFFVAFPPMIGYSLLSTTTGLIYGVSFEGWVTLALGSVTGSIASFVVFKTILHSRAEKLVHLNRRFEALASILQENNSYWILALLRLCPFPYSLTNGAIAGVYGISVRNFSIANIITTPKLFIYLFIGSRVKSLAESESTGSRVFDLVSIIITLLILSLTAWLLYFKTKKRYLELQNRDRQVSTDQLPELSFEV

SEQ ID NO: 8265 - DNA, 1461 bp, triticum aestivum
  CDS (197)..(1222)
ggtttgaagcaaaccggccggccaccaaccaaccaacgctcccgaatctatcccatcatatcatatcaaaccttccgccgccggcgagctactcgcagcgccggacagcccggcccacttgttctggttctctccctcctctgcccctccgccgcgagctccaacggagaggggaggaagaagcaaagcctcggacatggcacgcgtcctccctctggacatcgagcccggggaggcgcccagagctggtgagacggttgctagcacgccaagctcttcagctgtggtgtcatgcaatagaattgagcattctgagcaaaacataaaggacgacgaatacacgatgctgatgacgccaactcaacatgcaacagctgacaacaacacagaaattttacctcagcaacccaagtcaagtcacttcagttggtggatgacagctctgcttgtctgcttccttcttataatggcaacttatatctttgtgaaatttggagccccctttgcctttgagaaggttctttttccaatcatgaaatgggaagcaagtgcctttggtcgtccagtattggctcttgtcctcgtcgcgtctttggctatcttcccactcattttagtcccctctggaccttctatgtggttagcaggaatgatcttcggttatggctggggtttcgtgattattattgttgggactactcttggcatggttggagcatattggatcggctcattgttccgcgagcgactacatgcatggttaaagagatggcctcagcagatagctctaataaagcttgctggcgaagggagttggttccaccagtttcgagtggttgcgctattcagagtctcaccgtttccatactcgatttttaactatgccgtggccgtgacagaaatcaaattcagcccttatgtatgtggttcagttgccggaatgacacctgaggcattcatctatatctacagcgggcggttgatacgtacgctggccgatgtgaagtatggcaagcataagttgactactgtggagataatctacagcataatctcgttcatcgctgccgctgccctcacggtcgccttcacagtttacgccaagaagtcgctgaacaacataaaaggcccagatgatatctcagaggaccaccaacctgctgctggctctgctggggtgactgcactaaaaaatggccatcaggacgtgcatatcctgtagctttgtttacatgtcgtatgatgtctgtattcattcaattcatcagagaaaataggtagctaggctctgacagcaggtggatgcacctgtcttctaactagataaatatgtatggttttactgcttgattagtttcatgtggttgatcacccaacatgtattttggccttgttgttggctactggaaatttggccttctcttgaggtgcacatattttttgtcaaaaaaaaaaaaaaaa

SEQ ID NO: 8266 - protein, 341 aa, triticum aestivum
MARVLPLDIEPGEAPRAGETVASTPSSSAVVSCNRIEHSEQNIKDDEYTMLMTPTQHATADNNTEILPQQPKSSHFSWWMTALLVCFLLIMATYIFVKFGAPFAFEKVLFPIMKWEASAFGRPVLALVLVASLAIFPLILVPSGPSMWLAGMIFGYGWGFVIIIVGTTLGMVGAYWIGSLFRERLHAWLKRWPQQIALIKLAGEGSWFHQFRVVALFRVSPFPYSIFNYAVAVTEIKFSPYVCGSVAGMTPEAFIYIYSGRLIRTLADVKYGKHKLTTVEIIYSIISFIAAAALTVAFTVYAKKSLNNIKGPDDISEDHQPAAGSAGVTALKNGHQDVHIL

SEQ ID NO: 8267 - DNA, 1291 bp, Oryza sativa
  CDS (125)..(1291)
gcacgaggctctcctccccccctccgctgctgcaaagcttccagaaagaaaggggaggagggaggaggtggaaaagccaaaggcaaaggcaaaccacgcgtctctctttggtattcgtctctccatggcacgcgtcctccccctcagcatcgaggcgggggagatggccatgcccagacgtgaagaggtagttacagacatgccaagctcttccgcagtggcatcaggcaacggaatcgaacaacctgagcaaaacacaaaggatgatgaatatgaaaggctggtcagaccagctcatagtgtaatagctgatgataacacggtagtcctacctgaagaacctacctcaaggtccatttggtggatgaaagttctgcttggctgcttccttcttatattagtatcttatgtcttcgtgaaatggggagtcccctttgccttcgagaaggttctcttgccaatcatgcaatgggaagcaagtgcctttgggcgtccagttttggctgttgttctcgttgcatctttagccctcttcccagttactttagtcccttctggaccttccatgtggctagctggaatgatctttggctatggttggggtttcttgattattatggttgggactactataggcatggtggttccatattggattggctcattgttccgcgaacgtctgcatgcatggttaaaaagatggcctcagcagatagctctaataaaacttgctggggaaggaaattggttccagcagtttagagttgttgcactattcagaatctcgccatttccatatacaatttttaactacgctgtaactgtgacagaaatcaagttcaacccttatctatgtggttcaattgctgggatgatacccgaggcgttcatctatatttatagcgggcggttgatacgcacattggctgacatgaagtatggcaactacaagatgacaccggtggagataacatacaacgccatctcgttcgtcatcgctgttgtcctcacggtcgccttcacggtgtacgccaagagagctctgaatgacataaaagagtcggaaggttgggcggctcatgtaggcctcccgtttgcatctgggccgcattggctgtcgcagggcgaacagttagacagtagagtgctctctgctcgtttagtcccacctcgcctaaccaagtcggaggccttagggagctctgctatatataggggtctggtgccaacgcttgaactcacgcagctgcgcggtgagcacagagcgaactattctttcgccttttactaa

SEQ ID NO: 8268 - protein, 388 aa, Oryza sativa
MARVLPLSIEAGEMAMPRREEVVTDMPSSSAVASGNGIEQPEQNTKDDEYERLVRPAHSVIADDNTVVLPEEPTSRSIWWMKVLLGCFLLILVSYVFVKWGVPFAFEKVLLPIMQWEASAFGRPVLAVVLVASLALFPVTLVPSGPSMWLAGMIFGYGWGFLIIMVGTTIGMVVPYWIGSLFRERLHAWLKRWPQQIALIKLAGEGNWFQQFRVVALFRISPFPYTIFNYAVTVTEIKFNPYLCGSIAGMIPEAFIYIYSGRLIRTLADMKYGNYKMTPVEITYNAISFVIAVVLTVAFTVYAKRALNDIKESEGWAAHVGLPFASGPHWLSQGEQLDSRVLSARLVPPRLTKSEALGSSAIYRGLVPTLELTQLRGEHRANYSFAFY

SEQ ID NO: 8269 - DNA, 963 bp, Arabidopsis thaliana
  CDS (1)..(963)
atgtcaaacccattgaaagagtcaagagaggatattgcaaattctactcctcacatgagggataatgagtatgttcggctagttgtggctcatgaagcctccccagctgaaaccgtgttgtctctatcgcaatcagaggtgcagagtaagaaatttatgtggtggttaaaagctttgggaatatgtgcagttgctctcttgcttacgcttgttttcggaaaatggggagttccgtttgtgtttcaaaaggttcttattccaattttgcaatgggaagcaactgcgtttggccgtcctatgctcgcgattgtccttgttgtttccttggctttgtttcctgtgttcttgataccttctggtccttccatgtggttagctgggatgatttttggttatggtctcggttttgttattatcatggttggaaccaccattggcatggttctcccttacttaatcgggcttatgttccgtgatcgcctccatcaatggttaaaaagatggcctcgtcaagctgctgttctaagactagctgcagaaggaagctggttccatcaattcagagtcgtggcaatctttcgggtttccccatttccttacacgatttttaactacgcaatcgtcgtgacaagcatgagattctggccttacttcttcggatccatagcaggaatgataccagaagctttcatctacatttacagcggtcggttaatcagaacattcgcagatgtgcaatacggacatcaacgtttgacaacagtggagattgtgtacaatgtaatctccttagtcattgcggttgtgaccactgttgctttcactgtgtacgcgaaaagagctttgagagagcttcaaaacgcagaagctaatgaagatgaagaagttcaagtaagaaaagtgagattcgagatgaagaacgtagttcagcacgaagaagataatcatcagcgtttgccttag

SEQ ID NO: 8270 - protein, 320 aa, Arabidopsis thaliana
MSNPLKESREDIANSTPHMRDNEYVRLVVAHEASPAETVLSLSQSEVQSKKFMWWLKALGICAVALLLTLVFGKWGVPFVFQKVLIPILQWEATAFGRPMLAIVLVVSLALFPVFLIPSGPSMWLAGMIFGYGLGFVIIMVGTTIGMVLPYLIGLMFRDRLHQWLKRWPRQAAVLRLAAEGSWFHQFRVVAIFRVSPFPYTIFNYAIVVTSMRFWPYFFGSIAGMIPEAFIYIYSGRLIRTFADVQYGHQRLTTVEIVYNVISLVIAVVTTVAFTVYAKRALRELQNAEANEDEEVQVRKVRFEMKNVVQHEEDNHQRLP

SEQ ID NO: 8271 - DNA, 828 bp, Zea mays
  CDS (1)..(828)
atgccaaggtcatcagccggggcgtcatgcacagcagatgaccattctgagcagagcagaaaggatgatgaatatgagaggctggttacaagagctcaacatgcaacatctgatgttggcacgacaattttatctgagcaaccaaagtcaagatctttcatttggtggatgaaagttctgcttggctgtttccttcttatattagtgggctatgtcttcgtgaaatggggggtcccctttgtctttgagaaggttctcttgccaatcatgcaatgggaagccagtgcttttgggcgtccagtattagctattgttctcgttgcatctttggctctctttccagttattctagttccttctggaccttctatgtggttagcaggaatgatctttggatatggttggggtttcttgattataatggccgggagtactattggcatggtggttccatattggattggttcattgttccgtgaacgtctgcatgtatggctgacaaagtggcctcagcagatagcactaataaaactcgcgggtgaaggaaattggttccagcagtttcgggttgtcgcgcttttcagaatctcaccattcccatatacaatttttaattatgccgtgactgtgacagaaattaagttcaacccttatctatgtggttctgttgctggaatggtacctgaggccttcatttatatctacagtgggcgtctaatacgtacattggctgacatgaagtacggcaactataaaatgacaccagtggaaatagcatacaacgccatttccttcgtcatcgctatcgccctcacggtcgccttctga

SEQ ID NO: 8272 - protein, 275 aa, Zea mays
MPRSSAGASCTADDHSEQSRKDDEYERLVTRAQHATSDVGTTILSEQPKSRSFIWWMKVLLGCFLLILVGYVFVKWGVPFVFEKVLLPIMQWEASAFGRPVLAIVLVASLALFPVILVPSGPSMWLAGMIFGYGWGFLIIMAGSTIGMVVPYWIGSLFRERLHVWLTKWPQQIALIKLAGEGNWFQQFRVVALFRISPFPYTIFNYAVTVTEIKFNPYLCGSVAGMVPEAFIYIYSGRLIRTLADMKYGNYKMTPVEIAYNAISFVIAIALTVAF

SEQ ID NO: 8273 - DNA, 972 bp, Candida glabrata CBS 138
  CDS (1)..(972)
atgcctacagacaatgctgatttagggcaagaagacatcgatgtctttgacaatggtcgggaatctttcgatagattgaacaaacctgtgctggatggaatcggaattgaaggcaatgatgacgatgatgatgattacctaacattatacaatatgactccaagagaacgtttgatgtatacatttaggagatcgatgtacaaagctttagaccattttaatagtttaccaaaatggcagcggttgcttattattttatttggagcattagtaatagtactaggtattctgatgctcatattccataataagatccttgacaaagtcctagagacctctaaagatttaaatgagcggtcctcaacgaacttcattctactggttctcctgttctttgttggcttcccacctatgattggatattcgtttttatctacttccacaggactaatctatggcgtatcattccatggttggtttgtgttagctcttggatcagtaactggttcagtggcatcattctatgttttcaagaatctcctccattccagagccgagaaattagttcacatgaataaaagatttgaagcttttgcgtccattctacaagaagataacagttatctaatgcttgcactattaaggctatgcccattcccttactcgttaactaacggtgctattgctgggatatacggcatttcagtcaaaaacttcacaatcgcaaacattataacaacaccaaaactattaatatacttatttattggtgcacgtattaaaaatatggctgaagatcactccaccagttcaagaatatttgatctagtgagtatattaataactctaattattttcacattgacagcttggcttctatatttcaagaccaagcaaaggtacgctcagttaaaaaatcaagcagttgcacagaactcatcagctaatagagaagttgattttgagatataa

SEQ ID NO: 8274 - protein, 323 aa, Candida glabrata CBS 138
MPTDNADLGQEDIDVFDNGRESFDRLNKPVLDGIGIEGNDDDDDDYLTLYNMTPRERLMYTFRRSMYKALDHFNSLPKWQRLLIILFGALVIVLGILMLIFHNKILDKVLETSKDLNERSSTNFILLVLLFFVGFPPMIGYSFLSTSTGLIYGVSFHGWFVLALGSVTGSVASFYVFKNLLHSRAEKLVHMNKRFEAFASILQEDNSYLMLALLRLCPFPYSLTNGAIAGIYGISVKNFTIANIITTPKLLIYLFIGARIKNMAEDHSTSSRIFDLVSILITLIIFTLTAWLLYFKTKQRYAQLKNQAVAQNSSANREVDFEI

SEQ ID NO: 8275 - DNA, 918 bp, Kluyveromyces lactis NRRL Y-1140
  CDS (1)..(918)
atggctgatctttacgaggctagagttagttctggcggtttgtcgaggccttcagacacggattttttggatagtaacgacaactttgatgatttggacgatgacttccttgacatatacaacttgagctggaggcaacgtattgttcaacatgggaaacggcatttaagaaatggcaaggataagtttaatgcgttgagcagacgaaagaaggctcttgtggtgtttttaggggtccttgaaatcatattaatctttatcacagtagttaaaagggaagcgataatgaaagggttggtggatgcctctaatgatctgagacagaaatggtacacacctctagttctaatgctacttatattagcggtttcgttcccgccattgatcggatactcatttttatctctctctacaggtttgatctatgggctttccttcaagggttggttcattcttgccatgtccactgtgattggatcagttctctcattcacagtattccagagattgttgcattcccatgctgagagattgatcagaatgaatcccaaattagaagctgtatcatcggtattacaaggtaatgacagctattggatgattgctcttattagactttgtccgttcccatattctttcattaacggtgcgatagctggtatttatggaatctcaatcaagaactttgccattgctaacatcatcaccacaccaaaagcggttatttatctcttcgttggtgaaaggctcaaaaacatgggagaaacagactcgggttctacaaggttaatcaatttcatctctattctattggctaatggatttttaatattaacaacgtggttcctctattacagattcaaaaagagatacttagaactacaatctgaacagcaaaactcttttgacatcttttag

SEQ ID NO: 8276 - protein, 305 aa, Kluyveromyces lactis NRRL Y-1140
MADLYEARVSSGGLSRPSDTDFLDSNDNFDDLDDDFLDIYNLSWRQRIVQHGKRHLRNGKDKFNALSRRKKALVVFLGVLEIILIFITVVKREAIMKGLVDASNDLRQKWYTPLVLMLLILAVSFPPLIGYSFLSLSTGLIYGLSFKGWFILAMSTVIGSVLSFTVFQRLLHSHAERLIRMNPKLEAVSSVLQGNDSYWMIALIRLCPFPYSFINGAIAGIYGISIKNFAIANIITTPKAVIYLFVGERLKNMGETDSGSTRLINFISILLANGFLILTTWFLYYRFKKRYLELQSEQQNSFDIF

SEQ ID NO: 8277 - DNA, 1152 bp, Debaryomyces hansenii CBS767
  CDS (1)..(1152)
atgcctcggttgccttcttcttctgatccgttccaaggccataatgagcttcctcagagcaacaattttatgtctagaaccaacagcattatccaggataagctctttctcgtgaggaatgtaggacaacagacgttagattggtaccaaagccagccgttgtggaagcgtacattgcttcaggtgctttttgttttcaatgctattgtcgtggttttgattatgatattccataaatcgataatacaagcaatcgtggtcatatctgataagtggcacggattgaaatttggccaaggtttactatttacattggtatttatggttgggttcccgccattgcttggcttttcagccttatcgatgttggcgggtatggtttatgggtttgtacatggatggatcttattggcgtgtgcatcgatttcgggctccttttgttcgttccttgtcttcagatatttgcttcatagcagggcagaaagactcatgaattcaaacaaaaaattcagggctttctcagagattttgcgagaggattcaagtcttttcatcttggtattgttgagactttgtccattaccttattcattgtcgaatggtgcattggctgctattccggaattaccagcaacaacatactttttagcgtcattgataacttctcccaaattgatgatccatatatttgtcggacataaattaaaagagttgggggatgacactaagggtaagtctacccatttaattgatatacttagtatcataataacgggtgctgcggcatcattaacaacatacataatttacaacaaaatgcaaagaaaactagaattttaccatcaaagaggtataattcctcgtgatgatgcaattatatttggtaatttcgaagatattgagtctgcaaataatgtggaattaaattctgctgattacgatgaggataatttcattattgaagacgaagatgacgaaaatgctacagatccagattatgtagcaagtaagaagaatattcaggttcatgctgaagatcagaacaagaatggtgaatttgagatagatgaaaatgatggtgtagatgacttgggattaggagaaatatccaagaattccaaacaaaatacaaacggttatagagattattag

SEQ ID NO: 8278 - protein, 383 aa, Debaryomyces hansenii CBS767
MPRLPSSSDPFQGHNELPQSNNFMSRTNSIIQDKLFLVRNVGQQTLDWYQSQPLWKRTLLQVLFVFNAIVVVLIMIFHKSIIQAIVVISDKWHGLKFGQGLLFTLVFMVGFPPLLGFSALSMLAGMVYGFVHGWILLACASISGSFCSFLVFRYLLHSRAERLMNSNKKFRAFSEILREDSSLFILVLLRLCPLPYSLSNGALAAIPELPATTYFLASLITSPKLMIHIFVGHKLKELGDDTKGKSTHLIDILSIIITGAAASLTTYIIYNKMQRKLEFYHQRGIIPRDDAIIFGNFEDIESANNVELNSADYDEDNFIIEDEDDENATDPDYVASKKNIQVHAEDQNKNGEFEIDENDGVDDLGLGEISKNSKQNTNGYRDY

SEQ ID NO: 8279 - DNA, 1053 bp, Candida albicans SC5314
  CDS (1)..(1053): transl_table=12
atgccacaactcccgacatcttctgatcgtgagtatcggtacaattataatcaagactcatccttttctaccttaagaaatgtcttaactaccaaacttgccgcagtatcagacattatccaacaagctcgaacatggtacttggaacaatcaaccattaagcaaatactattgggtggtgctcttgttgtgattggtgtcatatcggtgttgatggttatttttcatatacatattattcgattcctcatatatttgtctgacgaatggcataatttgaaatatgggtcattgataatatttgccttagtatttatggttgggttccccccattgattgggttttctgcattgtcgtttttaacagggatgatatatgggtgcccacaaggttggccattgatagcaagtgcctccgttttgggttcaacttgttcatttatagtataccgttatgttctccataatcaagctgttaaattgatgaatcacaacgacacattcagagcatttgcagaaattttaggagaaggcaattcgttatttctattaattttgatcagattgtgccctttaccttactcgttatcaaatggtgcattggctgctattccagaattaccattactcacctattttttggctacattgattacatcgcccaaaattttgattcatttgtttgttggtagtaaattgaaacaaattggtgacgacaaatcaagtggaggaacaaaaattgtggatattatcagtatcgtgattactggaactgctgcaactttagctgcctatttgatttatgccaaaatgcaacaaaagttggcaagctatcattcaagaggtatagcagccgatgatattatggtatttggaaattttgaagatgacttggaattggggagtaatgaaatcgaattaaactcggctgattttgatgctgataattttataattgaagatgatgataatgaagatgatccaaggcaacagggaaatactaataatgccaaaaaagatattggtgtactgacatctgaagaaatactttag

SEQ ID NO: 8280 - protein, 350 aa, Candida albicans SC5314
MPQLPTSSDREYRYNYNQDSSFSTLRNVLTTKLAAVSDIIQQARTWYLEQSTIKQILLGGALVVIGVISVLMVIFHIHIIRFLIYLSDEWHNLKYGSLIIFALVFMVGFPPLIGFSALSFLTGMIYGCPQGWPLIASASVLGSTCSFIVYRYVLHNQAVKLMNHNDTFRAFAEILGEGNSLFLLILIRLCPLPYSLSNGALAAIPELPLLTYFLATLITSPKILIHLFVGSKLKQIGDDKSSGGTKIVDIISIVITGTAATLAAYLIYAKMQQKLASYHSRGIAADDIMVFGNFEDDLELGSNEIELNSADFDADNFIIEDDDNEDDPRQQGNTNNAKKDIGVSTSEEIL

SEQ ID NO: 8281 - DNA, 24 bp, Artificial sequence
  primer
atgagtcagtcttacgaagcagga

SEQ ID NO: 8282 - DNA, 25 bp, Artificial sequence
  primer
ttagacctcaaaagacaattcaggt

SEQ ID NO: 8283 - protein, 186 aa, Artificial sequence
  consensus sequence
  Variant (2)..(28): Xaa in position 2 to 28 is any amino acid
  Variant (30)..(46): Xaa in position 30 to 46 is any amino acid
  Variant (47)..(48): Xaa in position 47 to 48 is any or no amino acid
  Variant (50)..(50): Xaa in position 50 is any amino acid
  Variant (52)..(52): Xaa in position 52 is any amino acid
  Variant (54)..(67): Xaa in position 54 to 67 is any amino acid
  Variant (68)..(68): Xaa in position 68 is any or no amino acid
  Variant (70)..(95): Xaa in position 70 to 95 is any amino acid
  Variant (96)..(96): Xaa in position 96 is any or no amino acid
  Variant (98)..(103): Xaa in position 98 to 103 is any amino acid
  Variant (105)..(112): Xaa in position 105 to 112 is any amino acid
  Variant (113)..(115): Xaa in position 113 to 115 is any or no amino acid
  Variant (117)..(117): Xaa in position 117 is any amino acid
  Variant (119)..(120): Xaa in position 119 to 120 is any amino acid
  Variant (122)..(122): Xaa in position 122 is any amino acid
  Variant (125)..(127): Xaa in position 125 to 127 is any amino acid
  Variant (129)..(129): Xaa in position 129 is any amino acid
  Variant (131)..(150): Xaa in position 131 to 150 is any amino acid
  Variant (152)..(154): Xaa in position 152 to 154 is any amino acid
  Variant (156)..(159): Xaa in position 156 to 159 is any amino acid
  Variant (161)..(183): Xaa in position 161 to 183 is any amino acid
  Variant (184)..(185): Xaa in position 184 to 185 is any or no amino acid
FXXXXXXXXXXXXXXXXXXXXXXXXXXXLXXXXXXXXXXXXXXXXXXXGXIXGXXXXXXXXXXXXXXXGXXXXXXXXXXXXXXXXXXXXXXXXXXXAXXXXXXEXXXXXXXXXXXLXRXXPXPYXXXNXAXXXXXXXXXXXXXXXXXXXXPXXXIXXXXGXXXXXXXXXXXXXXXXXXXXXXXXXI

SEQ ID NO: 8284 - protein, 17 aa, Artificial sequence
  protein pattern
  Variant (2)..(2): Xaa in position 2 is any amino acid
  Variant (4)..(4): Xaa in position 4 is Ile, Leu or Val
  Variant (5)..(5): Xaa in position 5 is Cys or Ser
  Variant (7)..(7): Xaa in position 7 is Phe or Leu
  Variant (10)..(10): Xaa in position 10 is Ser or Thr
  Variant (11)..(11): Xaa in position 11 is Phe, Ile or Leu
  Variant (12)..(12): Xaa in position 12 is any amino acid
  Variant (14)..(14): Xaa in position 14 is any amino acid
  Variant (16)..(16): Xaa in position 16 is Ile, Leu or Val
  Variant (17)..(17): Xaa in position 17 is Ala or Thr
LXRXXPXPYXXXNXAXX

SEQ ID NO: 8285 - protein, 22 aa, Artificial sequence
  protein pattern
  Variant (2)..(2): Xaa in position 2 is Glu or Lys
  Variant (3)..(3): Xaa in position 3 is Ala, Ile or Leu
  Variant (4)..(4): Xaa in position 4 is Phe, Leu, Met or Val
  Variant (6)..(6): Xaa in position 6 is His or Tyr
  Variant (7)..(7): Xaa in position 7 is Ile or Leu
  Variant (8)..(8): Xaa in position 8 is Phe or Tyr
  Variant (9)..(9): Xaa in position 9 is any amino acid
  Variant (11)..(11): Xaa in position 11 is any amino acid
  Variant (12)..(15): Xaa in position 12 to 15 is any or no amino acid
  Variant (17)..(17): Xaa in position 17 is any amino acid
  Variant (18)..(18): Xaa in position 18 is Asp, Glu, Asn, Gln or Arg
  Variant (19)..(20): Xaa in position 19 to 20 is any amino acid
  Variant (21)..(21): Xaa in position 21 is Ala, Asp, Glu or Ser
  Variant (22)..(22): Xaa in position 22 is Asp or Thr
PXXXIXXXXGXXXXXLXXXXXX

SEQ ID NO: 8286 - protein, 17 aa, Artificial sequence
  protein pattern
  Variant (2)..(2): Xaa in position 2 is any amino acid
  Variant (4)..(4): Xaa in position 4 is any amino acid
  Variant (5)..(5): Xaa in position 5 is any or no amino acid
  Variant (7)..(7): Xaa in position 7 is any amino acid
  Variant (8)..(10): Xaa in position 8 to 10 is any or no amino acid
  Variant (12)..(12): Xaa in position 12 is Leu or Met
  Variant (14)..(14): Xaa in position 14 is Phe or Tyr
  Variant (16)..(16): Xaa in position 16 is any amino acid
  Variant (17)..(17): Xaa in position 17 is Gly, Pro or Ser
GXSXXLXXXXGXIXGXX

SEQ ID NO: 8287 - DNA, 1806 bp, Saccharomyces cerevisiae
  CDS (1)..(1806)
atgctcaaccatcccagccaaggctcagatgatgctcaggacgaaaagcaaggcgacttcccggtcatcgaagaggagaagacccaggctgtaacgctgaaggattcgtatgttagcgacgacgtcgccaactccacggaacgctacaacttgtccccttctccggaggacgaagacttcgaaggccccactgaagaagaaatgcagactttaaggcacgttggtggtaaaattcctatgaggtgttggttaattgctattgtagagctttccgagagattctcctactacgggctttccgcaccattccaaaactacatggaatatggacctaatgactccccaaagggtgttctgagcttgaacagtcagggtgccactgggttgtcgtattttttccagttttggtgttacgttacaccagttttcggtggttacgttgcggacaccttctggggtaaatataatacaatttgttgcggtaccgctatttacattgccggtattttcattctatttatcacttcgattccctccgttggtaacagagacagtgctattggtgggttcattgctgccattattctgatcggtattgccactggtatgattaaagctaacctttccgtgttgattgccgaccagcttcctaagcggaaaccctccatcaaagttttaaaatcgggcgaaagagtcattgtcgattcaaatattactttacaaaacgtttttatgttcttctatttcatgatcaatgtcggttctctatcattaatggccactactgaattggaatatcataaggggttctgggcggcctatctattgcccttctgcttcttttggatcgctgttgtcactttgatttttggtaaaaagcaatacattcaaagaccaatcggagataaagtcatcgctaaaagttttaaagtttgttggattttaactaagaataagttcgacttcaacgctgctaaaccttctgttcatccagaaaagaactatccatggaatgacaaatttgttgatgaaattaagagagctttggcggcttgtaaagtctttatattctacccaatttattggacccaatacggtaccatgatttccagtttcatcactcaggccagtatgatggaattacatggaattcccaacgatttcttacaagcattcgattccattgcgttgatcattttcatcccaatttttgaaaaattcgtatatcctttcattagaagatacactccactaaaaccaattacaaaaattttcttcggtttcatgtttggatcttttgccatgacatgggctgctgttctacaaagtttcgtttacaaggctggtccatggtataatgaacctctgggtcacaacaccccaaatcatgtccacgtttgctggcaaatacccgcatatgtcttgatttctttttcagagatctttgcctctatcactgggttggaatacgcttattccaaagccccagcttccatgaaatcgtttattatgtccattttcttattgactaacgcctttggttctgcaatcggttgtgcattgtccccagtgaccgttgatcctaaatttacatggttattcactggtttggctgttgcctgctttatttctggttgtttgttctggttgtgcttcaggaagtataatgatacagaggaagaaatgaacgctatggactacgaagaagaagacgaatttgatctcaatccaatttccgcacctaaagctaacgatattgaaatattagaaccaatggaaagtctaagatccaccaccaaatattag

SEQ ID NO: 8288 - protein, 601 aa, Saccharomyces cerevisiae
MLNHPSQGSDDAQDEKQGDFPVIEEEKTQAVTLKDSYVSDDVANSTERYNLSPSPEDEDFEGPTEEEMQTLRHVGGKIPMRCWLIAIVELSERFSYYGLSAPFQNYMEYGPNDSPKGVLSLNSQGATGLSYFFQFWCYVTPVFGGYVADTFWGKYNTICCGTAIYIAGIFILFITSIPSVGNRDSAIGGFIAAIILIGIATGMIKANLSVLIADQLPKRKPSIKVLKSGERVIVDSNITLQNVFMFFYFMINVGSLSLMATTELEYHKGFWAAYLLPFCFFWIAVVTLIFGKKQYIQRPIGDKVIAKSFKVCWILTKNKFDFNAAKPSVHPEKNYPWNDKFVDEIKRALAACKVFIFYPIYWTQYGTMISSFITQASMMELHGIPNDFLQAFDSIALIIFIPIFEKFVYPFIRRYTPLKPITKIFFGFMFGSFAMTWAAVLQSFVYKAGPWYNEPLGHNTPNHVHVCWQIPAYVLISFSEIFASITGLEYAYSKAPASMKSFIMSIFLLTNAFGSAIGCALSPVTVDPKFTWLFTGLAVACFISGCLFWLCFRKYNDTEEEMNAMDYEEEDEFDLNPISAPKANDIEILEPMESLRSTTKY

SEQ ID NO: 8289 - DNA, 1776 bp, Oryza sativa (japonica cultivar-group)
  CDS (1)..(1776)
atggaagaggcagcagaagataggcgattgcaggtgcgagaagagggtggtgatcaagaaccgctccttcttcttcctcaggatgctaatctttacaccggagatggatctgttgatatcaaagggcgccctgcattaaagcatgccactggaaattggcgtgcatgttttttcatcctaggggatgaatgctgtgagagactggcctattatggtattgcaaagaacctagttacttatctgaaaacaaatcttcatcaaggcaaccttgaagctgcaagaaatgttacaacttggcaggggacatgctacctaacacccctcattggtgccctcctagcagattcttactggggaaagtactggactattgctgctttctcagcaatttattttattggtctggttgctttgacgctgtcagcatcagttccagctctgcagccgcctaaatgttcaggatctatttgtccagaagcaagcttactccagtatggtgtatttttctctggcctctatatgatagccctcgggactggaggcatcaaaccttgtgtatcatcctttggagctgatcaatttgatgacagtgatccagcagacagagtaaagaagggctccttcttcaattggttttacttctgtataaatatcggtgcatttgtatcaggcaccgttatagtttggatacaagataactcaggttgggggataggatttgccattcctactatatttatggcattagcgattgcaagtttctttgttgcctcaaatatgtacagatttcagaaacctggtggaagccctcttacaagagtgtgtcaggttgttgttgcagcattccgtaagtggcacactgaagtgccacatgatacatctcttttatatgaggttgatggccagacttcagcgattgagggaagccggaagctggagcacacaagtgaacttgaattctttgacaaggctgccatcatctcatctgatgatgccaagagtgactcctttacaaatccgtggaggctatgcactgtcacccaggtggaagaactgaaaattctaatcagaatgtttcccatttgggccactactattatattcaacgcggtgtatgctcacaactcttctatgttcatagagcagggaatggttcttgacaagcgagttggatctttcattgtccctcctgcatccctctcaacttttgatgtcatcagtgtcatcatctggattccgttttatggccgtgtgcttgtgccaatagctagaaagttcactggaagggagaagggtttctctgagttacagcggattggaatcggattagccctctccatccttgcaatgctatctgcagctcttgttgagttgaggcgtttagggatcgccagatctgaaggtcttattcatgaggatgttgctgttccgatgagcattctttggcaaataccgcagtatttcttggttggcgctgctgaggtctttgctgccataggtcaggttgagttcttctacaatgaagcccctgatgccatgaggagtttgtgtagtgcatttgcgcttgtaacagtctcactggggagctatttaagctcaatcatattaaccttggtgtcatattttacaactcaaggaggggatcctggatggatcccagataacctgaatgaaggccacctagatcggttcttttcattgattgctgggatcaactttgtgaatttactggttttcactggttgtgcaatgagatacagatacaagaaagcatga

SEQ ID NO: 8290 - protein, 591 aa, Oryza sativa (japonica cultivar-group)
MEEAAEDRRLQVREEGGDQEPLLLLPQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAHNSSMFIEQGMVLDKRVGSFIVPPASLSTFDVISVIIWIPFYGRVLVPIARKFTGREKGFSELQRIGIGLALSILAMLSAALVELRRLGIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 8291 - DNA, 1782 bp, Oryza sativa (japonica cultivar-group)
  CDS (1)..(1782)
atggccgaggtgacggtggtccgtgcggagcgcgaggaggagtccaccctggagcagggtctcctcgccatcccggaggaatccaaccaacttacatacactggagatggatctgtcgacttttctgggaatcctgttgtgaaggagagaactggtagatggagggcatgcccatttatcttaggtaatgagtgctgtgagcggttggcctattatggaatctccacaaaccttgttacatacttgacaaagaaactgcatgatggtaatgcttctgctgctagcaatgtgactgcatggcagggaacttgctacttaactccccttattggagctatactggctgatgcatactggggaaggtattggactattgcaacattctccacgatatacttcattgggatggctgtactgactctttcagcatcagttcctacattcatgcctccaccttgcgaagggtccttttgcccaccagcaaatccattgcagtatactgtcttttttcttggactttacctaattgctcttggtactggtggtattaagccctgtgtctcatcctttggagcagatcaatttgatgatacagacccagttgagcgaatccagaagggatctttctttaactggttctatttctcaataaacattggtgctctcatatcaagcagttttctggtttgggtgcaagacaatataggatggggaataggctttggcattccaacaattttcatggggctggccatcataagtttcttctctggaacatcactttatagattccaaaagccaggcggcagtcctattacacgagtatgccaggtggttgttgcctcctttcgcaagtggaacgtacatgttccagaggatagctctcgcttgtatgagttgcctgatggggcttcagcaattgaagggagtcggcaattggagcacaccgatgaactcagatgtctggacaaagctgctacaattactgatcttgatgtgaaagcagatagctttacaaacccatggcgaatatgcactgtgactcaggtggaagaactgaagatattggtaaggatgttccctgtctgggcaacgactattgtgttttctgctgtctatgctcagatgtccaccatgtttgttgagcaagggatgatgcttgatacatcagtaggtccattcaagattcctccagcatctctatctacctttgatgtggtaagtgtcattatatgggtccccctctatgatagtatcttggttccaatagctaggaggttcactggcaacccgaggggctttacagagttacagaggatggggattggtttggtaatctcaatcttttcgatggcggcagctgcagttcttgagattaaaaggttggacattgcaagggctgaacatttggtggatcaaaatgttccagtaccactgaacatctgctggcaaattcctcaatatttcttggttggtgcctcagaggtcttcacatttgtcgggtcacttgagttcttctatgatcaatcaccggatgccatgaggagcctctgcagcgcactgcagcttgtcacaacagctcttgggaattatctcagtgcattcattttgacattggttgcgtacttcacaacaagaggaggaaatcctggatggattcctgataacttgaatcaaggtcacctagattatttcttctggcttcttgctgggctcagttttctgaactttgtgatatatgtcatctgcgcaaacaaatacaaaagcaagaaagcagcttga

SEQ ID NO: 8292 - protein, 593 aa, Oryza sativa (japonica cultivar-group)
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 8293 - DNA, 1791 bp, Oryza sativa (japonica cultivar-group)
  CDS (1)..(1791)
atggcgatggtgttgccggagacggcggcggaggggaaggcgctgacggacgcgtgggactacaaggggaggccggcggggagggcggccaccggcgggtggggctgcgcggcgatgatcctcggggcggagctgttcgagcggatgacgacgctgggcatcgccgtcaacctggtgccgtacatgaccgggacgatgcacctcggcaatgccgccgccgccaacacggtcaccaacttcatcggcacctccttcatgctctgcctcctcggcggcttcgtcgccgacacctacctcggccgctacctcaccatcgccatcttcgaggccgtccaggccaccggcgtgatgatactcacgatctccacggcggcgccggggctgcggccgccggcgtgcggcgacccgaagggggcgagcgcggagtgcgtggcggcggacgggacgcagctcggggtgctctacctggggctctacctgacggcgctgggcacgggggggctcaagtccagcgtctccggcttcggctccgaccagttcgacgagtccgacgtcgacggcgagaggaagaagatgatgcgcttcttcaactggttctacttcttcgtcagcctcggcgcgctgctcgccgtcaccgtgctggtgtacgtgcaggacaacgtcggacgccggtgggggtacggcatctgcgccgccggcatcctcgccggcctcgccgtgttcctctccgggaccaggaggtacaggttcaagaagctggtggggagccccctcacccaggtcgccgccgtcaccgccgccgcctggagcaagaggtcgctgccgctgccgtccgacccagacatgctctacgacgtcgacgacgccgccgccgccggccatgacgtcaagggcaagcagaggatgccacacagcaaggagtgccggttcctggaccatgcggcgatcatcgacaggtcggcggcggagtcgccggcgacggcgagcaagtggaggctgtgcacgaggacggacgtggaggaggtgaagcaggtggtgcggatgctccccatctgggcgaccaccatcatgttctggaccatccacgcccagatgaccaccttcgccgtcgcgcaggccgagctcatggaccgccgcctcgccggcggcttcctcatcccggcgggctccctcaccgtcttcctcatcgcctccatcctcctcaccgtccccttctacgaccgcctcgtcgtccccgtcgcgcgccgcgccacggccaacccgcacggcctcaccccgctccagcgcgtcttcgtgggcctctccctctccatcgccggcatggccgtcgccgcggccgtcgagcgccaccgcgccaccgcctccgcctccgccgccgccgccgcgcccacggtgttcctcctcatgccgcagttcctcctcgtcggcgccggcgaggcgttcacctacatgggccagctcgacttcttcctccgcgagtgccccaaggggatgaagaccatgagcacgggcctcttcctcagcacctgcgccatcggcttcttcttcagcacgctgctcgtcaccatcgtccacaaggtcaccggccatggcgcccgcggcggcggctggctcgccgacaacctcgacgacggcaggctcgactacttctactggctgctcgccgtcatcagcgccatcaacctcgtcctcttcaccgtcgccgccagggggtacgtctacaaggagaagcgcctcgccgacgccggcatcgagctcgccgacgaggagaccatcgccgtcggccactaa

SEQ ID NO: 8294 - protein, 596 aa, Oryza sativa (japonica cultivar-group)
MAMVLPETAAEGKALTDAWDYKGRPAGRAATGGWGCAAMILGAELFERMTTLGIAVNLVPYMTGTMHLGNAAAANTVTNFIGTSFMLCLLGGFVADTYLGRYLTIAIFEAVQATGVMILTISTAAPGLRPPACGDPKGASAECVAADGTQLGVLYLGLYLTALGTGGLKSSVSGFGSDQFDESDVDGERKKMMRFFNWFYFFVSLGALLAVTVLVYVQDNVGRRWGYGICAAGILAGLAVFLSGTRRYRFKKLVGSPLTQVAAVTAAAWSKRSLPLPSDPDMLYDVDDAAAAGHDVKGKQRMPHSKECRFLDHAAIIDRSAAESPATASKWRLCTRTDVEEVKQVVRMLPIWATTIMFWTIHAQMTTFAVAQAELMDRRLAGGFLIPAGSLTVFLIASILLTVPFYDRLVVPVARRATANPHGLTPLQRVFVGLSLSIAGMAVAAAVERHRATASASAAAAAPTVFLLMPQFLLVGAGEAFTYMGQLDFFLRECPKGMKTMSTGLFLSTCAIGFFFSTLLVTIVHKVTGHGARGGGWLADNLDDGRLDYFYWLLAVISAINLVLFTVAARGYVYKEKRLADAGIELADEETIAVGH

SEQ ID NO: 8295 - DNA, 1764 bp, Oryza sativa (japonica cultivar-group)
  CDS (1)..(1764)
atggacgcagcagcagccatggagaagcagcagcagccgggcgagaagaagatcaccggcggcgaggaggaggaggaggaggaggtgatcagcagcgtccggtaccgaggatggaagtcgatgccatacgtgatagggaacgagacgttcgagaagctgggcaccatcggcaccaccgccaacctgctggtgtacctcaccaccgtctaccacctccccagcgtccgcgccgccaccctcctcaacttcttctccggcaccaccaacctcgcccccctcctcggcgccttcctctccgacaccttcctcggccgctacaccaccatcgccgccgcctccctcgcctcctgcctcggcatgcttgtgcttaccctcaccgccgccatcccatctctccaccccccaccttgcactgcctcctcttcctcgtcgtcgtgccagggccccacacacggccagctcgccgctctcctcgccgccttcgccttcctcgtcgtcggcgccggcggcatccgcccctgcaacctcgccttcggcgccgaccagttcgacccgcgcaccgactccggccgccgcggcattgccagcttcttcaactggtactacttcaccttcaccgtcgccatgatgctctccgccaccctcatcatctacctccagagcaacgtcagctgggcgatcggactcgccgtccccgccgccctcatggccatctcctgcgcgctcttcttcatgggcacccgcctctacgtccgcgtccgccccgagggcagccccttcaccagcttcgcccgggtcatcgtcgccgccgtccgcaagcgccgcgtccccgcaccggcctccgccgacgacctgttcgacccgccgcaccagagcaagctggtggccaagatcgcgtacacggaccagttccggtgcctggacaaggccgccgtggtgacgccggagtcgagatcgagcccgtggcggctgtgcacggtgcagcaggtggaggaggtgaagtgcctggcgcggatcatcccggtgtggtcggcggggatcgtgtacttcatcgtggtaacgcagctgggcacgttcgtggtgctccaggcgctgcagatggaccggcggctgacgaggtggtgggcgttcgaggtgccggcggggtcgatggtggtgttcaacatgatggcgatgacggtgtggatcccggtgtacgaccgggtggtggtgccggcgctgcggcgggtgacggggaaggagggcgggatcagccagctgcagcgcatcggggtggggctggtgctgtcggtggcgacgatggtggtggcggcggcggtggagcagcggcggcgccggctgggcgcggtgggagtgaagatgtcgttcctgtggctggtgccgcagcaggtggcggcggggatgtcggaggcgttcgcggcgatcgggcagacggagctgtactacaggcagttcccggagaacatgaggagcgtggcgggggcgctcttcttcctggcgttcgcgctggccaactacgcgagcggcttcatggtggcggcggtgcaccggaccacggggtggctggcgcaggatctgaaccacgcccgcctcgacctcttctacctaaccgtcgcggccatcgcggcggccaacgtctgctacttcctcctctgcgcccgctggtacaggttcaagaacaccaccatcgccgaccacgtcgagctgccggattatcatcatcatcagcccggaaccgccaacaccatagcctccaaggtttaa

SEQ ID NO: 8296 - protein, 587 aa, Oryza sativa (japonica cultivar-group)
MDAAAAMEKQQQPGEKKITGGEEEEEEEVISSVRYRGWKSMPYVIGNETFEKLGTIGTTANLLVYLTTVYHLPSVRAATLLNFFSGTTNLAPLLGAFLSDTFLGRYTTIAAASLASCLGMLVLTLTAAIPSLHPPPCTASSSSSSCQGPTHGQLAALLAAFAFLVVGAGGIRPCNLAFGADQFDPRTDSGRRGIASFFNWYYFTFTVAMMLSATLIIYLQSNVSWAIGLAVPAALMAISCALFFMGTRLYVRVRPEGSPFTSFARVIVAAVRKRRVPAPASADDLFDPPHQSKLVAKIAYTDQFRCLDKAAVVTPESRSSPWRLCTVQQVEEVKCLARIIPVWSAGIVYFIVVTQLGTFVVLQALQMDRRLTRWWAFEVPAGSMVVFNMMAMTVWIPVYDRVVVPALRRVTGKEGGISQLQRIGVGLVLSVATMVVAAAVEQRRRRLGAVGVKMSFLWLVPQQVAAGMSEAFAAIGQTELYYRQFPENMRSVAGALFFLAFALANYASGFMVAAVHRTTGWLAQDLNHARLDLFYLTVAAIAAANVCYFLLCARWYRFKNTTIADHVELPDYHHHQPGTANTIASKV

SEQ ID NO: 8297 - DNA, 1824 bp, Arabidopsis thaliana
  CDS (1)..(1824)
atggagaaccctcccaatgaaaccgaggctaagcaaatccaaaccaatgaaggcaaaaaaacaaagggtggaatcatcactatgccttttatcatagctaacgaggcgtttgagaaagtggcgagttatggattactaccaaacatgattatgtacttaatcagagattatagatttggagtagcaaaaggaacaaatgtgcttttcatgtggtctgctgcatcaaatttcactcctctcttgggtgcttttctctctgattcctatcttggtcgcttcctcaccatctccattgcttctctctccagtttcttgggaatggtgcttttatggctaactgcaatgttaccacaagtgaagccatcgccttgcgatcccacagcagccggaagccactgtgggtcttcgaccgcatctcagctggctcttttgtattccgcatttgcccttatatcgatcgggtcaggcgggatcagaccatgttccttagcatttggagctgatcaactagacaacaaagagaacccaaaaaatgaaagagttctcgagagtttctttggttggtactacgcttcctcagctgtggcggttctcatcgcgttcacgggtattgtatacattcaggagcatctcgggtggaaaatcgggtttggagtacctgcggtcctcatgttgatcgctgctttgctattcattcttgcgtctcctctctatgttacacgtggtgtgaccaagagtctcttcaccggtttagctcaagcgattgttgcagcttacaagaagaggaagctaagtctaccagatcatcatgactcctttgattgttattatcacatgaaagattctgaaatcaaagctccaagtcaaaagttgaggtttttgaataaagcttgtttaataagtaaccgtgaggaggagattgggtcagatgggtttgctttgaatccatggaggctatgtacaacagacaaagtagaggagcttaaggcattgatcaaagtcatacccatatggtccacaggtataatgatgtccataaacactagccaaagttcgtttcagttactgcaagcgacttccatggacaggcgtctgagccgccatggttcaagctttcaagttccagctggatcattcggtatgttcacaatcatagctctagccctatgggtcattctatatgaccgtgcggttatcccattagcttccaagatccgaggcagaccttttagacttagcgttaagctaagaatgggattaggattattcatgtcattcttagcaatggcaatttccgcaatggttgaaagcttcagaaggaaaaaagctataagccaaggatatgcaaacaattcaaatgctgtggtagacatctcagcaatgtggcttgtgccacaatatgttctacatggtttagcagaggctcttaccgcaataggacagactgagtttttctacaccgagtttcctaaaagtatgtctagcatcgcggcttctctcttcggtttaggaatggctgtggctagtctattggcaagcgtggtcctcaatgcggtcaatgaactaacttctagaaatggtaaagagagttgggtttcagacaacattaacaagggtcactacaactattactattgggtactcgcgataatgagcttcatcaatgtgatctactacgtgatatgtagctggtcgtatggtcctttggtcgaccaggtaaggaatggtagggttaatggtgtgagagaggaagaggagttgattgacattgttggcaaaggattcgagaaggaagatctaagtccagttgttaaaaccaattaa

SEQ ID NO: 8298 - protein, 607 aa, Arabidopsis thaliana
MENPPNETEAKQIQTNEGKKTKGGIITMPFIIANEAFEKVASYGLLPNMIMYLIRDYRFGVAKGTNVLFMWSAASNFTPLLGAFLSDSYLGRFLTISIASLSSFLGMVLLWLTAMLPQVKPSPCDPTAAGSHCGSSTASQLALLYSAFALISIGSGGIRPCSLAFGADQLDNKENPKNERVLESFFGWYYASSAVAVLIAFTGIVYIQEHLGWKIGFGVPAVLMLIAALLFILASPLYVTRGVTKSLFTGLAQAIVAAYKKRKLSLPDHHDSFDCYYHMKDSEIKAPSQKLRFLNKACLISNREEEIGSDGFALNPWRLCTTDKVEELKALIKVIPIWSTGIMMSINTSQSSFQLLQATSMDRRLSRHGSSFQVPAGSFGMFTIIALALWVILYDRAVIPLASKIRGRPFRLSVKLRMGLGLFMSFLAMAISAMVESFRRKKAISQGYANNSNAVVDISAMWLVPQYVLHGLAEALTAIGQTEFFYTEFPKSMSSIAASLFGLGMAVASLLASVVLNAVNELTSRNGKESWVSDNINKGHYNYYYWVLAIMSFINVIYYVICSWSYGPLVDQVRNGRVNGVREEEELIDIVGKGFEKEDLSPVVKTN

SEQ ID NO: 8299 - DNA, 1773 bp, Arabidopsis thaliana
  CDS (1)..(1773)
atggtgaattcgaatgaagaagacgaaaggagaattcttgacgttgaagaatctcttcttacacaggaggaagtgaacaatcacttgaccggattgtcttctacagctgaagatggttctattgacatttatggaaacccaccatcgaagaagaagacaggaaactggaaagcttgtccctttattcttggaaacgaatgttgtgagagattagcttactatggaattgccaagaatctaatcacttactacacaagtgaattacacgagtccaatgtttctgcagctagtgacgttatgatttggcaaggaacttgctatatcacacctctcattggagctgttatagctgattcttactggggaagatactggaccattgcttctttctctgctatttatttcattggaatggctttgttgacactctcggcttcacttccggttttaaagccagcggcatgtgctggcgttgctgcggctctatgctcaccagcaacaacggttcagtatgcggttttctttacagggctttaccttattgctcttggtactggaggtatcaaaccatgtgtatcatcttttggtgctgatcagtttgatgatactgacccgagggaacgagttagaaaagcttctttctttaactggttttacttctccatcaacattggttcatttatctcatccactttgttagtttgggttcaagaaaatgtcgggtggggactcggtttcttgattcccaccgtgtttatgggagtctctattgcgagtttcttcattggaactccgctttatcggtttcagaaaccgggaggtagtccgattactagagtttgccaagttcttgtagctgcataccgtaaattgaagcttaatctccctgaagatatctcatttctgtatgaaacacgagagaaaaactccatgattgctggaagcaggaagattcaacacactgacggttacaagtttcttgacaaagctgctgttatctcagaatatgaatctaaatccggtgctttttccaacccatggaagctatgtactgtaactcaagtcgaagaagttaagactctaatccgtatgtttccaatctgggcctcggggatcgtctactcggtcctatattcacagatttccactctattcgtgcaacaaggacggtccatgaaccgaataatccgttctttcgagatccctcctgcttcattcggggttttcgacacacttatcgtgctcatatccatcccaatatatgaccgtttcctcgtaccctttgtaagacggttcacagggataccaaaagggttaactgatctgcagcgaatgggcattggtctttttctctctgtcctaagcattgcagctgcagctattgttgagacagtgcggttgcagcttgctcaagactttgttgcaatgagcatattttggcagatccctcagtacatactaatgggaatagcagaggtctttttcttcattggtcgagttgagtttttctatgatgaatctcctgatgcaatgagaagtgtatgcagcgctttggcactactcaataccgcagtcggaagctacctgagctcgttgatcctcactcttgtggcgtatttcacagctcttggaggtaaagatggttgggttccagacgaccttaataaaggacatcttgactacttcttctggcttttggtctctcttggacttgtcaacattcctgtttatgccttgatttgtgttaagcacacaaagaagaaggctttgtaa

SEQ ID NO: 8300 - protein, 590 aa, Arabidopsis thaliana
MVNSNEEDERRILDVEESLLTQEEVNNHLTGLSSTAEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDGYKFLDKAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 8301 - DNA, 1728 bp, Arabidopsis thaliana
  CDS (1)..(1728)
atggagcataagaatattggtgcagaagtacttcaagatacgtacgatgatcaacagaaatgggttcttgattcttctcttgatagcagaggacgtgttcctcttcgggctcgaactggcgcttggagagctgcactcttcatcatcgcgatcgagttcagcgagagattgagttacttcgggttagctacaaacttggtcgtctacctaacaacaattctaaaccaagatctcaagatggctataagaaatgtgaactactggtcaggtgtcactactttgatgcctcttcttggaggctttatagccgatgcatatctaggccgttatgctactgtcttggttgcaaccaccatttatcttatgggtttggtccttttaacaatgtcctggttcataccaggcttaaaaccttgtcaccaagaagtgtgcgttgaacctagaaaagcacacgaagtagccttcttcattgccatttacttgatctccatagggactggaggtcataagccttcccttgaaagctttggtgctgaccaattcgacgatgaccatgttgaagaaagaaagatgaaaatgtctttctttaactggtggaacgttagtctatgtgctggtattctaacggccgtgactgctgttgcctatatcgaagaccgggttggttggggcgttgctggcatcatactaactgtagtcatggctatatcactcatcatcttcttcattggaaaaccattctatcgttaccggacaccttctggtagccctttgacaccaatcttgcaagtctttgttgccgccattgccaaaagaaatctaccttatccttctgatccttctctgcttcatgaagtgtccaagacagagtttactagtggccggcttctctgtcacacagagcatcttaaatttcttgacaaggcagcaattatcgaagacaaaaatcctctggccctcgagaaacagagtccatggagacttctaacgttgacaaaagtcgaggaaacgaagctgatcatcaacgtgattccaatatggttctccacgttggcctttggcatatgtgcaacacaagcttcgacgtttttcatcaaacaagcaataaccatggacagacacatcggtggcttcacagttcctccagcttccatgtttacacttaccgccctcacattgatcatctcactcactgtctatgagaaactcctcgttcccttgctaagaagcatcacacggaatcaaagaggcatcaacattctccaaagaatcgggaccggtatgattttctccctcatcaccatgatcattgcagctctagttgagaaacaacgattggaccgtaccaacaacaacaaacccatgagtgtgatatggctagctcctcagttcatggtcattggctttgcggacgctttcacactagttggactccaagagtacttttaccaccaagtccctgactccatgagaagcttaggtatagcgttttacctaagcgtgataggtgcggctagcttccttaacaatctcctgatcacagccgttgatactctcgcggagaatttctcggggaagagttggttcggaaaggacctaaacagcagccgcttggaccggttctactggtttcttgctggtgttatcgctgccaatatatgtgtctttgtgattgtggcaaagagatgtccttacaaaagtgtgcagccaagccaagggctctcctga

SEQ ID NO: 8302 - protein, 575 aa, Arabidopsis thaliana
MEHKNIGAEVLQDTYDDQQKWVLDSSLDSRGRVPLRARTGAWRAALFIIAIEFSERLSYFGLATNLVVYLTTILNQDLKMAIRNVNYWSGVTTLMPLLGGFIADAYLGRYATVLVATTIYLMGLVLLTMSWFIPGLKPCHQEVCVEPRKAHEVAFFIAIYLISIGTGGHKPSLESFGADQFDDDHVEERKMKMSFFNWWNVSLCAGILTAVTAVAYIEDRVGWGVAGIILTVVMAISLIIFFIGKPFYRYRTPSGSPLTPILQVFVAAIAKRNLPYPSDPSLLHEVSKTEFTSGRLLCHTEHLKFLDKAAIIEDKNPLALEKQSPWRLLTLTKVEETKLIINVIPIWFSTLAFGICATQASTFFIKQAITMDRHIGGFTVPPASMFTLTALTLIISLTVYEKLLVPLLRSITRNQRGINILQRIGTGMIFSLITMIIAALVEKQRLDRTNNNKPMSVIWLAPQFMVIGFADAFTLVGLQEYFYHQVPDSMRSLGIAFYLSVIGAASFLNNLLITAVDTLAENFSGKSWFGKDLNSSRLDRFYWFLAGVIAANICVFVIVAKRCPYKSVQPSQGLS

SEQ ID NO: 8303 - DNA, 1776 bp, Arabidopsis thaliana
  CDS (1)..(1776)
atggagaaccctccggatcaaacagagtcaaaggagactcttcaacaacccattacaagaagaagaacaaagggtggtcttctcactatgcccttcatcattgcaaacgaggggttcgagaaagtggcgagctatggattattacagaacatgattctttatctgatgagtgattacagattgggacttgttaaaggacaaactgtcttgttcatgtgggttgctgctactaatttcatgcctctcgttggagcttttctctcagattcatatttgggtcgctttctcaccattgtcattgcttctctctccagtctcctggggatggtggttctatggctaacggcgatgttgccgcaagtaaaaccatcaccgtgtgtagcaacagccggaaccaactgcagttccgcgacatcttctcaattggctctcttgtataccgcattcgcattaatatcgattggatcaggaggaatcaggccatgttctttagcctttggtgctgatcaattggacaacaaagagaatcctaagaacgagagagttcttgagagtttctttggttggtactacgcttcttcatcagttgctgtcttgatcgctttcaccgtcattgtttacattcaagatcatctaggatggaaaatcgggtttggaatacccgcgattctcatgctgctcgcgggtttcttgtttgttttcgcgtctcctctctacgttaagcgcgatgtgagcaagagtctgttcactggtttagctcaagtggttgctgcagcttacgtgaagagaaacttaactttgccggatcatcatgactccagagattgttattaccgtttgaaagattctgaactcaaagctccaagtgacaaattgaggtttttaaacaaagcttgtgccataagtaaccgcgatgaagaccttggttctgatggtttggccttaaaccagtggaggctatgcacaacggaccaagttgagaaactcaaggcgttggtcaaggtgataccggtatggtccacggggataatgatgtcgataaacgttagccagaactcttttcagttgcttcaagctaaatcaatggacagacgtttaagcagcaattcgaccttccaaatcccagctggatcgtttggtatgttcacaatcatagccttaatctcatgggttgttctgtacgaccgcgcaattctccctttagcttcaaagatccgaggcagaccagttagagtcaatgtcaagattcgaatgggattagggctattcatatcattcttagcaatggcggtttccgcaactgttgaacattacagaaggaaaaccgcgataagccaaggactcgcaaacgatgccaactcaacagtgagcatctcagcaatgtggcttgtaccacagtatgtactacacggtttagcagaggccttgaccgggataggacagaccgagtttttctataccgagtttcctaaaagcatgtcgagtatcgcagcttcgttgttcggtctaggaatggcagtggctaatatcttggctagtgtgatcctaaatgcggtaaagaatagctcaaagcagggcaatgtgagctggattgaagataacatcaacaagggtcactatgactattactattgggttttagcgatcttgagcttcgttaatgtcatctactacgttgtgtgtagctggtcctatggtcctacggtggatcaggtgaggaatgataaggttaatggtatgagaaaagaagaagaggaagttattaaattaaactaa

SEQ ID NO: 8304 - protein, 591 aa, Arabidopsis thaliana
MENPPDQTESKETLQQPITRRRTKGGLLTMPFIIANEGFEKVASYGLLQNMILYLMSDYRLGLVKGQTVLFMWVAATNFMPLVGAFLSDSYLGRFLTIVIASLSSLLGMVVLWLTAMLPQVKPSPCVATAGTNCSSATSSQLALLYTAFALISIGSGGIRPCSLAFGADQLDNKENPKNERVLESFFGWYYASSSVAVLIAFTVIVYIQDHLGWKIGFGIPAILMLLAGFLFVFASPLYVKRDVSKSLFTGLAQVVAAAYVKRNLTLPDHHDSRDCYYRLKDSELKAPSDKLRFLNKACAISNRDEDLGSDGLALNQWRLCTTDQVEKLKALVKVIPVWSTGIMMSINVSQNSFQLLQAKSMDRRLSSNSTFQIPAGSFGMFTIIALISWVVLYDRAILPLASKIRGRPVRVNVKIRMGLGLFISFLAMAVSATVEHYRRKTAISQGLANDANSTVSISAMWLVPQYVLHGLAEALTGIGQTEFFYTEFPKSMSSIAASLFGLGMAVANILASVILNAVKNSSKQGNVSWIEDNINKGHYDYYYWVLAILSFVNVIYYVVCSWSYGPTVDQVRNDKVNGMRKEEEEVIKLN

SEQ ID NO: 8305 - DNA, 1713 bp, Arabidopsis thaliana
  CDS (1)..(1713)
atggaagaaaaagatgtgtatacgcaagatggaactgttgatattcacaaaaatcctgcaaacaaggagaaaaccggaaattggaaagcttgccgcttcattctcggaaatgagtgctgtgaaagattggcctactatggcatgggcactaaccttgtgaattatcttgagagccgtctgaatcaaggcaatgctacggctgcaaataacgtcacgaattggtctggaacatgttatataactcctttgattggagcctttatagctgatgcttaccttggacgatattggactattgcaacttttgttttcatctatgtctccggtatgactcttttgacattatcagcttcagttcctggacttaaaccaggtaactgcaatgctgatacttgtcatccaaattctagtcagactgctgttttctttgtcgcgctttatatgattgctcttggaactggcggtataaagccgtgtgtttcgtcctttggagctgatcagtttgatgagaatgatgagaatgagaagatcaagaaaagttctttcttcaactggttttacttctccattaatgttggagctctcattgctgcaactgttctcgtctggatacaaatgaatgttggttggggatggggtttcggtgttccaacagtcgcgatggttatcgcggtttgctttttcttcttcggaagccgtttttacagacttcagagacctggagggagtccacttactaggatctttcaggttatagtagcggcttttcggaagataagtgttaaggttccagaggacaagtctctgctctttgaaactgcagatgatgagagtaacatcaaaggtagccggaaacttgtgcacacagataacttaaagttttttgacaaggcagcggttgagagtcaatctgatagcatcaaagacggggaagtcaatccatggagactatgttctgttactcaagttgaagaacttaagtcaataatcacacttcttccagtttgggccacaggaatagtcttcgccacagtgtacagccaaatgagcacaatgtttgtgttacaaggaaacacaatggaccaacacatgggaaaaaactttgaaatcccatcagcttcactctcacttttcgacactgtcagtgtactcttctggactcctgtctatgaccagttcattatcccgctggcaagaaagttcacacgcaatgaacgaggcttcactcagcttcaacgtatgggtataggtcttgtggtctccatctttgccatgatcactgcaggagtcttggaggttgtcaggcttgattatgtcaaaactcacaatgcatatgaccaaaaacagatccatatgtcgatattctggcagataccgcagtatttacttatcggttgtgcagaagttttcacctttataggtcagcttgagtttttctatgatcaggctcctgatgccatgagaagtctctgctctgctttgtcgttgaccacggttgcgttggggaactatttgagcacagttcttgtgacggttgtgatgaagataacgaagaagaacggtaaaccgggttggataccggataacttgaaccgaggccatcttgattactttttctacttgttggcaactctcagtttcctcaacttcttagtgtacctctggatttcaaaacgctacaaatacaagaaagctgttggtcgagcacattga

SEQ ID NO: 8306 - protein, 570 aa, Arabidopsis thaliana
MEEKDVYTQDGTVDIHKNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVESQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAH

SEQ ID NO: 8307 - DNA, 1713 bp, Arabidopsis thaliana
  CDS (1)..(1713)
atggaagatgacaaggatatatacacaaaagatggaactcttgacattcacaagaaaccagccaacaagaataaaactggaacctggaaagcttgcagattcattcttggaactgagtgctgtgaaagattagcttactatggaatgagtactaatctcatcaactatctcgagaaacaaatgaatatggaaaacgtctctgcttctaagagtgtcagtaactggtctggaacatgttacgctactcctttgatcggtgcttttatcgccgatgcttatctcggtcgatactggaccatcgcttcctttgtcgtcatctacattgccggaatgacgctattgacgatatcagcttcggttcctggtctaacaccaacctgcagcggagaaacctgtcacgcaacagcgggtcaaaccgctattacattcatagcgctttacttgatcgcactcggaactggagggatcaagccttgtgtctcttcctttggtgctgatcagtttgatgatacagacgaaaaagagaaagagtctaagagctctttctttaactggttctactttgtgatcaacgttggtgcaatgattgcttcctctgttctcgtttggattcagatgaatgttggttggggttggggtttaggtgttcccaccgtcgcaatggctatagccgtcgtgttcttcttcgccggaagcaacttctacaggctgcagaaaccaggaggaagtcctctcacaagaatgctgcaagtcattgtggcttcatgcagaaaatctaaagtgaaaattcctgaagatgaatctcttctctacgagaaccaagacgccgaaagcagtatcataggaagccgcaagctcgaacacaccaaaatattaacgttctttgataaggcagcagtggaaacagagagtgacaacaaaggagcagctaagtcgtcttcatggaagctatgcacagtgacacaagtagaagagctcaaagcactgatccgtctcttaccgatttgggccacagggattgttttcgcttcggtttatagccaaatggggactgtgtttgtactacaaggcaacacactggaccaacacatgggacctaacttcaaaatcccttccgcatcactctccttattcgatacgcttagtgtcctgttttgggcacctgtctacgacaagctaattgttcccttcgcccggaaatacacaggtcacgaacgcggattcacacagcttcaacggattggaatcgggcttgtaatctccatcttttctatggtctctgcgggaatcctcgaggtcgcaaggttaaactacgttcaaacacacaatctttacaatgaagagactatcccgatgacgattttctggcaagttccgcagtattttttggtgggttgcgccgaggttttcacgtttataggtcagcttgagttcttctatgaccaagctcctgatgctatgaggagtctctgctcggctttgtcgctcaccgcaattgcatttgggaactatctgagcacatttctggtgacattggtcactaaagtcacgagatcaggtggaagaccaggctggatcgctaagaacctcaacaatggtcatcttgattacttcttttggctattagctggtctgagtttcttgaatttcttggtctacctttggattgctaaatggtacacttacaagaaaacgaccgggcatgcgctttga

SEQ ID NO: 8308 - protein, 570 aa, Arabidopsis thaliana
MEDDKDIYTKDGTLDIHKKPANKNKTGTWKACRFILGTECCERLAYYGMSTNLINYLEKQMNMENVSASKSVSNWSGTCYATPLIGAFIADAYLGRYWTIASFVVIYIAGMTLLTISASVPGLTPTCSGETCHATAGQTAITFIALYLIALGTGGIKPCVSSFGADQFDDTDEKEKESKSSFFNWFYFVINVGAMIASSVLVWIQMNVGWGWGLGVPTVAMAIAVVFFFAGSNFYRLQKPGGSPLTRMLQVIVASCRKSKVKIPEDESLLYENQDAESSIIGSRKLEHTKILTFFDKAAVETESDNKGAAKSSSWKLCTVTQVEELKALIRLLPIWATGIVFASVYSQMGTVFVLQGNTLDQHMGPNFKIPSASLSLFDTLSVLFWAPVYDKLIVPFARKYTGHERGFTQLQRIGIGLVISIFSMVSAGILEVARLNYVQTHNLYNEETIPMTIFWQVPQYFLVGCAEVFTFIGQLEFFYDQAPDAMRSLCSALSLTAIAFGNYLSTFLVTLVTKVTRSGGRPGWIAKNLNNGHLDYFFWLLAGLSFLNFLVYLWIAKWYTYKKTTGHAL

SEQ ID NO: 8309 - DNA, 1761 bp, Arabidopsis thaliana
  CDS (1)..(1761)
atgacagtagaagaggtaggagatgattatacaaaagatggaacagttgatcttcgaggaaatcgcgtccgaagatcccaaacaggccgttggaaagcttgttccttcgtcgttgtgtacgaggtgtttgaaagaatggcgtattatggaatatcaagcaacctagttatctacatgactaccaaattgcaccaaggcacggtcaagtcgtcgaacaatgtgaccaactgggttgggactagttggctcactccaatcttgggtgcttatgttgctgatgctcatttcggtcgctacatcactttcgtcatctcttccgctatctatttattgggaatggcattactgacactatcagtatcgctaccgggacttaaaccaccgaaatgttcgacggctaatgttgaaaactgtgaaaaagcttcggttatacagttagcggtattctttggagcgttatacacattagcaatcggtacaggcggtacaaaaccgaacatttctacaataggtgctgatcaattcgatgaatttgacccaaaggacaagattcataaacattcattcttcaattggtggatgtttagtatcttctttggtactttctttgctacaactgttcttgtctatgttcaagataatgttggttgggccataggttatgggctttcaactttgggacttgctttctccattttcatattcttgttgggaactcggttataccgacataaactcccaatgggaagcccattcaccaagatggctagagtcatcgtggcttcacttcgcaaagcccgcgagccgatgtcgagtgattcgacgcgcttctatgagcttccacctatggaatatgctagcaaaagggctttcccaatccattctacttcaagtctaagattcttaaatcgagcttcactcaaaaccggatcaacccataaatggaggctctgtactatcacagaagtggaagaaacaaaacagatgctaaaaatgttacctgtcctcttcgtaacattcgtcccaagcatgatgcttgctcaaataatgactctgttcatcaaacaaggaacgaccctcgaccgtcgtctcacaaacaacttcagcatcccacccgcaagtctcctaggcttcacaacattctcaatgctcgtctctatagtcatatacgaccgtgtctttgttaagttcatgagaaaactaaccggaaatccaagaggtatcacattgcttcagcgaatgggaatcggtatgatccttcacatcctaatcatgatcatcgcgtccataaccgaacggtataggctcaaggtcgctgctgaacacgggctaacccaccagaccgctgtaccaattcctttgagcattttcacattgcttccacagtatgtactaatgggtttggcagatgctttcatagaaatagcaaagctggagtttttctacgatcaagcaccagagagtatgaaaagcctcgggacatcatatacgagcacaagtatggcagtcgggtatttcatgagcagcattttgctttcgtcagtgtctcagataacaaagaagcagggaagaggatggattcaaaacaacttgaatgagtctaggctggataactattacatgttcttcgcggtacttaatttgcttaacttcatcctcttcttggttgtaattagattttatgagtacagagctgatgttacgcaatcagcaaacgtagaacagaaagaaccaaatatggtagataactacaatgagtaa

SEQ ID NO: 8310 - protein, 586 aa, Arabidopsis thaliana
MTVEEVGDDYTKDGTVDLRGNRVRRSQTGRWKACSFVVVYEVFERMAYYGISSNLVIYMTTKLHQGTVKSSNNVTNWVGTSWLTPILGAYVADAHFGRYITFVISSAIYLLGMALLTLSVSLPGLKPPKCSTANVENCEKASVIQLAVFFGALYTLAIGTGGTKPNISTIGADQFDEFDPKDKIHKHSFFNWWMFSIFFGTFFATTVLVYVQDNVGWAIGYGLSTLGLAFSIFIFLLGTRLYRHKLPMGSPFTKMARVIVASLRKAREPMSSDSTRFYELPPMEYASKRAFPIHSTSSLRFLNRASLKTGSTHKWRLCTITEVEETKQMLKMLPVLFVTFVPSMMLAQIMTLFIKQGTTLDRRLTNNFSIPPASLLGFTTFSMLVSIVIYDRVFVKFMRKLTGNPRGITLLQRMGIGMILHILIMIIASITERYRLKVAAEHGLTHQTAVPIPLSIFTLLPQYVLMGLADAFIEIAKLEFFYDQAPESMKSLGTSYTSTSMAVGYFMSSILLSSVSQITKKQGRGWIQNNLNESRLDNYYMFFAVLNLLNFILFLVVIRFYEYRADVTQSANVEQKEPNMVDNYNE

SEQ ID NO: 8311 - DNA, 1749 bp, Arabidopsis thaliana
  CDS (1)..(1749)
atgacagtagaagaggtaggagacgattacacaaaagatggaacagttgatcttcaaggcaatcctgttcgaagatccattagaggtcgttggaaagcttgctctttcgttgttgtgtacgaggtgtttgaacggatggcttattacgggatatcaagcaacctgtttatttacatgacaaccaaattgcaccaaggaacggtcaagtcgtcgaacaatgtgaccaattgggttgggactagttggctcactccaatcttgggtgcttacgttggagacgctcttctcggtcgctacatcactttcgtcatctcttgtgctatctatttctcggggatgatggtgttaacattatcagtaactataccgggaattaagccaccagaatgttccacgactaatgtggaaaattgcgaaaaagcttcggttttacaattagcagttttctttggagcgttatacacattagcaatcggtacaggcggtacgaaaccgaacatatcaacaataggagctgatcaattcgatgtattcgacccaaaggagaagactcaaaaactatcattcttcaactggtggatgtttagtatcttctttggtactctcttcgccaacactgttcttgtctatgttcaagataatgttggctggaccttgggttatggacttccaacattaggtttggctatttccattaccattttcttgttgggcactccgttttaccgccataaacttcccactggaagcccattcaccaagatggctcgagtcatcgtggcttcatttcgcaaagccaatgcaccaatgacgcatgacatcacgagcttccatgagctgccttctcttgaatatgagcggaaaggcgcctttccgatccaccctactccaagtttacgattcttagacagagcttcactcaaaacaggaacaaatcataaatggaatctttgtactaccacagaagttgaagaaacaaaacaaatgctgagaatgttaccagtcttgttcataactttcgtcccaagtatgatgcttgcacaaatcaacacattgtttgtgaaacaaggaaccactctagaccgaaaggttaccggatctttcagcatcccaccagcgagtctctccggatttgtcacactctcaatgcttatttccatagtcttgtatgaccgagttttcgtcaagataacccgaaaattcactggtaatccaagaggcattactttgcttcaacgaatgggaattggtcttatctttcatatcctcatcatgatcgtcgcatctgtcactgaaaggtatagactcaaagtcgctgctgatcatggtctcatccaccaaaccggagtaaaactaccattaaccatctttgctttgcttccacaattcgtcctaatgggtatggctgattcgttcttagaagttgcaaagcttgagtttttctacgatcaagctcccgagagcatgaaaagcctcgggacatcatattcgacaacgagtttggcgattgggaatttcatgagcagtttcttgttatctacggtatctgagataacaaagaaacgaggaagaggatggattttgaacaaccttaatgagtctaggttggattactattacctgttctttgcggtacttaatctggttaacttcgttttgttcttggtcgtggttaagttttatgtttatagagctgaggttactgattcggttgatgtgaaagaggtggaaatgaaagagactgaataa

SEQ ID NO: 8312 - protein, 582 aa, Arabidopsis thaliana
MTVEEVGDDYTKDGTVDLQGNPVRRSIRGRWKACSFVVVYEVFERMAYYGISSNLFIYMTTKLHQGTVKSSNNVTNWVGTSWLTPILGAYVGDALLGRYITFVISCAIYFSGMMVLTLSVTIPGIKPPECSTTNVENCEKASVLQLAVFFGALYTLAIGTGGTKPNISTIGADQFDVFDPKEKTQKLSFFNWWMFSIFFGTLFANTVLVYVQDNVGWTLGYGLPTLGLAISITIFLLGTPFYRHKLPTGSPFTKMARVIVASFRKANAPMTHDITSFHELPSLEYERKGAFPIHPTPSLRFLDRASLKTGTNHKWNLCTTTEVEETKQMLRMLPVLFITFVPSMMLAQINTLFVKQGTTLDRKVTGSFSIPPASLSGFVTLSMLISIVLYDRVFVKITRKFTGNPRGITLLQRMGIGLIFHILIMIVASVTERYRLKVAADHGLIHQTGVKLPLTIFALLPQFVLMGMADSFLEVAKLEFFYDQAPESMKSLGTSYSTTSLAIGNFMSSFLLSTVSEITKKRGRGWILNNLNESRLDYYYLFFAVLNLVNFVLFLVVVKFYVYRAEVTDSVDVKEVEMKETE

SEQ ID NO: 8313 - DNA, 1863 bp, Arabidopsis thaliana
  CDS (1)..(1863)
atggttttggaggatagaaaggacggttcttctttgccgggacgatccggtagtttctctaaatcgtcaccgtcggagttggatgttgttgatccctacaagcggataagttcgccgggatctatattggatgctgagaaggtagagaaaaagcctggaggatggagagccgtctcgttcattttaggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggagcgtatatctcagacacttatgttggccgcttcaagaccatcgctttcgcctcattcgccactctcctcggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaactctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttcgaagaaatcgatgaaatga

SEQ ID NO: 8314 - protein, 620 aa, Arabidopsis thaliana
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 8315 - DNA, 1920 bp, Magnaporthe grisea 70-15
  CDS (1)..(1920)
atgtcgaccgctccggagctcgacttggccgaggcggccagggcgcatgcgcctagcacggccaaagaaggcatgaccactaggggatcaaccgagtccctcagggccgtcgagggcgagatttatcccacagaggaggagttcgcgactctccgccgtgttcatggcaaagtcagctggctgatctacactattggtttggttgagatgtgcgagcgttttgcgtactatggtaccacagctgtcttcgtcaacttcattgcctatcccctccctgaaggctccacaactggtgctggaggcaccgacagacaggctggtgccttgggtcttggtcaacaggcatccacctcgttgacgctcttcaacgccttctggtcctacttcatgccgctcctgggtggataccttgccgatacttactggggtcgtttcatgaccatccagtatgccatcgtcctcgccaccattggtcacatcttgatcattgtggctgctattccctcggtcatcaccaatcccagcggcgcactcggcgctttcatcgtcggcattctattctttggcaccggtgtcggttggttcaaggccaatatctcaccgctgatcgccgagcaatatgaaatgcaacacccccgcgccgtcatcgagactctaccttctggcgagcgcgttattgttgacccagtcgtgacgatttccagaatctacatgcgctactacttcctggtcaacgtgggtgcgctcgttggacagatcagcatggtgtacgccgagaagtacgtcggcttctggctgtcgtacttgctccccactctgttgttcttcctttgccccattatcatggtcatcagccgcaagagctatgccaagcgtcccccgaccgggtctgttctcggcaacatggccaaacttgttgcgttcggtatcaagaagggctccatcacagagttgaacaaggacgtcttctgggaccgtatcaagcccagccgtgtcactggtgctgaccgacccaagtttatggacaccattgacgacgcttgggttgacgaggtccgccgaggcctgtctgcctgttatgtgtttgccttcttgcccatcttctggctggcctacaaccagatgagcaacaacatgatcaaccaggcagccacaatgcgccttgatggcatcccgaacgatgtcgtcaccaacctgaaccccttttcgctccttatcttgattcccatctgcgacaagctgatttacccggccctcgccaaggccggcatccgcttcactcccatcaagaagatcgcgttgggatttgtttcagccgccctttccatggccattgccgccatcatccagcactttatctatgtcaagtctccctgcggctacagcgcctcggaatgtatcgacccacccaacccccctgacatgagtgtttggatccaaacgcccgcctacgttttgattgctctctccgaggtttttgcatccatcactggtctcgagtacgccttcactaaggcgccgcgaaacatgaggggaatggtcactggtgttttctggctcgtcaattcgatcagcgccgcccttggctttgcattcgtcggacttgctacggatccacttctcgtctggctgtacaccaccgttgccatcgtcagtgcggttggaggtattgctttctggttctgcttccgcaagcttgacaagcgggaggatgagcttaacgctcttcccgaatccaactacaaggggcgccaccttgatggccccatggatgtcgagaagagggtgatggacgacgaagccacgcaagctgcacctgctgctacgtctgtccctgcacccggcactgcatccgggacggctgccgatgtcgacgccgtgacccccgtggaggccggcagcaccgagaagcgccaatag

SEQ ID NO: 8316 - protein, 639 aa, Magnaporthe grisea 70-15
MSTAPELDLAEAARAHAPSTAKEGMTTRGSTESLRAVEGEIYPTEEEFATLRRVHGKVSWLIYTIGLVEMCERFAYYGTTAVFVNFIAYPLPEGSTTGAGGTDRQAGALGLGQQASTSLTLFNAFWSYFMPLLGGYLADTYWGRFMTIQYAIVLATIGHILIIVAAIPSVITNPSGALGAFIVGILFFGTGVGWFKANISPLIAEQYEMQHPRAVIETLPSGERVIVDPVVTISRIYMRYYFLVNVGALVGQISMVYAEKYVGFWLSYLLPTLLFFLCPIIMVISRKSYAKRPPTGSVLGNMAKLVAFGIKKGSITELNKDVFWDRIKPSRVTGADRPKFMDTIDDAWVDEVRRGLSACYVFAFLPIFWLAYNQMSNNMINQAATMRLDGIPNDVVTNLNPFSLLILIPICDKLIYPALAKAGIRFTPIKKIALGFVSAALSMAIAAIIQHFIYVKSPCGYSASECIDPPNPPDMSVWIQTPAYVLIALSEVFASITGLEYAFTKAPRNMRGMVTGVFWLVNSISAALGFAFVGLATDPLLVWLYTTVAIVSAVGGIAFWFCFRKLDKREDELNALPESNYKGRHLDGPMDVEKRVMDDEATQAAPAATSVPAPGTASGTAADVDAVTPVEAGSTEKRQ

SEQ ID NO: 8317 - DNA, 1803 bp, Magnaporthe grisea 70-15
  CDS (1)..(1803)
atggctgacaccaagagctcggccgaggacgtaagccccatcgagcgcgtcaacaaagccgactcggcaggcacttatttctccgagaaaaaggatgccctcgaccaacagtcgtcccacgataaaccgaccgccgaggagctggtcaccctccggcgcgtggcctccaagatcccgctcaacatctactccatagccttcatccagctctgcgagcgcttctcctggtacggaaccgtcatcgtctataccaacttcatccagatgcccatgcccgaaggctccaccacgggcgcgcccctcacgcgagacggccaaccgggtgtcctgggcatgggccaacaagcctcgacctccatcaccctcacaaacatggccatcggagcctgcatgcctctcctcggcgcctacatcgcggaccagcacctcggccgctacaagaccatctgcgcggcgcttgtggtcgccatcctgggtcacttggtccttgttgtggccgcctccccacccgtgctggcgcagggaccctcaaatgccctcggcgccctcatcaccggcatgctgaccgtcagtctcggcgccgggggtttcctgccaaacatcagccccatgatcgccgagcagatcgacacagaaaagggtcctcgagtcacagtcctgcccaagacgggcgagcgcgtcatcgagaatccggccgtcacaattaaccgtgtgtacaattggttctacctctttatcaacatcggtgccttggtgggccagataagcatggtgtacgccgaggcatacgtcggcttctggctgtcgttcctgctgccggccattatcctctgcttctgcccctccatcatgtggtggggccgcaagcgcttcaagaccagaaagcccacaggcagcgccttgagcaaggccttgaggacctttttgttggccaacaaggggagatggcatattctgccatgggtcacctatcagaggctcaacgacgggacgttttgggaaaacgtcaagccgagcaagtttgcgcccggaacgaagcccaagtggatgacctttgatgatgcctgggttgatgagctacaacgcggattcgccgcctgccaggtgttcctttggtatcccatttactggctgtcctatggccagatgaacaacaacctgatctcacaggcggctaccatgaagctcgatggagtacccaacgacctgctgacaaacctagatcccataaccttgatcatcttgatccccatcttcgactttgtcatctaccccttcctccgcaagcacaagatcaacttcacgcccctaaagaagatcacagccggcttcctagtaggcggcgcgggcatgatctgggcggccgtggtacagaacagcatctacagcctctccgagtgcggcaacatggcatccggcacgacggccaccggcgaccagtgcccgcccgcaaccctgtcggtgtgggcgcagacggggtcgtacgtcctaatcgcgctgtccgaaatcctggcctccatcacgtcgctcgagtacgccttcagcaaggcgcccaagaacatgcgctccacggtccaggccatcgccatgttcatgacggccatcagcagcgccctggccgtggcgtttgtgccgctcagcaccgacccgttgctggtgtggaactacgggagcacggccgtcatcgccattgtcggaggcgccttgttctggtgggtctttagggagttggatagcaaggagggcgagctcaatgaactcccagagggcaagttgtttgccgacagggatgaggaggactag

SEQ ID NO: 8318 - protein, 600 aa, Magnaporthe grisea 70-15
MADTKSSAEDVSPIERVNKADSAGTYFSEKKDALDQQSSHDKPTAEELVTLRRVASKIPLNIYSIAFIQLCERFSWYGTVIVYTNFIQMPMPEGSTTGAPLTRDGQPGVLGMGQQASTSITLTNMAIGACMPLLGAYIADQHLGRYKTICAALVVAILGHLVLVVAASPPVLAQGPSNALGALITGMLTVSLGAGGFLPNISPMIAEQIDTEKGPRVTVLPKTGERVIENPAVTINRVYNWFYLFINIGALVGQISMVYAEAYVGFWLSFLLPAIILCFCPSIMWWGRKRFKTRKPTGSALSKALRTFLLANKGRWHILPWVTYQRLNDGTFWENVKPSKFAPGTKPKWMTFDDAWVDELQRGFAACQVFLWYPIYWLSYGQMNNNLISQAATMKLDGVPNDLLTNLDPITLIILIPIFDFVIYPFLRKHKINFTPLKKITAGFLVGGAGMIWAAVVQNSIYSLSECGNMASGTTATGDQCPPATLSVWAQTGSYVLIALSEILASITSLEYAFSKAPKNMRSTVQAIAMFMTAISSALAVAFVPLSTDPLLVWNYGSTAVIAIVGGALFWWVFRELDSKEGELNELPEGKLFADRDEED

SEQ ID NO: 8319 - DNA, 1845 bp, Gibberella zeae PH-1
  CDS (1)..(1845)
atgacttccaccggtcctatcgacaacgacgccatcgcccgctcagggcttgcggaccccgagactcacggcatcccccagatcgccgccaagggctccatggacgtcacacgccgctccgtctccgactctgacgatgagcttcccactgacgaggagcttcagacgctccgtcgtgtctctggaaagatcaagtgggccatgtacaccatcgccttcgtagaggcctgcgagcgtttctcctactacggttccgctgtgctctacaccaactttgtcgctcaggagcttcctcctggttccaacactggtgctcctcttgaccctagcggtcaggctggtgctttgggcatgggtcccaaggctgctcagggtatctctctgttcaaccagttcttcgcttatctcatgcctcttgtcggtgcctgggttgccgatgccaagctcggtcgtttcgtcacccttcacatcgccattgccatctccaccatcgctcacactatcctggttgctgcttcatctcccaacgtcatcgtccgcaaggaccctgctttcggtgctttcatcgtcggtctcatcactctctgtgtcggaactggtttcttcaaggccaacgtttctcccctcctggctgatcaaaatgaggacaccaagatgcgtgtcgaggtccgcaatggcgagcgagtcattgtcgatcctgccgtgacaaatacccgtgtcttcctctacttctacctcgccatcaacatcggttccgtctgcggtcagattgccatggtctacgttgagaagtaccactccttctggttggccttcttcatccccaccatcttcttcctcatcgcccccattgttcttgctctcaacaagaagaagtacaagctcaagcctgcgactggttccgttctttccaagttcttgaagatgttcttctacgtctctaagcgcagccctgctttccgacccaactgggagcacgccaagccttctcagattcctgttgaccagcgcccttcttggatgacctacgatgatgcctgggtcgatgaagtcaagcgtggtctcctggcctgcaaggtcttcctctacctgcccgtcttccatctggcttacaaccagatgaccggtaacctgaccactcaggcctccaccatggttctcaacggtgttcccaacgatgttattcagaacttgaaccctatctctatcgtcatcatggtccccctcattgatcaccttttgtaccccggtctccgcaagctgggtatctctttcacccccatcaagcgtatgacagttggtttcttgatctccgccctggccatggtcgcctctgctgttatgcaacactacatctaccagaagagcccctgtggcaagtatgccaacggcaaggacccctcaactggcgagaagtgcgcccccgccgacatcaacgtctgggctcagtgccttccctacatcttcattggtctcggtgagatcttcaccaacgttacctcttacgaatacgcctattccaaggcccccgagaacatgaagtccctcgtcatgagtgtcaacctcttcatgtccgcctttgcctccgccatcggccaggctttcacacctctctccgacgaccctctcctcgtctggaactacgtcatcgtcgctgtcattgcctttgtcggtggtgttgctttctggttccagttcaagcatctcgacggcgaggaagacaagtggaacatgctcaaggcctcagagtaccagggtgaataccaacccaatgctactgagaacaaggttgccgatgagcacgaggagcctaccaacgctcctcgggatattgagaagatgtga

SEQ ID NO: 8320 - protein, 614 aa, Gibberella zeae PH-1
MTSTGPIDNDAIARSGLADPETHGIPQIAAKGSMDVTRRSVSDSDDELPTDEELQTLRRVSGKIKWAMYTIAFVEACERFSYYGSAVLYTNFVAQELPPGSNTGAPLDPSGQAGALGMGPKAAQGISLFNQFFAYLMPLVGAWVADAKLGRFVTLHIAIAISTIAHTILVAASSPNVIVRKDPAFGAFIVGLITLCVGTGFFKANVSPLLADQNEDTKMRVEVRNGERVIVDPAVTNTRVFLYFYLAINIGSVCGQIAMVYVEKYHSFWLAFFIPTIFFLIAPIVLALNKKKYKLKPATGSVLSKFLKMFFYVSKRSPAFRPNWEHAKPSQIPVDQRPSWMTYDDAWVDEVKRGLLACKVFLYLPVFHLAYNQMTGNLTTQASTMVLNGVPNDVIQNLNPISIVIMVPLIDHLLYPGLRKLGISFTPIKRMTVGFLISALAMVASAVMQHYIYQKSPCGKYANGKDPSTGEKCAPADINVWAQCLPYIFIGLGEIFTNVTSYEYAYSKAPENMKSLVMSVNLFMSAFASAIGQAFTPLSDDPLLVWNYVIVAVIAFVGGVAFWFQFKHLDGEEDKWNMLKASEYQGEYQPNATENKVADEHEEPTNAPRDIEKM

SEQ ID NO: 8321 - DNA, 1791 bp, Gibberella zeae PH-1
  CDS (1)..(1791)
atggctcagaaccacgaggatttggccgccgagctccacgaagagcttggtgaccgcacacacaacgagaagaagaccgatctcactggcggctttattgctccttccgagattaatgagaagcaatcttttgacaagcagtctgacccagagttcggtaacacgcctgacggcgaggagcccaacaaccatgagagggccactcttcgccgtgttggcgagaaccttcccgcttcagctttcctcatcgctgttgtcgagttgacagaacgtttcgcctactacggtgctcaaggtctattccagaactacatctcctacgccaaagatggatccgatggccccaagggtctcggcatgggtaaccaggccgctaccggtctcaacctgttcttccaatggttttgctacgtgacccccattctcggtgccatcgtcgccgatcagtacctcggaaagtacaagaccattctcgtcttctgtggtttctactgggttggtctcatcattctctggacaactgcgctaccagccgccatggctgtcggtgccagcaagcccggttacatcgttgcaatcatcgttatcggtctgggaactggaggtatcaagtccaacattgctcctcttatcgccgatcagtaccaaagacgcagaatggccattcgaactgaaaagtccggagagcgagtcgtcatcgatcctgccattacctaccagcgtatctacatgatcttctactggtgcatcaacgtcggtgccctttctctgcttgccactccctttatggagaagtacgaaggattctggactgcctacctgatgtgtttcatcatgttcaacatcggtatcctcactcttgtcctccgccgcaagacctttgtcaaccgtcctccccagggatccgtcatcaccgatgctttcaaggctcttggtatgatgattgctgcccgcaacactgatgctgccaagccctcatggcgcgaggccaacggcaagaccaaggctgtcccctggaacgaccacttcgtcgatgagctcaagcgtgctctccgtgcttgcaaggtctttgtcttctaccccatcttctgggtttgctacggacagttctccaccaactttgtcacccaggctggtcagatgaacggccacggcgttcctaacgatctgatgcagaacttcgatcctatctccattttggttttcactcctcttatcgagaaggttctctaccctatcctgcgacgcttcggaatcgagcttcgacctattgcccgtatcaccattggtttctggttcgctgctctgtgtctcgcttacgctgctattgtccagcacatcatctactcttctggaccctgctacgagtcccccaaggactgtcctgccggtatggtcgacggcaagaacctccccaacaacgtgcacatcgctatccagacccccgcctacatctttattggtatttctgagatcttcatctccgtcactggtcttgagtacgcctacaccaaggctcctccttccatgaagtctttcgtccagtccatctacctcttcaccaacgctttcggttctgctatcgccgaggctctcgtctcacgcgccaaggaccccgacttcttgtggctctacgtcggtgttggtatcgcctctgccgttaccggttgcatcttctacgctctgttccgccactacgatgctcaagaagatgccatgtacgatctggatcgcgatgcgccagttcttactcacaacggtatcaaggagagcgaggaggagacgaagtaa

SEQ ID NO: 8322 - protein, 596 aa, Gibberella zeae PH-1
MAQNHEDLAAELHEELGDRTHNEKKTDLTGGFIAPSEINEKQSFDKQSDPEFGNTPDGEEPNNHERATLRRVGENLPASAFLIAVVELTERFAYYGAQGLFQNYISYAKDGSDGPKGLGMGNQAATGLNLFFQWFCYVTPILGAIVADQYLGKYKTILVFCGFYWVGLIILWTTALPAAMAVGASKPGYIVAIIVIGLGTGGIKSNIAPLIADQYQRRRMAIRTEKSGERVVIDPAITYQRIYMIFYWCINVGALSLLATPFMEKYEGFWTAYLMCFIMFNIGILTLVLRRKTFVNRPPQGSVITDAFKALGMMIAARNTDAAKPSWREANGKTKAVPWNDHFVDELKRALRACKVFVFYPIFWVCYGQFSTNFVTQAGQMNGHGVPNDLMQNFDPISILVFTPLIEKVLYPILRRFGIELRPIARITIGFWFAALCLAYAAIVQHIIYSSGPCYESPKDCPAGMVDGKNLPNNVHIAIQTPAYIFIGISEIFISVTGLEYAYTKAPPSMKSFVQSIYLFTNAFGSAIAEALVSRAKDPDFLWLYVGVGIASAVTGCIFYALFRHYDAQEDAMYDLDRDAPVLTHNGIKESEEETK

SEQ ID NO: 8323 - DNA, 1845 bp, Gibberella zeae PH-1
  CDS (1)..(1845)
atggcgcctaccggagacgctatgggcgagaccgttgctgcggccggcctccacgctgagatggttgacgagaagcgagcctctgttgccgctgagaggagatcctctgtggtcaccgacccccaggctcctgctgctgctgtgtcttctggtggtgtcaccgcagatgggcagtttcccactcctgaggagatgcaaagcttgaggcgcattgccaacaagattcccatgaagctctttagcattgcattcatagaactctgcgaacgcttcagttactacggatgcacggttgttttcacaaacttcatccagcagcctctcccccctggttctaccaccggtgccgacgatgagcagcctggtgcccttggaatgggtcagcgagcctcgacaggaatcactaccttcaaccagttctggcagtacctgatgcctcttctcggagcctatctcgctgatcagtactggggtcgttacaagaccatcagctatgctctggtagtcgacatcatcggtcatcttatccttatcgtctccgctgtccctggtgtcattcagagcgacggtgctctcggtgccatgatcgttggtattattgtcattggtttcggtaccggtggtttcaagcctaatgttaatcctcttattgtcgaacagcttggtgagcaatacatgcacgtcaagactctcaagtctggtgagcgtgttatcatcgatcctgccgtcaccattgagcgtgtttacatgtggttctactgggctattaacattggtgccctggtcggtcaggtcaccatggttttcgccgagaagtatgtcggtttctggctatcatacacccttcctaccttcatgctgtgcatctgccctatcatcttattcttcaaccgcaagaactacgaacgacgacctcctggtggttccgttctgggacctgctatgaagaccttcttccttgctcaaaagggccgctggagcattaaccccttccagacatggaagaacatgcacactggtgacttttgggagaacgttaagccatctcgcttcagtcatgagaaccgccctaagtggatgactttcgacgatgcttgggttgatgagcttcgtcgtggatttaacgcttgtgccgtattctgctggtaccccatcttctggctttgctacaatcagatcaacaacaacctgatctctcaggccgctctcatgcagcgtcacggtgttcccaacgatattctctccaacctcaaccccttcgccctcttgatcttcattcctctcaacgatcgcctaatctaccctgctctccgaaaggctggtatccgctttactcccatcaagaagatcacggcaggtttcttcactggagccgccgccatgatctgggctgctgttgtccaacactacatataccaaaagtctgagtgtggtatgcgggcatctggcgaagactgtcctgtcgtcgagattaacgtctgggcccagactggcgcttacgttctcattgctctgtccgaagtgttcgcctctatcacttctcttgagtacgccttctccaaggctcccaagaacatgcgttccatggtccaggccgttgctctcttcatgactgctttctcggctgctcttggacaggccctggttggtcttgctgccgatcctctgcttgtttggaactacggtgttgttgccatcctcgctgtgattgccggaacttgcttctggttccagttcaaggacttggatattatcgaggatgagctcaacgctctccctgagggtcaagctggtgccaagttcgacgaggagtctcctttgggcgagaagcgggttgacggataa

SEQ ID NO: 8324 - protein, 614 aa, Gibberella zeae PH-1
MAPTGDAMGETVAAAGLHAEMVDEKRASVAAERRSSVVTDPQAPAAAVSSGGVTADGQFPTPEEMQSLRRIANKIPMKLFSIAFIELCERFSYYGCTVVFTNFIQQPLPPGSTTGADDEQPGALGMGQRASTGITTFNQFWQYLMPLLGAYLADQYWGRYKTISYALVVDIIGHLILIVSAVPGVIQSDGALGAMIVGIIVIGFGTGGFKPNVNPLIVEQLGEQYMHVKTLKSGERVIIDPAVTIERVYMWFYWAINIGALVGQVTMVFAEKYVGFWLSYTLPTFMLCICPIILFFNRKNYERRPPGGSVLGPAMKTFFLAQKGRWSINPFQTWKNMHTGDFWENVKPSRFSHENRPKWMTFDDAWVDELRRGFNACAVFCWYPIFWLCYNQINNNLISQAALMQRHGVPNDILSNLNPFALLIFIPLNDRLIYPALRKAGIRFTPIKKITAGFFTGAAAMIWAAVVQHYIYQKSECGMRASGEDCPVVEINVWAQTGAYVLIALSEVFASITSLEYAFSKAPKNMRSMVQAVALFMTAFSAALGQALVGLAADPLLVWNYGVVAILAVIAGTCFWFQFKDLDIIEDELNALPEGQAGAKFDEESPLGEKRVDG

SEQ ID NO: 8325 - DNA, 1794 bp, Candida glabrata CBS 138
  CDS (1)..(1794)
atgctaaatcgtttctcgaaacggaacgatgaaaagaacgctgtcgaagtgcagaaggatgtttctagcatcgacgacaactcttccaaggaggtatatgagatcgaggaccaggagatccaccacttggacagagacaagtctaacgccgagtctaactttgcgctaggcgaggatgacgactttgaagctcctaccgaggaggagttgaagacgctgagacatgtcgccggccacatcccacttagatgttggttgatcgccatcgtcgagttatccgagagattctcttactacggtctgtccgctcctttccagaactacatgcagaacggtcctaacgacaatccaaagggtttgttgggtctaaagtcccaaggtgccaccggtctgtcctacttcttccaattttggtgttacgttacccccgtgttcggtggttgggtctctgatacttactggggtaagtacaacaccatctgtgtcggtactttcatctacgtctgcggtatcttcatcttgttcatcacttctatccctggtgtcaccaactctgacggtgccctaggtggtttcatcgctgctatcatcttaatcggtattgctacaggtatgatcaagtctaacttgtccgtgttgattgctgaccaactgccaaacaagaaacctagagttgtcatcacaaagaaaggtgaaagagtcatcgaagatccaaacttgactttgcaaaacgtcttcatgttcttctacttcaccattaacgtcggctctttgtctgtcatggccactaccgagttggaataccacaagggtttctgggctgcttacttgctacctttctgtttcttctgggtcgccgtcgccgtcttggtctttggtagaaaccaatacatcaagccacctgtcggtgacaaggtcatctctaagtccttcaaagtgttgtacatcttgtccaagaacaagtttaacgctgaagccgctaagccttctttcaacccagacaagaacttcccatggtccgacaagttcgtcgacgagatcaagagagccctacaagcttgtaaagtgtttgtcttctaccctgtctactgggtctgttacggtactatgttgaacaacttcgtcacccaaggtggtactatggaattgcacaacttgccaaacgatttcttgcaagctttcgactccatcgctttgattatcttcatcccaatctttgaaagatttgtctacccattcattagaagatacacacctttgagaccaatcacaaagattttcttcggtttcatggtcggctccggtgctatggtctgggccgccgttctacaacacttcatctacactaagggtccatggtacgaccacccattggaccacgacacaccaaaccacattcacgtcgcatggcaaattcctgcttacgtcttgatcgccatctctgaaattttcgcttctatcactggtctagagtacgcttactccaaggccccagaatctatgaaatccttcatcatgtccatcttcttgttgaccaacgccttcggttccgccatcggttgtgctttgtctccagtctctgtcgatccaaagttcgtctggttctacactggtttggcctgtgcttgtttcatcgccggttgggtcttctggttcatctacagtggtttgaacgatgaagaagaagctatgaatgccttggactacgaacacgatgagttcatgtacaagcatcacagcgatgacgaagaggctgctgaacacgtcagaagcatcaagtctgaaaagtcatag

SEQ ID NO: 8326 - protein, 597 aa, Candida glabrata CBS 138
MLNRFSKRNDEKNAVEVQKDVSSIDDNSSKEVYEIEDQEIHHLDRDKSNAESNFALGEDDDFEAPTEEELKTLRHVAGHIPLRCWLIAIVELSERFSYYGLSAPFQNYMQNGPNDNPKGLLGLKSQGATGLSYFFQFWCYVTPVFGGWVSDTYWGKYNTICVGTFIYVCGIFILFITSIPGVTNSDGALGGFIAAIILIGIATGMIKSNLSVLIADQLPNKKPRVVITKKGERVIEDPNLTLQNVFMFFYFTINVGSLSVMATTELEYHKGFWAAYLLPFCFFWVAVAVLVFGRNQYIKPPVGDKVISKSFKVLYILSKNKFNAEAAKPSFNPDKNFPWSDKFVDEIKRALQACKVFVFYPVYWVCYGTMLNNFVTQGGTMELHNLPNDFLQAFDSIALIIFIPIFERFVYPFIRRYTPLRPITKIFFGFMVGSGAMVWAAVLQHFIYTKGPWYDHPLDHDTPNHIHVAWQIPAYVLIAISEIFASITGLEYAYSKAPESMKSFIMSIFLLTNAFGSAIGCALSPVSVDPKFVWFYTGLACACFIAGWVFWFIYSGLNDEEEAMNALDYEHDEFMYKHHSDDEEAAEHVRSIKSEKS

SEQ ID NO: 8327 - DNA, 1965 bp, Kluyveromyces lactis NRRL Y-1140
  CDS (1)..(1965)
atgtccgccgcagaaaaggatttcttgacagacgacaaaattagtgatgatatcatcaacaacaacaacaacaacaacaacaacaacaacaacaacagtcaggcattgaacgttgacagcacagttagtagtgatgatgaatttactggtgagaagaaagatgaaaaattcaaaaacaacacagacatcaaggtatatatttcaaaggaccatcatgctagttctgataaaatcgattttattggtgctgtagacgaagatgacaaccaaaacgaaaatggaagagaacctaccgaagaagagttgagtactttgagacatgtgtcggaaaggattccattcacttgttggttgattgccatcgttgaattggctgaaagattctcatactatggtctttctgcaccattccaaaactatatgcaaaacggtcctaacgacacaccaaagggtgtcttgcagttgaaatcacaaggtgccactgctttgtcgtatttcttccagttttggtgttacgttactccattgttaggtggttatttggctgatactttctggggtaaatataatactatctgtgttggtgccagtttctatgttgttggtatcctgatcttgtttatgactgcaatcccaagtatcaacgataaaaactcctcgttgggtggatttatcgtttctttgattataatcggtattggtactggttttatcaaagctaatttgtccgtcttgatcgcagatcaaatcccaaagacaaggcctagaattaaggttttgaagaacggtgaaaaagtcatcgaagatcccaatgttacaatgcaaaatgtgtttatgttcttctacttgatgattaatattggttctttatctgtcatggcaaccacccatttagaagctagttacggtttctgggctgcttatttgttaactttctgtttcttctgggtcggtatcgtggtgcttgtgtttggtagaaagaagtacgtgaggaggcccattggtgaccatgtcattgcaagatgtttcaaaatctgctggattggtttatgcaacggtttcaatttgaatagagccgttccatctttgaacccagaaaaggagtacccatggaatgatttattcatcgatgaaattagaagagctttcaaggcttgtaaagttttcgcattttacccaatttactgggttgtttacggtcaaatgcttaacaatttcgttacccaagctggtactatggaattgcacggtttgccaaatgatttcttacaagctatcaactctattgctttaattgtattcatcccaatcatggaacaattcatttacccatttatcagacgtttcactcctttcagaccagttaccaagatcttcattggtttctgtttcggttctagtgccatggtttacgctgctgtcttgcaacactttatttacaaagcaggtccatgttacgacttcccaatgtcctgtgcaccagaatacgcaaacactccaaacagagtccatatcggctggcaagttcctgcttatgtcttaatttctctttctgaaattttcgcgtccattactggtttggaatacgcttactctaaagccccagccacaatgaaagccttcatcatgtccatctttttggtcacgaacgctgtcggttctgctctcggtatcgccttgtccccaacagccgaaaatccaaagtacgtctggacattctctggtttggctgttgcttgtttcattgctggttgtttgttctggctatgtttccaccactacaacaaggatgaagaagccttgaatgcattggattacaagacagaagaacaagaacaaatgttgtcaggtgttggtgtcaccggagaaggtgctgctttatacagtgtctcctcagttcgcagtagagttcaacagcaacagaaacagcaaaatctagagcatcaattatctcgctcagcttaa

SEQ ID NO: 8328 - protein, 654 aa, Kluyveromyces lactis NRRL Y-1140
MSAAEKDFLTDDKISDDIINNNNNNNNNNNNNSQALNVDSTVSSDDEFTGEKKDEKFKNNTDIKVYISKDHHASSDKIDFIGAVDEDDNQNENGREPTEEELSTLRHVSERIPFTCWLIAIVELAERFSYYGLSAPFQNYMQNGPNDTPKGVLQLKSQGATALSYFFQFWCYVTPLLGGYLADTFWGKYNTICVGASFYVVGILILFMTAIPSINDKNSSLGGFIVSLIIIGIGTGFIKANLSVLIADQIPKTRPRIKVLKNGEKVIEDPNVTMQNVFMFFYLMINIGSLSVMATTHLEASYGFWAAYLLTFCFFWVGIVVLVFGRKKYVRRPIGDHVIARCFKICWIGLCNGFNLNRAVPSLNPEKEYPWNDLFIDEIRRAFKACKVFAFYPIYWVVYGQMLNNFVTQAGTMELHGLPNDFLQAINSIALIVFIPIMEQFIYPFIRRFTPFRPVTKIFIGFCFGSSAMVYAAVLQHFIYKAGPCYDFPMSCAPEYANTPNRVHIGWQVPAYVLISLSEIFASITGLEYAYSKAPATMKAFIMSIFLVTNAVGSALGIALSPTAENPKYVWTFSGLAVACFIAGCLFWLCFHHYNKDEEALNALDYKTEEQEQMLSGVGVTGEGAALYSVSSVRSRVQQQQKQQNLEHQLSRSA

SEQ ID NO: 8329 - DNA, 1950 bp, Debaryomyces hansenii CBS767
  CDS (1)..(1950)
atgaccagcgtgaaagaaattaatgagaaagacccaggtaaggacgagtatagcgtcgacgagagggcagaacatgaagtcgcggagactcatctcaacgcaaatcacgataatgcttctatcgtctcgaaagaagagtttgaagatgaaggtatctacgattttgacgattcgaacaattactcaaccacttttgtcgatgatcataatcctatggggttaagaaagcctactaaacaggaagcttcttcgttgagaagagttttgggaagggctgattgggcctgttatatgatttgcgtggccgaatttgctgaaagagcctcgtactattcgtgtcagactctcttaagtaattttgttaccaacccattgcctgagggaagcggaactggtaagcttatgcctggtagtgttaatcctggtgccttagggttgggtgtgcctaccgctaccgccattacttatactttgactttcgttgcctaccttgttccgttatatgctggttatgttgctgattcgcaaattggtaaatttagagccatctggattggtgttatttgtggtttttttgctcatattttacttgtcatagctgctatccctgctgttattgagggaggcaatgctattgttcctactgcgttcggtatcattacgttggcgtttggtactggttttatcaaacctaatttattaccactcttgttggatcaataccccgaggagtcggatgtggttaaattgttgccatcaggagaaaaggttattgttgaccgtcaaaagtcattggaaagaatggtcttagtattctattggtccgtaaaccttggtgcacttttccctattccaagtgtttacatcgaacaaagaattggattttggtttgctttcttcattccaatcattatatatctcattattccagcagtgttttggttcgtccgtccaagacttaagaaagaaaagcttcaaagctctgttatggtcaacactaacaaaatcttgaaggttctgtttagaggaaactggataaaaagaatcagaaacaataccttttgggattatgcagctcctaccaacatgaatgcaagaggcgaggaatactattctgcaaagaaaaagaagccaattacttggactgaccaatgggtgttggatgtcaagcaaattgttaatatttccaaagttttcctttacttcgtgatcttcaacctttgtgatgctggtggtaccggagcaactccagctttaactgcacagtcgggatctttgactagtgatggaacgcctaatgatatctacagtagtttcaatccaatcactatcattttccttatcccaatattggattacggtatttatcctttattgcgtagatggaagatagactttagaccggtcttgagaatcacctttggtttcttattggcagctttgtctcaggtagcagctgcagtaatccaaaaagaaatttataaccagattgaatgtggagaccatgctacagaatgtgtagagaaaggaatagtagcaccatttagtgcctgggtcctggtgatgccatacatcttatctgctgcttctgaatgttttgctaatacttctggttatgaattgggttatactagagctccacctcatttgaaagggtttgttcaggctttgttcttacttgcgactgctttagctgctgctattggtgatgctatcagtccagcattgaaagatccaaacttggtttggtattttgcagctttggcaattgtcggtggtgtatttactgttttattctatgttcattttagaaacttgcacaagattatgggacaagaaagcaagttgagagccattatgatgcgtcaagaaaatgaaaaagaagtgctggaagtcaacaatttggccctgattacttcggtcccgtcagttgctgttaaacaaatataa

SEQ ID NO: 8330 - protein, 649 aa, Debaryomyces hansenii CBS767
MTSVKEINEKDPGKDEYSVDERAEHEVAETHLNANHDNASIVSKEEFEDEGIYDFDDSNNYSTTFVDDHNPMGLRKPTKQEASSLRRVLGRADWACYMICVAEFAERASYYSCQTLLSNFVTNPLPEGSGTGKLMPGSVNPGALGLGVPTATAITYTLTFVAYLVPLYAGYVADSQIGKFRAIWIGVICGFFAHILLVIAAIPAVIEGGNAIVPTAFGIITLAFGTGFIKPNLLPLLLDQYPEESDVVKLLPSGEKVIVDRQKSLERMVLVFYWSVNLGALFPIPSVYIEQRIGFWFAFFIPIIIYLIIPAVFWFVRPRLKKEKLQSSVMVNTNKILKVLFRGNWIKRIRNNTFWDYAAPTNMNARGEEYYSAKKKKPITWTDQWVLDVKQIVNISKVFLYFVIFNLCDAGGTGATPALTAQSGSLTSDGTPNDIYSSFNPITIIFLIPILDYGIYPLLRRWKIDFRPVLRITFGFLLAALSQVAAAVIQKEIYNQIECGDHATECVEKGIVAPFSAWVLVMPYILSAASECFANTSGYELGYTRAPPHLKGFVQALFLLATALAAAIGDAISPALKDPNLVWYFAALAIVGGVFTVLFYVHFRNLHKIMGQESKLRAIMMRQENEKEVLEVNNLALITSVPSVAVKQI

SEQ ID NO: 8331 - DNA, 1968 bp, Debaryomyces hansenii CBS767
  CDS (1)..(1968)
atgggaagtatgatcagtattagccaagatagagagaaagactcagacaaggccaagtacaaagtcaatggaaagactcagggggagattgaggaggctcgtctcaatgctgttaacgaagatgatacgaacgactcgaagacatcaagcgacgaatttgaagatgaggatatctacgattttgatgacagtaacaattattcaacgaactttgtcgatgaacacaatcctatggggttgagaagacctactaaacaagaatcgtcttcattaagaagagtgttgggtagagctgactggatttgctatttgctttgtgtagccgaatttgctgaaagagcttcttactactcatgccagactctcttgagtaactttgttactaacaaattgcccgagggtagcagtaccggtaagcttatgcctggtagtgttaatcctggtgctttaggcttgggtgtgccaactgcaaccgccattacctatacgttgacattcgtggcttatgttgtaccattatatgctggttatgtcgctgatgctcagattggtaagtttaaagcgatatggattggcgttatttgtggaatagttgctcatgttttacttgttgtagctgccgctcctgctgttattgctggagggcatgctattgttccaactgcattgggtgtcatcatgttagcatttggaactggtttcatcaaacctaatttgctaccactcttgatggatcaataccctgagctgacagatgtgattaaagttttgccttctggagaatcggtgatagttgaccgtcaaaagtcgttggaaaggatgacgttagtattctattggtccatcaatgtcggcgctcttttcccaattccaagtgtttacatcgaaagaagaattggattttggttcgcctttttcattccgatcattatatttctcattattccttttgtcttttggttcgtacatcccaaacttaaaaaggaggagcttcaaggctctgttcttgtaaacactaacaaaatcttgagagttctgtttagaggaaactggcttaagaggttgaagcaaaggaccttttgggattatgcgactccaactaacatgagggcgagaggcgaaggatactttaatataaagaaaaagaagccgatcacttggactgaccaatgggtgttagatgtcaagcaaattgttaatatttgtaaagtttttttgtacttcgtagtattcaatctttgtgatgctagtagtagtggagcaacaccagcattaacggcacagtcaggatctatgacgagtgatggaacacctaacgatatgtacagtaatttcagtgcaatgtcgatcgttgcacttataccaatattggattacggtatttatcctttattgcgtaaatggaaaatcaacttttggccttcatggagaatcactcttggttttctcttggctgctttgacccaggcagcagctgcaattattcaaaaagaaatttataacacaattgaatgtggagagcatgccacagaatgtgtagaaaacggaatcgtagcaccgattaatgcctgggtcctggtgacaccatatattttatctgctgcaggtgaatgttttgctaacacttccgcttatgaattgggttatactagagctccatctcacatgaaaggcttcgtccaggcattgttcttattttcaactggtatagctgcagcgatagctgatgctatcagccctgctttgaaagatccaaacttggtttggtattttgcagcattagcaattgtcggtggtgtatttactgttcttttctttattcattttagaaacttgcataagactatggaacacgaaagcaagataagagccatattgatgcgtaaacaggagggtgaaataactctcgaactcaacaacatggaactggtcacgtcgaccacatgtgttgctgttaagcaattgtga

SEQ ID NO: 8332 - protein, 655 aa, Debaryomyces hansenii CBS767
MGSMISISQDREKDSDKAKYKVNGKTQGEIEEARLNAVNEDDTNDSKTSSDEFEDEDIYDFDDSNNYSTNFVDEHNPMGLRRPTKQESSSLRRVLGRADWICYLLCVAEFAERASYYSCQTLLSNFVTNKLPEGSSTGKLMPGSVNPGALGLGVPTATAITYTLTFVAYVVPLYAGYVADAQIGKFKAIWIGVICGIVAHVLLVVAAAPAVIAGGHAIVPTALGVIMLAFGTGFIKPNLLPLLMDQYPELTDVIKVLPSGESVIVDRQKSLERMTLVFYWSINVGALFPIPSVYIERRIGFWFAFFIPIIIFLIIPFVFWFVHPKLKKEELQGSVLVNTNKILRVLFRGNWLKRLKQRTFWDYATPTNMRARGEGYFNIKKKKPITWTDQWVLDVKQIVNICKVFLYFVVFNLCDASSSGATPALTAQSGSMTSDGTPNDMYSNFSAMSIVALIPILDYGIYPLLRKWKINFWPSWRITLGFLLAALTQAAAAIIQKEIYNTIECGEHATECVENGIVAPINAWVLVTPYILSAAGECFANTSAYELGYTRAPSHMKGFVQALFLFSTGIAAAIADAISPALKDPNLVWYFAALAIVGGVFTVLFFIHFRNLHKTMEHESKIRAILMRKQEGEITLELNNMELVTSTTCVAVKQL

SEQ ID NO: 8333 - DNA, 1737 bp, Debaryomyces hansenii CBS767
  CDS (1)..(1737)
atgagtgaacatgccaccgaaaagatcgttgataccgacctggttgaaaagaaacatgagacagcccttgtaaaagaaaatagtgaaaccaacgaagatcaattatcttctccagttgacgaagatgaaggcagaaccccaaccaacgaagaaatgaagaccttaagacatgtgtcggaaaaaattcctataaggtgttggcttgtggctattgttgaattggcagaaagattctcttactatggtttgagtgctccatttcaaaattatatgcaatatgacaagccaaagggtatgttaaatttgagccaacaaggtgctactgctttatcttactttttccagttctggtgttacgttacaccagtccttggtgcttgggttgctgatacatactggggtaagttaaatactattattgctttctctcttttctacactgttggtattttaattttattcgtcacttccctcccatcaatgagtgaaaccacagcattgggtggatttattgttgcgattattattatcggtattggtaccggtggtgttaaatccaacgtttccccattaattgctgatcaggttccaaagactttaccagttatcaaagttttgaagtctggtgaacgtgtagttcaagatccaaatgttacaattcaaaatgtcttcatgtatttctaccttatgattaatattggttcattatccgtcattgctactacggaattagaatacaatgtcggcttctgggcggcatacttattaccattctgcttcttcttcattgctatcggagctttaataattggtagaaagcaatatgtccaattacctgtttctgagaaggttatcgcaaaatctttcaaaatctcttttatcggtttaaagaataagttcaacttagatgttgctaaaccttccgtttccccagaaatggattacccatggagtgataaatttgtcgaagaagtcaagagagctttctatgcttgtaaggttttcgccttctatccactttattgggttgtttacgggcaaatgcttaataacttcgtttctcaagctgctcaaatggaaacacacaacttaccaaacgatattttgcaagctatcaattccattgcaattattatcttcattccagtctgtgaaagacttgtctaccctttcattagaagattcacccccttcaaagccatcactaaaattactatgggttacatgtttgctaccggtgctatggtttacgctgccgttttacagcattatatttactccagtggcccttgttacgatgaaccattaaaatgtgccggttacgaaggtgtcccaaaccatgttcatgttgccatccaagccccagcttatttcttgattgccatgtctgaaattttcgcatccattaccggtttagaatacgcatacactaaggctccggtttccatgaagtctttcattacgtcattgttcttacttaccaatgccattggttctgctatcggtattgctttatcttctacttctgaagaccctaaattggtctggaactacactggtttagccgtatcttgtttccttgctggtaccgcattctggttcaccttcaagcattacaactacagagaagatgaattgaatagcttagattacgttgacgacaacggtattccaaacaacaatcgtgatcttcaaccgatcacttcctttgccttttccggtaaaagtattgcataa

SEQ ID NO: 8334 - protein, 578 aa, Debaryomyces hansenii CBS767
MSEHATEKIVDTDLVEKKHETALVKENSETNEDQLSSPVDEDEGRTPTNEEMKTLRHVSEKIPIRCWLVAIVELAERFSYYGLSAPFQNYMQYDKPKGMLNLSQQGATALSYFFQFWCYVTPVLGAWVADTYWGKLNTIIAFSLFYTVGILILFVTSLPSMSETTALGGFIVAIIIIGIGTGGVKSNVSPLIADQVPKTLPVIKVLKSGERVVQDPNVTIQNVFMYFYLMINIGSLSVIATTELEYNVGFWAAYLLPFCFFFIAIGALIIGRKQYVQLPVSEKVIAKSFKISFIGLKNKFNLDVAKPSVSPEMDYPWSDKFVEEVKRAFYACKVFAFYPLYWVVYGQMLNNFVSQAAQMETHNLPNDILQAINSIAIIIFIPVCERLVYPFIRRFTPFKAITKITMGYMFATGAMVYAAVLQHYIYSSGPCYDEPLKCAGYEGVPNHVHVAIQAPAYFLIAMSEIFASITGLEYAYTKAPVSMKSFITSLFLLTNAIGSAIGIALSSTSEDPKLVWNYTGLAVSCFLAGTAFWFTFKHYNYREDELNSLDYVDDNGIPNNNRDLQPITSFAFSGKSIA

SEQ ID NO: 8335 - DNA, 1719 bp, Yarrowia lipolytica CLIB122
  CDS (1)..(1719)
atgtccaaacacctggctctagagagagtccgagccagtatggactctactcgaaccccaactccttctcgacctgcatctatcctgaccaaagaaaaaggcgaagacatcatcgtcgaagtcaccgacagctgctcagtccaagaggtgtactccgaatggggtgcctacacggacgaacataaccctgagggtctcagaaccgccacagattccgacaaggatctcagacacattgctggaccggttggaaaaatgacctacctcttgtcaattgtcgagtttgccgaacgtggctcctactacggcctagtcaatgtcatctcaaactacgtccagtttccctttcctgagggagggaacggatggggagcttcaccagtaggcactcagctgactcccggagctctagggaagggtctccaaattgccaccgtcgtcactctcgttttgcagtttctctcctacgtggctcctctctggggagcctggcttgccgacgcccgatacggacgattcaacaccatctgggccggcaccattgtgtgtggagtgggtcacgtgataattgtgattgctggcttccccggtattatcgaacacaccaacgcgtctttcggtgtcttcatggtcggcctgttggtctttgctatcggaactggtctgttcaaacccaacattctacctctgctgctggaccagtaccgagaaaaggcaaattgggtaaagaagctgccttctggcgaagaagtagtcattgacagagatgctactctgcaaagaatgaccctggtctactattggggcatcaacattggggtcactctgggtattgctacagcctactctgagaaaagggttggtttctggctcgcctttctcatccccaccatcctctactttctcttgcctcctcttctttggtacgttcgaaaggatgtctacaaggtccctcccagcagaagttctgttctcagtggcttttacggagtcttgtatcaaagaattatgcgcaagccacccacctactccgaggaatttgtctttgacgtcaattccactcttaaggcctgcagattcttcctcttcttccccatgtactggatcaacgacgagggtattggagccttgttcaattctcagggtgcttccatgctcaccaatggcgtgcccaacgatctcctcaacaacttcaatcccattaccatcattgtatgcatccctattgtcgattatatcatctaccccacgctccgacggctgaaaatcaacttccgagcctctttccgcatgtttctgggcttcatgctggctgctgcctcttccggggctggtgcaatcattcaatggcgtgtttacgaaacgtctccttgtggatattatgccacagagtgtcccgagggggtgtctcatatcaccatctggtggcaggtggttccctactttttggctgctgtctctgagatctttgcagtgatcacctcttacgagctggcttactccctgtctcctgctggtctcgaatccgtggtcatgtcgctgctgctgtccatgtcagccgtctctactgccatcaagaccgccatcactcctgctctcaaggaccctgatctcatctggccctttgtaggaattgcctgcggaggagttggctttgccgtagtgttcttgatctgtttctggcgtctaggaaaggaccaagtgagaccgttaacttag

SEQ ID NO: 8336 - protein, 572 aa, Yarrowia lipolytica CLIB122
MSKHLALERVRASMDSTRTPTPSRPASILTKEKGEDIIVEVTDSCSVQEVYSEWGAYTDEHNPEGLRTATDSDKDLRHIAGPVGKMTYLLSIVEFAERGSYYGLVNVISNYVQFPFPEGGNGWGASPVGTQLTPGALGKGLQIATVVTLVLQFLSYVAPLWGAWLADARYGRFNTIWAGTIVCGVGHVIIVIAGFPGIIEHTNASFGVFMVGLLVFAIGTGLFKPNILPLLLDQYREKANWVKKLPSGEEVVIDRDATLQRMTLVYYWGINIGVTLGIATAYSEKRVGFWLAFLIPTILYFLLPPLLWYVRKDVYKVPPSRSSVLSGFYGVLYQRIMRKPPTYSEEFVFDVNSTLKACRFFLFFPMYWINDEGIGALFNSQGASMLTNGVPNDLLNNFNPITIIVCIPIVDYIIYPTLRRLKINFRASFRMFLGFMLAAASSGAGAIIQWRVYETSPCGYYATECPEGVSHITIWWQVVPYFLAAVSEIFAVITSYELAYSLSPAGLESVVMSLLLSMSAVSTAIKTAITPALKDPDLIWPFVGIACGGVGFAVVFLICFWRLGKDQVRPLT

SEQ ID NO: 8337 - DNA, 1683 bp, Yarrowia lipolytica CLIB122
  CDS (1)..(1683)
atgaagccttctccctctacaagatcagttgaaaagaagaccagcgggatcgacccgtcaatcgacaaagacgaggggctcgtggagtactcggaagttgtcattgggggatacagcgagacatggtctggttactcggatgaatacaaccgggccggactccggattgccacagacgaagactgccatacacttcgaaaagtcgctgctcccatcacgggaatgacctacatgttgtctctggtggagtttgccgaacgaggttcgtattacggactcaccaacgtcatctccaactttgtacagtttcctctccccaagggcggaaacggatggggagccactccgagaggttctcagctgacggccggggccctggatcagggtcttcaagtggccacggctctcactcttgttctcaactttttgtcctatctgacccctctgctgggagcctacttggccgactccaagtacgggcgattccgcacaatctgggccggaacagttatctgcggtattggacacactgtgattgtgattgccgccatcccgggggttctcgagcaccaaaaggcatctctaggggtctttatcgtcgggcttatcatctttgcattcggcacggggctcttcaaaccaaacttgctgccacttcttctggaacagtaccgagaagacgacaactgggtcaagcgtctcccaagtggggaggaggtggtcatcgacaaagaatccaccctgcaaagaatgaccctggtctactactggtccatcaacgtgggggcgtttctcggtctaggaacttcctacgccgagaaacgtatcgggttctggctcgcctttctggttcccacaattctctacttttttctgcccttcttcctcttcctcattcaaaacagagtctacaagatcccacctacagaggactccatcattgcgggcttctttggagtcatgtaccagacgatactccggaaaccctccacgtacccagacaagtttgtggccgacgtgtggtccaccctcaaagcctcccgcttctttctcttctttcccatctactttctcaatgataccggcataggagccctctccaactcccagggaagctccatgatcaccaacggagttccaaacgaccttctcaacaacttcaaccccatcaccatcatcgtagccatccccatggtcaactacggcctgtatccactgctgagacgctacaagatcaacttccgagcctcgctgagaatcttcttggggttcatactaggcgcctgctcaccaatgatcggagccatcctccagtggagaatctacgaaacctccccctgtggataccatgctaccggatgcaacaagggggtagccccaatcacaatctggtggcaggtgtttccgtacgtatgcactgctctgtcaggaatctttgccaccatcacttcatacgagttggcctactctctagctccgactcatatgcgatcaatcgtcatgtctctgcttctgttcatgtcggccttcagcaccgccatcgccacaggtatcactccggctctgagagatccatatcttatctggccctttgtaggtctgtcggctggaggaggagcatttgcagtggcatttctgtgctgctactggaggctcggagagggtcagaagttgtccgtgtaa

SEQ ID NO: 8338 - protein, 560 aa, Yarrowia lipolytica CLIB122
MKPSPSTRSVEKKTSGIDPSIDKDEGLVEYSEVVIGGYSETWSGYSDEYNRAGLRIATDEDCHTLRKVAAPITGMTYMLSLVEFAERGSYYGLTNVISNFVQFPLPKGGNGWGATPRGSQLTAGALDQGLQVATALTLVLNFLSYLTPLLGAYLADSKYGRFRTIWAGTVICGIGHTVIVIAAIPGVLEHQKASLGVFIVGLIIFAFGTGLFKPNLLPLLLEQYREDDNWVKRLPSGEEVVIDKESTLQRMTLVYYWSINVGAFLGLGTSYAEKRIGFWLAFLVPTILYFFLPFFLFLIQNRVYKIPPTEDSIIAGFFGVMYQTILRKPSTYPDKFVADVWSTLKASRFFLFFPIYFLNDTGIGALSNSQGSSMITNGVPNDLLNNFNPITIIVAIPMVNYGLYPLLRRYKINFRASLRIFLGFILGACSPMIGAILQWRIYETSPCGYHATGCNKGVAPITIWWQVFPYVCTALSGIFATITSYELAYSLAPTHMRSIVMSLLLFMSAFSTAIATGITPALRDPYLIWPFVGLSAGGGAFAVAFLCCYWRLGEGQKLSV

SEQ ID NO: 8339 - DNA, 1848 bp, Yarrowia lipolytica CLIB122
  CDS (1)..(1848)
atggaaaagaacaatcagggcgagatcgtcgagcccgtgtacaccgccaccaacaccgagcttggatcggtaaaccagctggccgaggaggtggttgagactgaacgagtgccttcttacgactcggatatcgacactaaacatgaggtttccaccaccatcaacgccctgggccccgagcccaccgaggaggagatgctgactctccgacgagtgtccgactcgctccccaaggctgcctggatggtggctgtggtcgagctgggtgagcgattcacctactacggtatcaccggtcctttccagaactacatgcagcgaaagcgaggctttggcgcgcacgccggtgctcttgatctcggtcagtccaccgcctctgctctgtcctactttttccagttctggtgttacgtgactcccattctcggagccatcatcgccgacacctggtggggaaagtacaagaccctgtttgtcttctccctcatctacgtcactggtaacctgattctgtttgtcacttctctgccctcgtctctggacgccggagccggtctcggaggtctggtcaccgccatgattgtcattggtctcggaactggaggtatcaaatctaacgtgtctcctctcatttccgagcagtacaccaacaccaagttctacattcgaactctcaagtctggcgagcgagttgtcgtcgaccccaaccagaccattcagtccattttcatggtcttctacatgtgcattaacgtcggctctctgtccgccattgcaaccacaaacctggagcgatacgtcgacttctgggctgcctacctgctgccctttgccttcttcttcattgcaattgctgctctggtcctcggcaacaagtactacgtcaagcgacctcctatgggctctgttattccccaggccttccgagtcgtctttgctgctgccaagaagaagtccttcgatgctgccaaaccctcttaccgacaggagaacggcgagagcgaggttccctggaccgatctctttgttgacgaggtccgacgagctttcattgcctgcaaggtcttcgtcatctaccccatctactgggttgtgtacggccagatgcttaacaacttcgtgtcccaagccggccagatgcagacccacggtatccccaacgatatcatgcagaacattgaccccattgccatcattatcttcattcccatcatggagaagctcgtctaccccggtcttcgacgagttggtatcaagatgcgacccattacccgaatcactctcggtttcttcttcgcttcttgtgccatggcctacgctgccattgtccagaagatcatctactctgccggtccttgttacgacgctcccggtgcctgtcccgcagctcttctgcccgacggagagaactacgctcccaataatgtccacgttgccgtccagactcccgcctacgccttcattgctctgtcggagattttcgcctctatcaccggtctggagtacgcctacaccaaggctcctacttccatgaagtccttcatcatgtccatcttcctcttcaccaacgccattggtgctgccatcggtattgctctgtcccctaccgccaaggaccccaagctcatctggacctacaccggtcttgccggagccacctttgttgctggatggattgtctggttcggataccgacatcttaacaaggtggaagacgagctcaacgtcattgacgccgagtacaccgctgagctcaacgccactctgatgcatgataaggagaaggctgatctggagcgagcccacaagaccgccattgtcgacgagggtgtggagaaggttttctaa

SEQ ID NO: 8340 - protein, 615 aa, Yarrowia lipolytica CLIB122
MEKNNQGEIVEPVYTATNTELGSVNQLAEEVVETERVPSYDSDIDTKHEVSTTINALGPEPTEEEMLTLRRVSDSLPKAAWMVAVVELGERFTYYGITGPFQNYMQRKRGFGAHAGALDLGQSTASALSYFFQFWCYVTPILGAIIADTWWGKYKTLFVFSLIYVTGNLILFVTSLPSSLDAGAGLGGLVTAMIVIGLGTGGIKSNVSPLISEQYTNTKFYIRTLKSGERVVVDPNQTIQSIFMVFYMCINVGSLSAIATTNLERYVDFWAAYLLPFAFFFIAIAALVLGNKYYVKRPPMGSVIPQAFRVVFAAAKKKSFDAAKPSYRQENGESEVPWTDLFVDEVRRAFIACKVFVIYPIYWVVYGQMLNNFVSQAGQMQTHGIPNDIMQNIDPIAIIIFIPIMEKLVYPGLRRVGIKMRPITRITLGFFFASCAMAYAAIVQKIIYSAGPCYDAPGACPAALLPDGENYAPNNVHVAVQTPAYAFIALSEIFASITGLEYAYTKAPTSMKSFIMSIFLFTNAIGAAIGIALSPTAKDPKLIWTYTGLAGATFVAGWIVWFGYRHLNKVEDELNVIDAEYTAELNATLMHDKEKADLERAHKTAIVDEGVEKVF

SEQ ID NO: 8341 - DNA, 2058 bp, Yarrowia lipolytica CLIB122
  CDS (1)..(2058)
atggagactccaagcctggcccagagcgattccagcggagtcagtctgttgcaactagctggagacattgaagagacgccgagagtaatgactattggcagtgccagagacacaaatcccaccgacacatgcgcagacgatgcccacagacccagcaccaacacatccactagccacccccaagacacccgctacaacagtaacctgcgacttgaaaccgccaacacagacagctacgtgagcgtttgtgatctcgacaactacggaacggcctccttgcgacactcgccttctcgtgacacaactctcgaccctacatacaccaccagacacgatattaccacggtcaccaccccccacactagccacacggaaacaagcccgctgctcaagaaacccacctccatgactaccgacgttgccgactcggaggaaggcgaaatcatctcgctcccagacctccccgaagacgtgccccacatctccgataaaatcccctactcggcctatctggtggcagtagtcgagctctgtgaacggttcacctactacggactctcgggtcccttccagaactacatccagaacccgcgggagggccgactacctggagccctcggcctgggccaacaaaaggccgtggctctcctctatgccttccagttctggtgctacctaacccccattttcggagctatcattgctgactcatactggggcaagtacaagacaattcttcggttcgccatcgtcaatgttattggcgtctttgtgctggtgatctcttctcttcccgtcaacattgacaacggatgggctctcccaggcctgctgctggccatggtcatcatcggactcggaacaggaggaatcaaggccaacgtgagtcctctgattggagagcagtaccgaaacgaaaagtacagactcgtctataccaagaacgagtctcaagccattatttcccctgtcgtcaccatccagtccatcttcatgatcttctactactgcatcaacattggctgcctggcccccatgattacatcttacgtggaaatgaaggtcgacttctgggctgcttatctcatccctggcgtctttttcttctttggaatggctgccctggttatgggaagaaacatgtactactgcgctcctgtcaagggaagtgttgttcccgatgccgtggctgtctcttggatgctcttcaaggagagaggcaacaaatgtgacactgagacaagcgctctcccacgggacaccgatgctgaatcttcctctcgtacctcccaagagtctctgctctcccaggaccttgaaacttcccccgagttcatctcctccgtcgacaccaccatctctcctcgagccatgtacgtttccaaggcctcgggcaacaagtattctgcttccttcgtgcaggatatcattgtcacgctcaaggcatgtcgggtattcctcttttaccccgtctactggcttgtttacggccagatgacatccaacttcattgctcaggctggtcagatgaatacctactccattcccaacgacattatgagcaacattgacccaatcaccctacttctgttcattcccattgttgagaagaagttatatccctggttgcgatctcgaggctactcgtttggtcctcttgctcgaatcttcactggcttcttgtgtgctgcattggccatggtctgggcctgtggagtgcaggtgtttatctaccgaggccaggcagacacaaagattgacgaggttggtgtggagaacctggtatctgtcttctggcaggtgcctgcatacattttcattgcattttccgagattttggcctccgtcactggtttggagtatgcattcttgaacgctcccaaaacgatgaaatcactggttatgagtgtcttccttgtcaccaatgctggtggttacgccatgggtattgtcattagtccgtggttcaaggacccctacatggtgacttgttacttctggattgccgcattgacgtttgccacaggagctctgttccgatactgcttcagggactga

SEQ ID NO: 8342 - protein, 685 aa, Yarrowia lipolytica CLIB122
METPSLAQSDSSGVSLLQLAGDIEETPRVMTIGSARDTNPTDTCADDAHRPSTNTSTSHPQDTRYNSNLRLETANTDSYVSVCDLDNYGTASLRHSPSRDTTLDPTYTTRHDITTVTTPHTSHTETSPLLKKPTSMTTDVADSEEGEIISLPDLPEDVPHISDKIPYSAYLVAVVELCERFTYYGLSGPFQNYIQNPREGRLPGALGLGQQKAVALLYAFQFWCYLTPIFGAIIADSYWGKYKTILRFAIVNVIGVFVLVISSLPVNIDNGWALPGLLLAMVIIGLGTGGIKANVSPLIGEQYRNEKYRLVYTKNESQAIISPVVTIQSIFMIFYYCINIGCLAPMITSYVEMKVDFWAAYLIPGVFFFFGMAALVMGRNMYYCAPVKGSVVPDAVAVSWMLFKERGNKCDTETSALPRDTDAESSSRTSQESLLSQDLETSPEFISSVDTTISPRAMYVSKASGNKYSASFVQDIIVTLKACRVFLFYPVYWLVYGQMTSNFIAQAGQMNTYSIPNDIMSNIDPITLLLFIPIVEKKLYPWLRSRGYSFGPLARIFTGFLCAALAMVWACGVQVFIYRGQADTKIDEVGVENLVSVFWQVPAYIFIAFSEILASVTGLEYAFLNAPKTMKSLVMSVFLVTNAGGYAMGIVISPWFKDPYMVTCYFWIAALTFATGALFRYCFRD

SEQ ID NO: 8343 - DNA, 1740 bp, Yarrowia lipolytica CLIB122
  CDS (1)..(1740)
atgactcaacatctaggagatcatctggaggaccacctggagccttccaaagaagacggtctttactacaaggacactgaccaaaagactacccactctatcgataaagacgacaaaaacgaaattgaattcaccgagattgaaaccacatcgatcatctcccagggatactctcagacatgggccacctacaccgatgaacataaccccgacgggctcagaattgccacagacgaagatcgagcgactctaagacgagtagctgctccaattggagccatgacttacatgctgtctcttgttgagttcgcagagcgaggctcgtactatggtctgaccaacgtcatttccaactttgtccagttccctctccctaagggcggaaatggctggggagccacacctgccggttctcagttgacagcgggagccctagatcagggtcttcaagtcgccacggctctgactctggttttgcagtttttatcctacttgacacctcttctaggagcctaccttgccgattccaaatatggacgtttcaagaccatctgggccggtacgatcatctgtggaattggccatattgtgattgtgattgccggaattcccggaatcatagagcaccagaaagctgctctaggaatctttattgctggactaatgatctttgcctttggaaccggtctcttcaagcccaacttgcttccactattgctggaacagtacagagaagacaacaactgggtgaagaagatgcccaatggagaactcgtggtgattgacaaagaatcgactcttcaacgaatgactctcgtctactactggtctatcaacgtgggagcttttcttggtctgggaactgcttatgccgaaaaaagaattggtttttggctcgcttttctggttcccactattctctacttcttcctccccctgtttctctggatcatcagaaacagggtttacaaggctcctgcttctgaagattctctcattgctggattcttaggagtcatctaccaaagactgttcaagaaggactccacatactccgagaagtttcaaactgacgtctgggccactctcaaagccacccgcttcttccttttctttccaatctactttatcaacgatggaggcattggagcactgtctaattctcagggtagttcaatgatcaccaatggagtccccaacgatcttctcaacaacttcaaccctctcacgattattgtggcagtaccgatagtcaactacggactatatcctctactgagacgctacaaaatcaactttcgggcctcgttccgaatctttttgggctttatgctggcagctttttctcccatgattggagctattcttcaatggagaatctacgagacttccccctgtggatactatgccacccaatgtgaagctggagtagctccaatcaccatctggtggcaagtcttcccttatgtctgtactgctttgtctgagatctttgccatcactacctcatacgaactagcttactctctggctccagaacatatgagatcacttgttatggcactgctactgtttatgtctgccttcagtacggctattcagacaggtctgactccggctttggtcgatccgcatctcatttggccgtttgtgggcatctcagcagcaggaggagccttcgccatcgcctttctcttttgctactggaacctcggaaaaggtcagaagttgtcagtctag

SEQ ID NO: 8344 - protein, 579 aa, Yarrowia lipolytica CLIB122
MTQHLGDHLEDHLEPSKEDGLYYKDTDQKTTHSIDKDDKNEIEFTEIETTSIISQGYSQTWATYTDEHNPDGLRIATDEDRATLRRVAAPIGAMTYMLSLVEFAERGSYYGLTNVISNFVQFPLPKGGNGWGATPAGSQLTAGALDQGLQVATALTLVLQFLSYLTPLLGAYLADSKYGRFKTIWAGTIICGIGHIVIVIAGIPGIIEHQKAALGIFIAGLMIFAFGTGLFKPNLLPLLLEQYREDNNWVKKMPNGELVVIDKESTLQRMTLVYYWSINVGAFLGLGTAYAEKRIGFWLAFLVPTILYFFLPLFLWIIRNRVYKAPASEDSLIAGFLGVIYQRLFKKDSTYSEKFQTDVWATLKATRFFLFFPIYFINDGGIGALSNSQGSSMITNGVPNDLLNNFNPLTIIVAVPIVNYGLYPLLRRYKINFRASFRIFLGFMLAAFSPMIGAILQWRIYETSPCGYYATQCEAGVAPITIWWQVFPYVCTALSEIFAITTSYELAYSLAPEHMRSLVMALLLFMSAFSTAIQTGLTPALVDPHLIWPFVGISAAGGAFAIAFLFCYWNLGKGQKLSV

SEQ ID NO: 8345 - DNA, 1818 bp, Yarrowia lipolytica CLIB122
  CDS (1)..(1818)
atgacttcacaccttggtgaccacctcgaggatcacctggagccatccagagatgacaatctctattatcatgaggaggaggaagctcccggttaccaggcatacacttctcaggcagattaccctgcgaagcctacctactctggaagtggttcatctcagcgacggttcgatgactataacacttctcttgagaagaaggaaggtgatatcgagttcaccgaagtcgttgatgagtctgaacactactcgcagaagtggtctacgtatactgacgagtataaccctgacgggctgcgggtcgcaacagatgaggagtgtatgactcttcgaaagatcgctgctccgatctctgccatgacttacatgctgtctctagtcgagtttgccgaacgaggttcctattatgggctaaccaacgtcatctccaactttgttcaattccctttgcctcccggaggaaacggctggggtgctacacccaaagactctcagtccaccgctggtgctctcaaccagggactccaggttgctactgctctcactcttgttctccaatttctgtcctacctcactccccttcttggtgcttaccttgcagattcaaagtacgggcgtttccccacaatttgggccggtaccatcgtttgtggagttggtcatgtcatcattgttatttccggtatccccggtgttcttgaacaccagaaggcctcattaggcgtgtttatcgctgggttgatcatctttgcttttggaacaggtctattcaagcctaatttgttgcctctccttctggaacagtaccgagaagatgataactgggtcaagaagctcaagagtggtgaggaggttgttatcgacaaagagtccaccctccagcgaatgaccctggtctactactggtccattaacgtcggaggattccttggtttgggtactgcctacgctgagaagcgaatcggctactggctcgcatttctggtccccactatcctctacttcttccttcccttcttcctctttattatccgaaaccgggtttataaggctccttctagcgaggactccatcatcgccggttttgtcggtgttatgtggcagtggctcttcagaaagccttctacttactcggagaagttcgtggctgatgtctggaccaccctcaaggctacccgtttcttccttttcttccccatctacttcatcaatgacaacggcattggagctctttccaactcacagggaagttcgatgatcacgaatggtgttccgaacgatctgctcaacaacttcaatcccatcaccattatcgtggcggtgcctatcgtcaactatatcctgtatcctctgctgcgtcgatacagaatcaacttccgcgcttcgtttcgaatcttcctgggtttcatgctggcagctttctctcccatgattggagccattctgcagtggcgaatctatgaaacttctccttgtggatactacgcaacagattgtgacaagggtgttgctcccatcaccatctggtggcaggtcttcccctatttctgcacagcgctatctgaaatctttgccgtcactacctcctacgagctggcctactcccttgcgcctgcccatctgcgatctattgtcctcgctctgctgctcttcatgtcggctttcagcaccgccattcagaccggtatcactccggcgctggttgatccccatctgatttggccgtttgtgggcatttcagtggcgggtgcagcctttgccattgcattcttgtgttgttactggcgtctcggaaagggccaggaggtttctgtctaa

SEQ ID NO: 8346 - protein, 605 aa, Yarrowia lipolytica CLIB122
MTSHLGDHLEDHLEPSRDDNLYYHEEEEAPGYQAYTSQADYPAKPTYSGSGSSQRRFDDYNTSLEKKEGDIEFTEVVDESEHYSQKWSTYTDEYNPDGLRVATDEECMTLRKIAAPISAMTYMLSLVEFAERGSYYGLTNVISNFVQFPLPPGGNGWGATPKDSQSTAGALNQGLQVATALTLVLQFLSYLTPLLGAYLADSKYGRFPTIWAGTIVCGVGHVIIVISGIPGVLEHQKASLGVFIAGLIIFAFGTGLFKPNLLPLLLEQYREDDNWVKKLKSGEEVVIDKESTLQRMTLVYYWSINVGGFLGLGTAYAEKRIGYWLAFLVPTILYFFLPFFLFIIRNRVYKAPSSEDSIIAGFVGVMWQWLFRKPSTYSEKFVADVWTTLKATRFFLFFPIYFINDNGIGALSNSQGSSMITNGVPNDLLNNFNPITIIVAVPIVNYILYPLLRRYRINFRASFRIFLGFMLAAFSPMIGAILQWRIYETSPCGYYATDCDKGVAPITIWWQVFPYFCTALSEIFAVTTSYELAYSLAPAHLRSIVLALLLFMSAFSTAIQTGITPALVDPHLIWPFVGISVAGAAFAIAFLCCYWRLGKGQEVSV

SEQ ID NO: 8347 - DNA, 1875 bp, Yarrowia lipolytica CLIB122
  CDS (1)..(1875)
atgacctacgacgacaaggacgacaacttcaaagctaccatgtacccttcacagggggagtacctttctgaggttgagcaagttgagtacaatcctcaggttgagtacgactcccatattgactacagtctggaccccactccggagtttcccgaaaatgggactctcaaggacgctctcaaggacacactagctacgaccacctctgtcaatgacgagtcagtccgagagggaagcgttgaccccaataatgagaaggatggaatcgactacgagtatgaggagatctatatggagcacgagcattactctcacacttgggccaactacaccgacgagtggaatcctaatgggttgagaaaggttgaggatggagatatcgcactccgaagagtctctggaccagttccaaagattacctacgttttggcacttgtggagtttgccgaacgaggctcttactacggtcttacaaacgtcatctccaactttgttcagtttcctcttccaaaggggggcaatggctggggagctaccccgaaggactctcagcttacagctggagctctcaaccagggtcttcaagtagccacggctattactcttgttctcaatttcctttcctacctgacacctcttcttggtgcttatcttgcggatgccagatacggacgataccccactatttgggcaggaactattgtttgtggaattggacacgttattatcgttattgctggtgttcctggagtgattgaagcccaaaaggcttctctgggtctattcattgcgggtctgattatcttcgcgtttggaaccggtctgttcaagcccaacttgcttccgttagtgatggaacagtatcgagaagacgatgattgggtcaagacacttccatctggggaacaagtggtgataaacaaggagaccactctgcagagaatgaccctggtttactactgggctgtcaatgtcggtggtttcctcggtctgggcactgcttatgctgagaaacgaattggttactggctcgcctttctcgtacctactatcctctacttcttcctacctgctcttctctacatcatccgaaacatggtgtacaaggtcccgtcctctaaaaactccatcattgctggcttctgtggtgtcatttaccagtacattttccgcaagaagtccacctatcctcccaagtttgtgcacgatgtctggtccactcttaaagccactatgttctttctcttctaccccgtctactttattaacgacaacggtattggtgccctttcgaactcccagggtgcttccatgatcaccaacggagtgcccaatgatctcattaacaacttcaacccgttaactatcattgtgtttgtgcctatcatcaactatggattgtatccgctgcttcgaaagatgagaatcaacttcagagcttccttccgtatcttcctgggattcatgctcgcggctttttctccaatgattggagctatcctgcagtggcagatatacgagacatctccttgtggatactacgcgaccaattgcgaggaaggtgtagccccaattacaatctggtggcaggtgttcccctacttctgtacagcactgtctgaaatttttgcagtaactacttcttatgagctggcctaccatctggctccctacaagttgagatccatcgtccttgctctgctgctgttcatgtctgcactcagtacagcaatccagacaggtatcacacctgctcttaaggatccatacctcatctggccatttgtgggtatctgttgtgccggtgttgtttttgcaattgctttcatcatcatctactggaaactcggaaagggattgtccaccaagctatag

SEQ ID NO: 8348 - protein, 624 aa, Yarrowia lipolytica CLIB122
MTYDDKDDNFKATMYPSQGEYLSEVEQVEYNPQVEYDSHIDYSLDPTPEFPENGTLKDALKDTLATTTSVNDESVREGSVDPNNEKDGIDYEYEEIYMEHEHYSHTWANYTDEWNPNGLRKVEDGDIALRRVSGPVPKITYVLALVEFAERGSYYGLTNVISNFVQFPLPKGGNGWGATPKDSQLTAGALNQGLQVATAITLVLNFLSYLTPLLGAYLADARYGRYPTIWAGTIVCGIGHVIIVIAGVPGVIEAQKASLGLFIAGLIIFAFGTGLFKPNLLPLVMEQYREDDDWVKTLPSGEQVVINKETTLQRMTLVYYWAVNVGGFLGLGTAYAEKRIGYWLAFLVPTILYFFLPALLYIIRNMVYKVPSSKNSIIAGFCGVIYQYIFRKKSTYPPKFVHDVWSTLKATMFFLFYPVYFINDNGIGALSNSQGASMITNGVPNDLINNFNPLTIIVFVPIINYGLYPLLRKMRINFRASFRIFLGFMLAAFSPMIGAILQWQIYETSPCGYYATNCEEGVAPITIWWQVFPYFCTALSEIFAVTTSYELAYHLAPYKLRSIVLALLLFMSALSTAIQTGITPALKDPYLIWPFVGICCAGVVFAIAFIIIYWKLGKGLSTKL

SEQ ID NO: 8349 - DNA, 1806 bp, Aspergillus nidulans FGSC A4
  CDS (1)..(1806)
atgggctcctctaaccccaagaactcgtcagatatggcagacagcactttcaaacactccgtcgagatgcagacgggaaaggctgcgactatttctacttcttccatcagacacggccgcgagtatccgactgagcaggagctgaacaccctccgtcgtgtttctggaaaggttcgctggaccgcatacaccattgccttcgtggaactatgcgagcgattctcttatcatggaaccactgccgtcttcaccaacttcatccagcagcctctaccccccaactccaccactggcgctggtttcagtggtcagtccggagctctgggccatggccagcgtgcatcgaccgggttgaacaccttcaataccttctggtgttatctgatgccgatcctgggagcatggatcgcagatgaattcttgggccgtcttagaaccatccagatctcgattgcatttgccatgtttggtcacatcctcctaatcatatctgcactcccacctgtcatcgcccacgctcacggcgctctgacgatcttttccatcggccttgttatcttcggcattggtgttgggggtttcaaatcgaatattgccccgttgattgcagagcagcatagaggcaatcgtccgtacatcaaggccgaccctgtgaccggcgaacgatatatagtggacccagcgcagaccgtctccagagtcttcatgtacttctatttcatgatcaatgtcggcgctctaatcggctcgatttccatggtctatgcggagaaatacattgggttttggctgtcctttcttcttccaaccgtcatgtttgcattttgtccaatggttctgttcatctgccggcacaagtacaacactacgccaccaactggttcggttgtaggcaaagcgtttagactgtgggctttcgcaatgaagccgcattggacctggaatcctgttagacttaatctccgccacagaccatcctggatgacctttgacgaccaatgggtcgatgaagttcgtagggccgtcaaagcatgcggcgtctttgcctggtaccccatttactgtccgtccatcataggttctcaatggaaaaacaggctgctgactcttctgtgcaacatagggcttgcctacggccaaatgaccagcaacctaatatcacaagccgccacaatggaactcaacggtgtgcccaacgatataatcaataacctcgatcctctcgcactcataattttcatcccagtcatggaccaatttgtctatccgttcattcgcaagctcggttttaacttcacacccttgaagcgcatctacgcagggtacatggtcgcctctttttccatgatcacagccacagtaactcagcattatatttatgtccgcagcccgtgccataacagggcttcctcttgcgacgagccagcccccataagcgtctggtggcagacgatcccgtacgtgctcatcgcgctatcggaaatattcacctcgatatccggctacgagtacgcgtacacaaaggcgccgcgcaacatgaagagtattgtacaaagcttgtacctcttcacgaacgcggtaagtgccgcgatccagcagggactgacgagtttgagtgcggatccgttgttgaagtggaactacggcttcattgcggtattagcgttctttgggggccatcttttctggtatacacattggcggctggatcgggaagaagattatttaaatcacttggagccgtcaagttttctgggacggggttctgggaggaagaagcgccaggatgcggacttggagaagtag

SEQ ID NO: 8350 - protein, 601 aa, Aspergillus nidulans FGSC A4
MGSSNPKNSSDMADSTFKHSVEMQTGKAATISTSSIRHGREYPTEQELNTLRRVSGKVRWTAYTIAFVELCERFSYHGTTAVFTNFIQQPLPPNSTTGAGFSGQSGALGHGQRASTGLNTFNTFWCYLMPILGAWIADEFLGRLRTIQISIAFAMFGHILLIISALPPVIAHAHGALTIFSIGLVIFGIGVGGFKSNIAPLIAEQHRGNRPYIKADPVTGERYIVDPAQTVSRVFMYFYFMINVGALIGSISMVYAEKYIGFWLSFLLPTVMFAFCPMVLFICRHKYNTTPPTGSVVGKAFRLWAFAMKPHWTWNPVRLNLRHRPSWMTFDDQWVDEVRRAVKACGVFAWYPIYCPSIIGSQWKNRLLTLLCNIGLAYGQMTSNLISQAATMELNGVPNDIINNLDPLALIIFIPVMDQFVYPFIRKLGFNFTPLKRIYAGYMVASFSMITATVTQHYIYVRSPCHNRASSCDEPAPISVWWQTIPYVLIALSEIFTSISGYEYAYTKAPRNMKSIVQSLYLFTNAVSAAIQQGLTSLSADPLLKWNYGFIAVLAFFGGHLFWYTHWRLDREEDYLNHLEPSSFLGRGSGRKKRQDADLEK

SEQ ID NO: 8351 - DNA, 1764 bp, Aspergillus nidulans FGSC A4
  CDS (1)..(1764)
atggctgccgtagagcatggtatcgaggccaccctcccggctctcgctaccgatactcccgttacaactggtcctgtggctggacaggataaagttgtcggccagtctgagaaagcccttactgacactcccgacggggaagaaccgaacgaccacgagaacaagactctgcgtcatgttgccgaaaaccttccactttccgcttggctagttgctattgtcgagctgtgtgagcgtttcacatactatggcatgtctggattattccaaaactacgttcagcgtccctataacggtggtgcgcaaccccctggtgcgctcggtatggggcaccagggagctaccggattggttaccttcttccagttctggtgttacgtgacacctatcattggtgcgatcattgccgaccagtatctcggcaaatacaagaccatcgtcctcttttgcggcgtctacctcgttggtctgctgatcctcgtctgcacgtcgattccaaccgcccttgaacatggagctgggcttggaggctttatcgttgccattctcattatcggtttgggcaccggtggaatcaagagtaacgttgctccattgattgcggaccagtacaagcgcaagaaaatggctgtctcaactaccaaaaagggcgaaaaagtcatcatcgacccggcgcttacgattcaacgcatttacatgatcttctacggctgcatcaacatcggttcgctttcgctgctggctaccccttacatggaaaagtacacgggattctggtcggcttacctgctgtgcctttgcatgttcgccgttggcacggccgttatcgtcttgggacgcaagtactatgttgtccgtcctccacaagggtctgtcattaccgacgcattcaaagctctctggatcatggttgtcaaccgcaacatggatgcacccaagcctacatggcaggctgcaaacggtggaggcagaaccaacctgccctgggacgatcactttgtcgacgagctgaagcgcgcccttgtcgcttgccgcgtcttcgccttctatccgatctactgggtcgtctatggtcagttctcgagcaactttgtcagtcaggctgctcagatgcaggggcacggcatccctaacgacttgatgcaaaactttgatccgatttccatcattgtgttcatccccgttctggaatccctggtataccccgttctacgtcgcatgcgcatccggttccgcccaatctcccgtatctcgctcggcttcgttgttgcttccctggccatgatgtacgctgctatcgttcagcatttaatctactcggctggcccctgttacgagcagcctctttgtgatgcttccattggttccgatggttcgacctcaggcaacaacgtccacattgctatccagacgcccgcctacttcttcatcggtatttctgagatcttcgcgtcggtttctggtctggagtacgcatacacaaaggcgccgccatccatgaagtctttcgtgcagtctatgtacctcttgactaatgcctttggctctgcccttgccgaggccttgacgcccgctgcatttgaccctgctattatgtggatgttcgttgggttggccatcgcatcgtttgttaccggtattctcttctacatcatctaccacccgcttaatgcccaagaagatgctatgaacgctcttgatgccgacgaccccgatgttccggttccgcgtatctccgatgagaagaagaaggaagaaaactag

SEQ ID NO: 8352 - protein, 587 aa, Aspergillus nidulans FGSC A4
MAAVEHGIEATLPALATDTPVTTGPVAGQDKVVGQSEKALTDTPDGEEPNDHENKTLRHVAENLPLSAWLVAIVELCERFTYYGMSGLFQNYVQRPYNGGAQPPGALGMGHQGATGLVTFFQFWCYVTPIIGAIIADQYLGKYKTIVLFCGVYLVGLLILVCTSIPTALEHGAGLGGFIVAILIIGLGTGGIKSNVAPLIADQYKRKKMAVSTTKKGEKVIIDPALTIQRIYMIFYGCINIGSLSLLATPYMEKYTGFWSAYLLCLCMFAVGTAVIVLGRKYYVVRPPQGSVITDAFKALWIMVVNRNMDAPKPTWQAANGGGRTNLPWDDHFVDELKRALVACRVFAFYPIYWVVYGQFSSNFVSQAAQMQGHGIPNDLMQNFDPISIIVFIPVLESLVYPVLRRMRIRFRPISRISLGFVVASLAMMYAAIVQHLIYSAGPCYEQPLCDASIGSDGSTSGNNVHIAIQTPAYFFIGISEIFASVSGLEYAYTKAPPSMKSFVQSMYLLTNAFGSALAEALTPAAFDPAIMWMFVGLAIASFVTGILFYIIYHPLNAQEDAMNALDADDPDVPVPRISDEKKKEEN

SEQ ID NO: 8353 - DNA, 1887 bp, Aspergillus nidulans FGSC A4
  CDS (1)..(1887)
atgaacccagccgattccgttgagatcggcgacgccgtcgccgctcagcagaatgctcatctcgctcagctgcccttgggtaaagatatcaagttggagaaggatgccatcgccagggagtccagtatcgaggaaatccccgcgaccaaggaatatccaaccggcagcgaggaggaccaggatctgaacaagctccaccctacgcaggaggagatgcaaacgctccgccgcgttgctgggccgatgaactggatcactttctctgtggctttcgtcgagctgtgcgagcgtttctcctactatggaaccaccgctgttttcgtcaacttcatccaacagcctctgcccccgggctctaccaccggtgccatctctggcggctccgaggttcctggcgccttggatatgggccagcaggcttcgaccggtttgactttgttcaactctttctggtcgtacgttatgccactcgccggtgccttcttggcagatcagtactggggtcgtttccgaacgatcatgttctcgatcggttgtgccctagtcggtcacgttatcctcatcatctccgccattccccccgtgatcgcaaaccccaatggcgctattggctgttttgcgatcggtctgatcatcatgggtatgggtaccggtggtttcaagtccaacatctcggccttgattgcggaacaataccccgatgagcggccctacctaaagaccctaccatcaggagagcgcatcatcattgacccagctgccactgttgctcgtgtctatctttatttctacctgtgtatcaacgtcggctcgcttactggacagatcagcatggtctacgccgagcgatacgttgggttctggctgtcattcttgctgcccacgatcatgttctgcttctctcctctcgtgctgtacctctgccgcaacaaataccacctggttcccccgactggctctgtgtatacccaggcctatcgtctgatcagggaagctatcaggcaccattggtccgttaccacggtcaaagtggctggtattccattcaagagaatcaagaaaaacgatacccacttctggaacaccgtcaagcccagcaccatgggagcaaaccgtcctacctggatgacattcgatgacgagtgggttgatgaagttgcccgcggtctcaaagcgtgccgggtgttcctctggtatcccctgtactggcttgcctacaaccaaatgcttaacaatcttacctctcaggccgccacgatgcgacttggcggcgtccccaacgacatcatcaacaacttcaacccgctcgccctcatcattttcatccccatcttcgaccgcttgctataccctttcctccgtcgtattggaatcaaattcacgccgctcaagcgtattacagcaggattcttcgtggccggttccggtatgatcgtggctaccgtcacccagcactatatctacaagaaaggcccatgcggtaaagaagccaacagttgtctggagcaaggcctgcacgcacccatctctgtctgggtgcaggctctcacctacattctcggtggtatttccgagattctggcgtcggttacatcccttgagtacgccttcaccaaggcgcccaagaacatgcgcagtttggtccaggccgtctcactcttcatgaacgctttctcttctgccatcggtcaggcctttgtcggtctttcagaagacccgcttcttgtctggaactacgctgtcgttgccatcttggcgttcgttggcggcattggcttctgggcaacaaactacaagctggataaacaggaagatgagctcaacacccttgctcagtcgaagtatgagggctctggattgaagcaggatgaggaggcgaaagcctaa

SEQ ID NO: 8354 - protein, 628 aa, Aspergillus nidulans FGSC A4
MNPADSVEIGDAVAAQQNAHLAQLPLGKDIKLEKDAIARESSIEEIPATKEYPTGSEEDQDLNKLHPTQEEMQTLRRVAGPMNWITFSVAFVELCERFSYYGTTAVFVNFIQQPLPPGSTTGAISGGSEVPGALDMGQQASTGLTLFNSFWSYVMPLAGAFLADQYWGRFRTIMFSIGCALVGHVILIISAIPPVIANPNGAIGCFAIGLIIMGMGTGGFKSNISALIAEQYPDERPYLKTLPSGERIIIDPAATVARVYLYFYLCINVGSLTGQISMVYAERYVGFWLSFLLPTIMFCFSPLVLYLCRNKYHLVPPTGSVYTQAYRLIREAIRHHWSVTTVKVAGIPFKRIKKNDTHFWNTVKPSTMGANRPTWMTFDDEWVDEVARGLKACRVFLWYPLYWLAYNQMLNNLTSQAATMRLGGVPNDIINNFNPLALIIFIPIFDRLLYPFLRRIGIKFTPLKRITAGFFVAGSGMIVATVTQHYIYKKGPCGKEANSCLEQGLHAPISVWVQALTYILGGISEILASVTSLEYAFTKAPKNMRSLVQAVSLFMNAFSSAIGQAFVGLSEDPLLVWNYAVVAILAFVGGIGFWATNYKLDKQEDELNTLAQSKYEGSGLKQDEEAKA

SEQ ID NO: 8355 - DNA, 1821 bp, Aspergillus nidulans FGSC A4
  CDS (1)..(1821)
atggagcccgtcctcaacgagaagaccggcgcgcccgccgtcgaagatgtcgtcgccgtctccgattatgaagagccgaccgaggaggagctcaagacgctccgccgcatccccggcgccctcccgaccgtcgcctaccttatctgtatagtagaattctgcgagcgcgcctcgtatctgggagtctccggtctcatctccaacttcgtgaaccggcctctccctgcgggaggcaatggttacggcgcgcctgcgcgcgggacccaggacacggctggtgccctgggcatgggcaccgtcaaggcgaatgccgtcagccagtcattcagtatgctcgcgtacctgctgcccatgttctttggctacctctccgatgcgcacactggacgtttcaagatgatcctctacggtgttgcggtctttggtgttgcgcacgttctcatggtcggtgctacggcgcccaaactgctggccaatgggggtgcaaaggcgccgtactttatctcactgtatatgctctctgtcggtgcttccatgttcaagcccaacgtatcccccctcctcctcgaccagatgcctcgcgataaagccaagatcaaggttcttcccagcggcgaacgggtcattgtcgacccggaggctacttctgagcgaaccatgctatggttctacctgctcatcaatatcggcggcttcatgcagaccgccacctcgtacgctgagaagtacgtcggctggtggttggctttcattctgcctctgttcctctacatccctctgccccttcttctgatctggttgcgcaagcgcctcgtcctctttccccctggaggaagcgaccttcccaacgtcgtgcgcgtgctgaagatctgtctctctcgcgggggcatcttccgcatcggccgccacggcttctgggatgccgcgaaaccgtcagtgattgcggcgaaagggcagaacattcgcacacagtggaacgaccagttcgtcgaggacgtgcgacgcacctttcaagcgaccgggatcttctgcttcttcccgatccagtacatcaacgacaatggcctcggcagcgccgccagtttcctctccactatgctcaagacggatggagtgccaaacgacctgatctcgaacttcaacccgctcagcatcatcttcttcgcgccgatcctgaactacgggctttacccgttgctgcgccggtggaagatccactatggccctgtggcacgcatggcaactggtctcttcatctcttccattgggggcattggatacactgtgctcaactactacgcgtacaaacttggtccctgcgggaaatgggggtcctcggatacttgcgttgatgagaacgggaatacgcgcgtggcaccgatcaccatctggtggatcgccattccctacgccatcggtggcatctctgagctcttcatcaacgtccccgcctacggcatcgcctactcccgcgcccccaagaatatgcgcggcctcgtctccgccatcaacctcctcaacacggcagtcgcctatgccattggactggcctgctcggccgtgatcaaggacccttatctgacttgggactttggcggcccgtccattgtaggctttgtcctcactgtcatcttctactttatgttccgccacatcgacaaggaggagtacttcctcacggagatggcggagaacgagaacgagacgactgcccagcctaaggagagcgcgctgagtgagaatggggataagacattaagccccgtagagaaggttgctgataatgagccggagaagattggggtatccctaaaacaatga

SEQ ID NO: 8356 - protein, 606 aa, Aspergillus nidulans FGSC A4
MEPVLNEKTGAPAVEDVVAVSDYEEPTEEELKTLRRIPGALPTVAYLICIVEFCERASYLGVSGLISNFVNRPLPAGGNGYGAPARGTQDTAGALGMGTVKANAVSQSFSMLAYLLPMFFGYLSDAHTGRFKMILYGVAVFGVAHVLMVGATAPKLLANGGAKAPYFISLYMLSVGASMFKPNVSPLLLDQMPRDKAKIKVLPSGERVIVDPEATSERTMLWFYLLINIGGFMQTATSYAEKYVGWWLAFILPLFLYIPLPLLLIWLRKRLVLFPPGGSDLPNVVRVLKICLSRGGIFRIGRHGFWDAAKPSVIAAKGQNIRTQWNDQFVEDVRRTFQATGIFCFFPIQYINDNGLGSAASFLSTMLKTDGVPNDLISNFNPLSIIFFAPILNYGLYPLLRRWKIHYGPVARMATGLFISSIGGIGYTVLNYYAYKLGPCGKWGSSDTCVDENGNTRVAPITIWWIAIPYAIGGISELFINVPAYGIAYSRAPKNMRGLVSAINLLNTAVAYAIGLACSAVIKDPYLTWDFGGPSIVGFVLTVIFYFMFRHIDKEEYFLTEMAENENETTAQPKESALSENGDKTLSPVEKVADNEPEKIGVSLKQ

SEQ ID NO: 8357 - DNA, 1731 bp, Candida albicans SC5314
  CDS (1)..(1731): transl_table=12
atgtccacagaagagaaacatctgcaaacagatgttataaatagttctactcaaggctcacattccgtcgaaaaactgctgagggatgatgaatatgctggtgacaacttagggtccgatatacagatcgatgatgaaggtagagaacctaccgatcatgaaatggaaaccttgagacatgtttctgaatccattccaatatcatgttggttagttgctattgttgaattagctgaaagattttcctattatgggttgtcagctccgttccagaactatatgcaatttactccagaacattcaccaaaaggtatgcttggattaaagcaacaaggtgccactgcgttgtcgtactttttccaattctggtgttatgtcactcctattcttggtggttggatttctgacacctactggggtaaatataaaacaatttttgtcttttgtgttatttatatcgttggtattttcttattgttcatcacttccgttccatctataaccagtaaaagtactgctactgggggttatattgcggctattatcatcattggtcttggtacaggtggtgtcaaatccaacgtttccccattgattgctgatcaaattcctaaaaagaaaccatacattaaggtcaccaaaaagggagaaagagtcattgttgatccaaacatcactgttcaaaacgtattcatgttcttctaccttatgatcaacattgggtctttgtcagttattgccaccactcaaatggaggctcacattggattctggtcttcttacttgcttacgttctgcttcttctttatcgcaattgctgctttgattgttggtagaaacaaatatgtcaaggttcctgttggtgacaagattgtcaacaagactttcaaatgtgtttgggtcggtatcataaacgggttcaacttcgatgctgccaagccctccgtcaaaccagaaaaatcttatccatgggatgaccattttgttgacgaagtcaaaagaactatatctgcttgtaaagtgtttgtgtggtaccctatctactgggtccaatataatggtatgatgaacatgtttgttagttctgcagcaggtatgagccgtgatattccaaacgatttcttgacagtttttgacagtgtggccattatcgtctttatcccaatattcgaaagatttttatatccttttgttagacattttactccattcaaaccaatcacaaagattttctgggggttcatgtttggatctggtgctatggtttacgccgctgttttgcaacactatatctacaaagccggtccatgttatgaccatcctttggattgtccaaacggtaaccacatcaacattggtttgcaaacacctgcatatgtcctcattgccatctctgaaattttggcctcgattactggtcttgagtatgcctacactaaggcacctgtgcaaatgaaatctttggtaatggcaatgtttttacttacaaacgccgttggtgctgccattggtattgccttgctgagtgttagtgtggatccaaaaatggtgtggacatacctgggattagctgtgctgtgtttcattgctggttgcttgttcttgactttgttcaaacactacaataaaaaggaagacgagtggaacaatttggaatacgaagccaatattgaagaggctgcgcttatgccagtttcttcattaactccgtcacgcaaatccattgcatag

SEQ ID NO: 8358 - protein, 576 aa, Candida albicans SC5314
MSTEEKHSQTDVINSSTQGSHSVEKSSRDDEYAGDNLGSDIQIDDEGREPTDHEMETLRHVSESIPISCWLVAIVELAERFSYYGLSAPFQNYMQFTPEHSPKGMLGLKQQGATALSYFFQFWCYVTPILGGWISDTYWGKYKTIFVFCVIYIVGIFLLFITSVPSITSKSTATGGYIAAIIIIGLGTGGVKSNVSPLIADQIPKKKPYIKVTKKGERVIVDPNITVQNVFMFFYLMINIGSLSVIATTQMEAHIGFWSSYLLTFCFFFIAIAALIVGRNKYVKVPVGDKIVNKTFKCVWVGIINGFNFDAAKPSVKPEKSYPWDDHFVDEVKRTISACKVFVWYPIYWVQYNGMMNMFVSSAAGMSRDIPNDFLTVFDSVAIIVFIPIFERFLYPFVRHFTPFKPITKIFWGFMFGSGAMVYAAVLQHYIYKAGPCYDHPLDCPNGNHINIGLQTPAYVLIAISEILASITGLEYAYTKAPVQMKSLVMAMFLLTNAVGAAIGIALSSVSVDPKMVWTYSGLAVSCFIAGCLFLTLFKHYNKKEDEWNNLEYEANIEEAALMPVSSLTPSRKSIA

SEQ ID NO: 8359 - DNA, 1917 bp, Ustilago maydis 521
  CDS (1)..(1917)
atgcccctcgacatccaggacaacgctatcgctggccacgcagaggctcagcgcgacttgtacgtcgccgacatcaaggctcacggtggcaatgatcaagaccatcctgttgcccacctcgagactggcgttcgcgtcaagcccgacgtctcggacgatgactttattgctccctctgatgaggatctcgccaccttgcgacgtgtacccgagaagctcccttggaccacctacgccatcgctttctgcgagctggcagagcgtttctcctactacggctgtgtccaggtcttccagaactttatccagcagcctcgtccctccaatagccgtgccggtgccggtggttccagcaaccagtctggtgctctcggcgagggtcagcaggctgctactggtctcaccaccttcaacaccttctgggtctactgcatgcccattctcggtgcctacctcgcagatacccgctggggccgtttcaaaaccatctgcatcgccgttttcatcgccatggtcggccacgttcttctcattgtctcttcgcttcccaccgtgctcgacaaccaaggtggcgccatggcttgctttgtcctcgccatcatcatcatgggtgtcggaaccggctggttcaagtcgaccatcagtcctctgatcgcagagcaggtcaacggttccaagcaatccgttcagacgctcaagaccggtgaacgtgtcattgtcgaccctgtcttgaccatcagccgcatcttcatgtacttttacctttttatcaacattggtgcgctcggcggtcaactcggtatgtcgttttccgaaaagtacgttggcttttggctcgcctacaccttgcccaccgttgtctttgctctctgcatccccgtgctcgcctttggtagcaaatactacgtcaagacgcctccttccggctcggtgctcgccgagtgcatgcgcctctggtcgtatgccgccaagggtcgttggacgctcaaccccattcagcttgccaagaacatgcgtgccgacgacttttgggagaacgtcaagccttccaagcattctcccgagaccaagccccgttggatgacctttgacgatgcctgggtcgacgaggtgcgacgtggtttcaaggcttgcaccgtcttcctctggttcccgctctactggctcacctacaaccagatcaccaacaacctcgtctcgcaggctgccaccatggaggtgcacggtcttcccaacgaggttgtctcgaatctggaccccttcgcgctcatcatcctcattcccttgtttgaccttttcctctaccccgctctccgcaaggccggtttcaactttacgcctctcaagaagatcgccctcggtttcttgactggtgccctcgccatggtgtgggccgccgtcgttcagcactacatttacaagaggtcgcaatgcggcaagaacgcctcgacctgctacgacattaacggtgatggctttgccgaccctggtgccgatggatccgaggaaaacgccgtctacattcctgcgcctctcaacgtgtggatccaatcgggctcctacattctcatcgccatttccgagattctggcgtcgattaccggtctcgagtacgccttttccaaggctcccaagtcgatgcgttcgctcgtcatgtccatgtttctcttcacctcggctatcgctgccgccctgcagcaagccttcatctcgctctccgaggaccccaacctggtctggagctacacggtgtttggctgcctcgcctttgtcggcttcatcggcttctcgatttcgttcaggaagctcgactcacaggaagacgcgctgaaccagctcgatgccggaacggtcaacgccaccgacagcgctattacttcggagcctggacaatcggagaaggcgcttgccccctaa

SEQ ID NO: 8360 - protein, 638 aa, Ustilago maydis 521
MPLDIQDNAIAGHAEAQRDLYVADIKAHGGNDQDHPVAHLETGVRVKPDVSDDDFIAPSDEDLATLRRVPEKLPWTTYAIAFCELAERFSYYGCVQVFQNFIQQPRPSNSRAGAGGSSNQSGALGEGQQAATGLTTFNTFWVYCMPILGAYLADTRWGRFKTICIAVFIAMVGHVLLIVSSLPTVLDNQGGAMACFVLAIIIMGVGTGWFKSTISPLIAEQVNGSKQSVQTLKTGERVIVDPVLTISRIFMYFYLFINIGALGGQLGMSFSEKYVGFWLAYTLPTVVFALCIPVLAFGSKYYVKTPPSGSVLAECMRLWSYAAKGRWTLNPIQLAKNMRADDFWENVKPSKHSPETKPRWMTFDDAWVDEVRRGFKACTVFLWFPLYWLTYNQITNNLVSQAATMEVHGLPNEVVSNLDPFALIILIPLFDLFLYPALRKAGFNFTPLKKIALGFLTGALAMVWAAVVQHYIYKRSQCGKNASTCYDINGDGFADPGADGSEENAVYIPAPLNVWIQSGSYILIAISEILASITGLEYAFSKAPKSMRSLVMSMFLFTSAIAAALQQAFISLSEDPNLVWSYTVFGCLAFVGFIGFSISFRKLDSQEDALNQLDAGTVNATDSAITSEPGQSEKALAP

SEQ ID NO: 8361 - DNA, 1899 bp, Cryptococcus neoformans var. neoformans B-3501A
  CDS (1)..(1899)
atgaccacacatgcaaatgccatccaagattttgaggcggcaccagtgccgtctgctgccatcccttcatctgaagacaagacttccgccgctggtcctgtgacgctaagttacggcgacaagaaggattcattgcccgatgtttcggttggcgacgctggtgccatcgactacattacggaggaggtggagcctactgacgaggaatttgctgtattaaaaaaagtgcacgggaagatgccatgggtttgcattgccatgtgtgctattgagctttccgagcgagcgtcgtactatggtatcactggtgtcgttcaaaattttatcaagaaccctcttcccgaaggtggtaatggtgctggtgctgttgctcctggtgctgccggtacaaatcagtctgccggtgcactaggtcgaggttctgttcaatcttctgcttgttacaatgcgttcgtctttcttgcctatgttttccccattatgggaggtatcctcgcagacacaagatggggtcgttttaagaccgttgctattggtaccgccgttggagcctttgcgcatattttaatggttgttgtcaccatccctcaagtcctccgtactggcaatggtctcggtcctttccttgtctcattctacatcttatcctttgctgctggtttcatcaagccttgcctggccactttgctctgtgaccaaagccctgtgaagaagcctgttatcactactactaaaactggtgagagggtcattcttgatccccagaccaccgttcaacgataccttctcatcttctactggtgtatcaacgtcggcggcttctttgccattgcttcttcatactctgcacgttttgtcggcttttggctggcttaccttctgcccggtatcgtgtacatgctcatgcctatcgtcttggtcgtctgctataaacgactctataaggccccccctcagggttctgtcacccttgaagcgatgaaagtcttgtaccttatcataaagaagggaggtttcgtcaagatgttcaagggaggtgaagaattctggcagacagctaaaccgagttatatcttggccaaggaaggctcggtcgacacttccaagatcttctgggatgatttgtttgtggatgaaattaggcagtctattgcagcttgtggtgtcttcgcccttattcctattttcaaccttgccgacggtggtattggttcacaggagaacgacatgtcaactgccatgactctgaacaacgctcctaacgatgttatttcaaactttaaccctcttactatcatcgtcgccacacctatcattacctacggtctttaccccttctttgacaagatcggtcaccccatcaagcccatgacccgaatggctattggcttcattcttggtatggccaacatgatctatggcgcggtcatccagtggaagatctactccatttctgagtgtggctggtacgcatctacttgtgacaccgtcaccagtatttctatctgggctcagattcctctttactcgcttcccgccattggtgaaatctttgtcaatgttacatcttacgagctggcctacactcgtgctcctgcgcgaatgaagggcctggtttatgctttgtgtttgttcaaccaagctatctcctctgctattggtctcgcgtgctccaacgccattcaagacccgtacctcatttggccttacgtcgcccttgccatcgcctgtttgatctgtgccgttctttgccctacctacttccgacacctcaacgaccctgtgcgaacctttgccgatcccgccaggcaggctggtaagcttcaagagcttgagcctctcactgctgctcgtgcgtcgcaaaacgagcttaatgagaaggccgatgagaaggcttag

SEQ ID NO: 8362 - protein, 632 aa, Cryptococcus neoformans var. neoformans B-3501A
MTTHANAIQDFEAAPVPSAAIPSSEDKTSAAGPVTLSYGDKKDSLPDVSVGDAGAIDYITEEVEPTDEEFAVLKKVHGKMPWVCIAMCAIELSERASYYGITGVVQNFIKNPLPEGGNGAGAVAPGAAGTNQSAGALGRGSVQSSACYNAFVFLAYVFPIMGGILADTRWGRFKTVAIGTAVGAFAHILMVVVTIPQVLRTGNGLGPFLVSFYILSFAAGFIKPCLATLLCDQSPVKKPVITTTKTGERVILDPQTTVQRYLLIFYWCINVGGFFAIASSYSARFVGFWLAYLLPGIVYMLMPIVLVVCYKRLYKAPPQGSVTLEAMKVLYLIIKKGGFVKMFKGGEEFWQTAKPSYILAKEGSVDTSKIFWDDLFVDEIRQSIAACGVFALIPIFNLADGGIGSQENDMSTAMTLNNAPNDVISNFNPLTIIVATPIITYGLYPFFDKIGHPIKPMTRMAIGFILGMANMIYGAVIQWKIYSISECGWYASTCDTVTSISIWAQIPLYSLPAIGEIFVNVTSYELAYTRAPARMKGLVYALCLFNQAISSAIGLACSNAIQDPYLIWPYVALAIACLICAVLCPTYFRHLNDPVRTFADPARQAGKLQELEPLTAARASQNELNEKADEKA

SEQ ID NO: 8363 - DNA, 1455 bp, Myxococcus xanthus DK 1622
  CDS (1)..(1455): transl_table=11
atggcccaggcacccgccgcgcagagcaacaagttcccgccgcaaatccccttcatcatcggtaacgaggcgtgtgagcgcttcagcttctacgggatgcggaacatcctcacggtgttcctcatcgactacctgctgcgcacgcagataccggacaacgcgctgcgggaggccgaagcgaagagcttgatgcacacgttcatggcgggcgtgtacttcttcccgctcatcggcggctacctggcggaccggttcttcgggaagtaccgcatcatcctggggctgagcctggtgtactgcctgggccacgcgtgcctcgccatcttcgagaacaacgtcacggggttcttcacgggcctggcgctcatcgccattggcagtggcggaatcaagccctgcgtggcggccatggtgggggaccagttcaatgagtccaacagccacctggtgaagaaggtcttcgccatcttctactggaccatcaacttcggctcgttcttcgcgtcgttgttcatccccctgctgctcaagcacttcgggccgtcggtggccttcggcatccccggggtgctgatgttcatcgcgacgttcatcttctgggcgggccgtcacaagtacgtccgggtgccggccacgggcgccaacccgcacagcttcttcaaggtggtggccagcgcactgcgcaaccgcggccagggcggcggctggctggacggcgcgaagcgggagcaccccgaggaggccgtggacggcgtgaaggcggtgttccgggtgagcgcgctgctgctccccttcgtgcccttcttctggatgctcttcgaccagaaggcgtccacgtgggtggtgcaggcccggtccatggacccgcaggtggggccgttcaccttccaggccagccagatgcagttcatcaacccgctgctggtgatgattctcatccccttcctgacggccgtcgtctacccagccttccagcgcttcggctgggagctgacgccgctgcggcgcatgcccctgggcctggtggtgggcgcgctgtcgttcatcatcgccggcatcttccaggtcacgatggaaggcggcacgacgctgaacatcgcgtggcagattctgccgtacatcgtgctgacgctgggcgaaatcctgatgtccaccacgggcctggagttcgcgtacacgcaggccccgcgtgagatgaagggcaccatccagagcgtgtggctggtgacgaacacgctggccaacgcggcggtggccatcaccgcgaagctcaacgtcttcacgggctccgggcagttcttcttctacgccggcttcgccctggtggccgcagtgggaatggccctggtggcccgccgctacgtggtgcgtgactactaccagacgtccgcgcccatccccaccgaggagcgctccgctgccggcgtgacgcccggctcggcgaagtccgcgtag

SEQ ID NO: 8364 - protein, 484 aa, Myxococcus xanthus DK 1622
MAQAPAAQSNKFPPQIPFIIGNEACERFSFYGMRNILTVFLIDYLLRTQIPDNALREAEAKSLMHTFMAGVYFFPLIGGYLADRFFGKYRIILGLSLVYCLGHACLAIFENNVTGFFTGLALIAIGSGGIKPCVAAMVGDQFNESNSHLVKKVFAIFYWTINFGSFFASLFIPLLLKHFGPSVAFGIPGVLMFIATFIFWAGRHKYVRVPATGANPHSFFKVVASALRNRGQGGGWLDGAKREHPEEAVDGVKAVFRVSALLLPFVPFFWMLFDQKASTWVVQARSMDPQVGPFTFQASQMQFINPLLVMILIPFLTAVVYPAFQRFGWELTPLRRMPLGLVVGALSFIIAGIFQVTMEGGTTLNIAWQILPYIVLTLGEILMSTTGLEFAYTQAPREMKGTIQSVWLVTNTLANAAVAITAKLNVFTGSGQFFFYAGFALVAAVGMALVARRYVVRDYYQTSAPIPTEERSAAGVTPGSAKSA

SEQ ID NO: 8365 - DNA, 1548 bp, Shewanella sp. MR-4
  CDS (1)..(1548): transl_table=11
atgactactcctgcagatgcgccaaagtggccacgccaaataccctatattatcgccagcgaagcctgtgaacgttttagcttttatggcatgcgcaacattctaacaccattcttgatgacggcacttttgctctctattcccgaagatcttcgcggggctgtggcaaaggatgtattccattcgtttgtgattggggtgtattttttccccttactcggtggttggatcgcagatagattctttggtaagtacaacactattttgtggttaagcttactctattgtgtgggccatgcattcttggcgatttttgagcacagcgtgcaaggcttttataccggtttattcttaattgccttaggttcgggcgggattaagcctttagtttcttcctttatgggcgatcagtttgatcagagcaacaagtctttggcgcaaaaagccttcgatatgttctattttacgatcaacttcggttccttcttcgcatcattgtctatgccattgttactcaagaattttggcgcagcagtggctttcgggatccccggtgtgttgatgtttatcgctacagtgtttttctggttaggccgtaaacgttatgtgcatatgccgccagagcctaaagatccccatggatttttacccgtgatccgtagcgctttgctgactaagatcgaaggcaaggccaatataggtttagtgttagccttaattggtggtgtttctgccgcttatgcgttggtgaatattccgaccctaggtattgtggccggtttgtgtagcgctatggtgctgctgatgggatttgtaggccttggggcgtcattacagcttgagcgcgcgcgagggattcatcctgatgcggccgtggatggtgtgcgttcagtgttgcgtattttggtgttgttcgccttagtgacgccattttggtccttgttcgatcaaaaagcttctacatggattttgcaggctaacgatatggtcaaaccctcgtggtttgaacctgccatgatgcaggcattaaatccgctgttagtgatgctgttgatcccattcaataacttcgttttatatcctgcgattgagcgtatgggcgtgaaattaactgcgctgcgtaaaatgggggcggggatagcgattactggcttaagctggattgtagttgggacgattcagttgatgatggatggtggctcgtcgctgtctatcttctggcagatcttaccctacgccttactgacctttggtgaagtattagtttcggcgacgggtttagaatttgcctacagccaagcacctaaggcgatgaagggcactattatgagtttttggaccttatcggttaccgtcggtaacctttgggtattgctggccaatgtgagcgtaaaaagcccagctgtgacggaacaaattgttcaaaccggtatgagtgtgacggcattccaaatgttcttcttcgcgggatttgcgattttggcagcggtcatcttcgcgctctatgctaggtcttatcaaatgcaggaccattatcgccaagtctag

SEQ ID NO: 8366 - protein, 515 aa, Shewanella sp. MR-4
MTTPADAPKWPRQIPYIIASEACERFSFYGMRNILTPFLMTALLLSIPEDLRGAVAKDVFHSFVIGVYFFPLLGGWIADRFFGKYNTILWLSLLYCVGHAFLAIFEHSVQGFYTGLFLIALGSGGIKPLVSSFMGDQFDQSNKSLAQKAFDMFYFTINFGSFFASLSMPLLLKNFGAAVAFGIPGVLMFIATVFFWLGRKRYVHMPPEPKDPHGFLPVIRSALLTKIEGKANIGLVLALIGGVSAAYALVNIPTLGIVAGLCSAMVLLMGFVGLGASLQLERARGIHPDAAVDGVRSVLRILVLFALVTPFWSLFDQKASTWILQANDMVKPSWFEPAMMQALNPLLVMLLIPFNNFVLYPAIERMGVKLTALRKMGAGIAITGLSWIVVGTIQLMMDGGSSLSIFWQILPYALLTFGEVLVSATGLEFAYSQAPKAMKGTIMSFWTLSVTVGNLWVLLANVSVKSPAVTEQIVQTGMSVTAFQMFFFAGFAILAAVIFALYARSYQMQDHYRQV

SEQ ID NO: 8367 - DNA, 2260 bp, Hordeum vulgare
  CDS (276)..(2015)
tcttttttattcgccaaatccaaaggtggctgcggctcacacccatcctcacaccgagaccgagaccgagggaggtggagctcagagcctcggacgagaccagagggaatcgcgcgggcgtggcgacaactgaggcgcccggagatcccctccgaccgggctccaccgatccccggccgccgccgcccaccgagcatcgaccaacagagcagagtaagcagttcctctgagctgctgtgagctccggcgagaaagaagcaggaaggtcaggagccatgggggaggtcgcggcagagatgtacacccaggacggcaccgtcgacatcaagggcaacccggccctcaagaaagacaccggcaactggcgcgcctgcccctacatcctcgcgaacgagtgctgcgagcggctggcctactacggcatgagcaccaacctggtcaacttcatgaaggaccggatgggcatggccaacgcggcggctgccaacaacgtcaccaactggggcggcacctgctacatcaccccgctcatcggcgccttcctcgccgacgcctacctcggccgcttctggaccatcgcctccttcatgatcatctacatcttcggcctgggcctgctcaccatggccacctccgtgcacggcctcgtgcccgcctgcgcctccaagggcgtgtgcgaccccacgcccggccagtccgccgcggtcttcatcgcgctctacctcatcgcgctcggcaccggcgggatcaagccctgcgtctcatccttcggggccgaccagttcgacgagcacgacgacgtggagcgcaagagcaagagctccttcttcaactggttctacttctccatcaacatcggcgcgctggtggcctcgtcggtgctggtgtacgtgcagacacacgtcggctggagctggggcttcggcatccccgccgtcgtcatggccatcgccgtcggcagcttcttcgtcggcacgtcgctgtaccgccaccagcgccccggcggcagcccgctcacccgcatcgcacaggtgctcgtcgccgccacgcgcaagctgggcgtcgccgtcgacgggtcggcgctgtacgagaccgcggacaaggagtccggcatcgaggggagccgcaagctggagcacacgcggcagttcaggttcctcgacaaggcggcggtggagacgcatgccgacaggacggcggccgcgccgtcgccctggcggctgtgcacggtgacgcaggtggaggagctcaagagcgtggtgcgcctgctgcccatctgggcaagcggcatcgtgttcgccacggtgtacgggcagatgagcaccatgttcgtgctccaaggcaacaccctggacgcctccatggggcccaagttcaagatcccctccgcctccctctccatcttcgacaccctcagcgtcatcgcctgggtgcccgtctacgaccgcatcctcgtccccgccgtgcgctccgtcaccggccggccgcgcgggttcacgcagctccagcgcatgggcatcggcctcgtggtctccatgttcgccatgctcgccgccggcgtgctcgagctcgtccgcctccgcaccatcgcgcagcacgggctgtacggggagaaggacgtggtgcccatctccatcttctggcaggtgccgcagtacttcatcatcggctgcgccgaggtgttcaccttcgtggggcagctcgagttcttctacgaccaggcgcccgacgccatgaggagcatgtgctccgcgctctcgctcaccaccgtggcgctcgggaactacctcagcacgctgctcgtcacggtggtggccaaggtgaccaccaggggaggcaagcaagggtggatcccggacaacctcaacgtcggccacctcgactacttcttctggctgctcgccgcgctcagcctcgtcaacttcgccgtctacctgctcatcgccagctggtacacctacaagaagaccgccggagattctccggacgccaaaggaggagctcatgatcagtgagtgactgactgacatgctctgtctgcgattggtgtctgaatgtgttcaagagacaaaacataatacagtactagattgttgaaagaagaagaaaacaaggattgggacttcagagctcagataggtgaaattaagggagggaaatgaaatgcatggtgtggtttgtgacctcaagaatcaagagtgttgtgttgttgattaattctagtgcttggaaaaatctggcagaaacaaaaaaaaaaaaa

SEQ ID NO: 8368 - protein, 579 aa, Hordeum vulgare
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 8369 - DNA, 1662 bp, Phaeosphaeria nodorum
  CDS (1)..(1662)
atgccaccaccatggcgttcccagggcgtctctgggcttggcgcctacacgacagtggcccaaaccgaagaccacaccgctgagcttacggcgcatggcaaggagacatcaatcgatgatgaaaggcatggcggtccggatattgaagactctgcaccctccgcacacgacctctcatcacttccccacgtttcagactccctcccgctctccgctttcctcatcgccattgtcgagctctgtgagcgcttcgcctactatggcctctctggtccgtttcaaaactacatcgccaacccacccaagtcgacgcttcctggtgccttggggctcggtcaatcttctgcgacagcgatgacgaacttcttccagttctggtgctatctcacgcctgttatgggtgcggttgttgcggatcagtacttgggcaagtatgcgacgatcaagtggttcagtgtcgtctacatgattggcatcatgatcttgttcgttacaagtctaccagtcagtgtggaaagaggagcggcgttccctgggctggttgtcgcgatgatggttattggattgggaacaggcggcatcaaaagcaatgtggcgcctctgattgcggaacaaatctcgactacagaagcatatgtcaaaacgttgaagagcggtaaaagagtgattgtcgaccccgaggtcaccatgcagcgtgtcttcatggttttctacacgtgtatcaacataggctccatttctgctatcgcaacgaccatgctcgaacttcatgttggtttctggagcgcatatctgctgccgctgatcatgtttgttgttggctttacagtcctggttaagttcaggaatacatacaccataaaaccaccccaaggaggcgtgatcggaaactgctttcgcgcgctgttcattgcagttcgcaatggcttcgacctcaacgctgctcgtccttcacgagcggcggcaaaacatcgcattacttgggacgacaagttcattgacgaactcgagacagcgctggttgcgtgcaaggcgtttctcttcttcccgatatattgggtcaccttttcgcaaatgatgaacaatttcgtctctcaagccggccacatggaactacacggtcttccaaacgacatcctccccaacatcgaccccataaccatcatcatcctcatccccatcatggatcgcttgatctacccattcatccgcgcaaagctccacttcgccttcggtcccatcacgcgcatctcactcggcttcataatggccgccagcgccatgttgtacgccggtatcttgcaaaccaagatctacgccgcggagccgcaaaagatacatgtcgcatggcaggcaccagcatatatcttcgtcgccatttccgagatcctagcaagtatcactggtcttgaacttgcatatgcgaaggcgcctgagaacatgaagagcttcatcatgagtttgttcctgttaacgtcggcgggaggcagcgctttgggtatcttgattgcgccgttcgcgaaagatccgtggttgcattggatgtacttcggacttgcgattgcggcggcaggaacggggtttgcgttctggcgcacgtttcgcagcggaagtgacaagcatatagatgcagagagttttgagatgacagatagagtttag

SEQ ID NO: 8370 - protein, 553 aa, Phaeosphaeria nodorum
MPPPWRSQGVSGLGAYTTVAQTEDHTAELTAHGKETSIDDERHGGPDIEDSAPSAHDLSSLPHVSDSLPLSAFLIAIVELCERFAYYGLSGPFQNYIANPPKSTLPGALGLGQSSATAMTNFFQFWCYLTPVMGAVVADQYLGKYATIKWFSVVYMIGIMILFVTSLPVSVERGAAFPGLVVAMMVIGLGTGGIKSNVAPLIAEQISTTEAYVKTLKSGKRVIVDPEVTMQRVFMVFYTCINIGSISAIATTMLELHVGFWSAYLLPLIMFVVGFTVLVKFRNTYTIKPPQGGVIGNCFRALFIAVRNGFDLNAARPSRAAAKHRITWDDKFIDELETALVACKAFLFFPIYWVTFSQMMNNFVSQAGHMELHGLPNDILPNIDPITIIILIPIMDRLIYPFIRAKLHFAFGPITRISLGFIMAASAMLYAGILQTKIYAAEPQKIHVAWQAPAYIFVAISEILASITGLELAYAKAPENMKSFIMSLFLLTSAGGSALGILIAPFAKDPWLHWMYFGLAIAAAGTGFAFWRTFRSGSDKHIDAESFEMTDRV

SEQ ID NO: 8371 - DNA, 1848 bp, Phaeosphaeria nodorum
  CDS (1)..(1848)
atggcctccgcaatctcccactcgccagagcgtgagttctcggcagacgagaagacgcccgagtatcccaacgctgttcacgaccatgcactgttgaacagcgactatgagggcaagcccacgcctgaggaactcctgaccctccgtcgtgttgctgggcctatgcccactgtggcctacttgatctgtgccgttgagttcgctgagcgcgcatcctactacggagtgcagcaactcctcggtaacttcatcaaccgaccgcttcccaagggcggaaacggatggggagctccacctcgtggcactcagcagaccgctggtgctcttggcatgggaaccgtcaaggccaatgctgtctcacaatccttccagatgatggtgtacatccttcccatcttcttcggttggttggccgatactaagaccggtcgcttcaagctcatctgctggggtgtgcttgtctttggtgtagcccacgtcttgatggtagtcagtgctagcaagagtctgctggctgatggaagtgccaaaacccccttcttccttgcgctgtacattcttgctattggagctgccatgttcaagccaaatgtctcccccatgcttctcgaccaaatgaccacaagggtgccgaaagtggtcaccaccaagaaaggagagagagttatcgaagacccagaggcgactactgagcgcgtcatgctgtggttctacctcctcatcaacgtcggtggcttcatgggtgttgcaaccacttacaccgagaagtacataggttggtggttggctttcttgctgccactgctgttgtaccttccccttcccctcctgctctggttcctcaagaagcgtcttgtgctccacccacctgccggcagcaacctcggtcaagtcttcaagctcttcggtgtcatcttccgacgaggtggtcttggtaaaattggtcgtggtggcttctgggcacttggaaagccgtcaaatattgctgccgctggtctttctattcagacaacttggaatgacgagttcgtcgatgatgtcgcccgcgctgttcaggctaccggaatcttctgcttcttccccatccagtacctcaacgacaacggtattggtggcgctgccggttatctctcgactatgctcaccaccaacggcgtgcccaacgatgtcatccagaacttcaacagtttgagcatcatctgcactgttcccatcttcaactatgtcctctaccccagtctgcgcaaggccagaatccaatacggcccgatcgcccgcatcaccaccggactgcttatgtcatcaatcggtggtgtaggatacactgttctcaactactatgcttacaagcagtctccttgcggtaatttcggttccgacgactgcgagattggcaccggagtcgcgcctatttccatttggtacatggccatcccctacgctctcggtggtatctccgaagtcttcgtcaacgtccccgcctacggtatcgcttactctcgcgctcccgtcagcatgcgtggtttggtatctgccatcaaccttttcaacaccggtgtcgcctatgctatcggtcttgcctgctcggccgtcattcgtgacccgtacctcacctgggacttcggtggcccagctatcgctggtttcatcactgctgtggtcttctacttcaccttccgcaagatcgacaaggaagagctcgttatgcgcgacgagtcggacgttgattaccaccttgactcgacgggcaccaggagcgttgtccgtgccaactcgatcaacggtgagggtgttaatgttgctcagatcgcgaagaacgaggaggtcatgatttcgcagaagcagtag

SEQ ID NO: 8372 - protein, 615 aa, Phaeosphaeria nodorum
MASAISHSPEREFSADEKTPEYPNAVHDHALLNSDYEGKPTPEELLTLRRVAGPMPTVAYLICAVEFAERASYYGVQQLLGNFINRPLPKGGNGWGAPPRGTQQTAGALGMGTVKANAVSQSFQMMVYILPIFFGWLADTKTGRFKLICWGVLVFGVAHVLMVVSASKSLLADGSAKTPFFLALYILAIGAAMFKPNVSPMLLDQMTTRVPKVVTTKKGERVIEDPEATTERVMLWFYLLINVGGFMGVATTYTEKYIGWWLAFLLPLLLYLPLPLLLWFLKKRLVLHPPAGSNLGQVFKLFGVIFRRGGLGKIGRGGFWALGKPSNIAAAGLSIQTTWNDEFVDDVARAVQATGIFCFFPIQYLNDNGIGGAAGYLSTMLTTNGVPNDVIQNFNSLSIICTVPIFNYVLYPSLRKARIQYGPIARITTGLLMSSIGGVGYTVLNYYAYKQSPCGNFGSDDCEIGTGVAPISIWYMAIPYALGGISEVFVNVPAYGIAYSRAPVSMRGLVSAINLFNTGVAYAIGLACSAVIRDPYLTWDFGGPAIAGFITAVVFYFTFRKIDKEELVMRDESDVDYHLDSTGTRSVVRANSINGEGVNVAQIAKNEEVMISQKQ

SEQ ID NO: 8373 - DNA, 1824 bp, Phaeosphaeria nodorum
  CDS (1)..(1824)
atgtcttccggtgctcctctcgagattgtggacgtcgccgcggcacacgtaccagactcgaaggacgagcgcatttttgaaaagcgcgagtcactcagctctaccaaagacgatctggttggtcctaatggcgagctgtatcccacggatgaagagtgggcttcgctccgccgagtgtatggcaaagtgaattggatgatctatattatcggtattgtagagatgtgcgaacgattcgcctactatggcaccaccgctgtttttgtcaacttcatccaacaatctctaccaaccgagggaccattccccgaagctggtgctgctggcaccaatggtcaaccaggagctctgggtatgggacaaagagcctcaaccggacttgtgcagttcaatcagttcttctcttatatcatgcctatgattggtgggtggcttgctgatgaatattggggaaagtttaaaactatttacgtcgcaatcgtcgtggccacgtttggacatatcctcattctcatcgctgctatcccacaagtaattgcttcaccgaaaggagctctcgcctcgtttatccttggcctcatcctcttcggtacaggcgtgggattcttcaaggcttgcatttcgccgcttatcgctgaacaatacgaagcttctcaccccagagcatatatcaggaccgaagctaatggcgagcgtgtcatcgtcgatccagggatcacgtactctcgcatctacatgcgctactacctactgatcaacgtcggagctttggtcggtcagatttctatggtgtatgctgaaaaatacgtgggtttctggctgtcttacctcctaccgaccattctcttcatcttctgtccgattcttatgatggccttcagtaggcattatgtcaagaagccgccgcagggagacgtcgccatcaagtctttgcgtctctatgggcttgcactgaagggccaattctcgctcaaccccatccgcacttggaagaacctctcctctcctgatctttgggagaatgtcaaacccagcagggtctcaaacaaacccaagtggatgacttttgacgatgcttgggtggatgaagtgcgtcgtggtttcaaagcttgttatgtcttcctctggcttccaatcttctggcttccgtacggacaaatgacttccaatctcgtctcgcaagcgtcgacaatggaactcaacggcgtcccaaacgatatcatccacaacctgaaccccatcacgcttctcatcatgatcccaatcttcgacaaattcatctacccggcgatagcccatgcaggtctcaacttcacgccgcttaagaagatctcagctggatttgtgttcgcgatgttcagtatgattgcagctgcagtcattcaacattccatctaccagaagtcgccctgtggaaagtacccaggcacatgcgatgagccaccgaacctatcggtgtgggtgcagactccggcttatgtcatgattgccttttcagaaatctttgcttccatcaccggtctagaatacgcctacaccaaggcgcccaaaaacatgcgctcgctggtaacgggtgtattctggttcactcacgcgttttcctcagccatcgctcaggcatttgttccactggccgatgatccgcttttggtctggctctacgtctccattactatcttgactttcattggctgggttggcttttcgtggactttcaggtctttagacaaggaaaatgatgcgctcgacaagttgcctgagggaggtttccagtcaggatcggagagcggctcggcgaataatgttgtggtgaacaaggcgtga

SEQ ID NO: 8374 - protein, 607 aa, Phaeosphaeria nodorum
MSSGAPLEIVDVAAAHVPDSKDERIFEKRESLSSTKDDLVGPNGELYPTDEEWASLRRVYGKVNWMIYIIGIVEMCERFAYYGTTAVFVNFIQQSLPTEGPFPEAGAAGTNGQPGALGMGQRASTGLVQFNQFFSYIMPMIGGWLADEYWGKFKTIYVAIVVATFGHILILIAAIPQVIASPKGALASFILGLILFGTGVGFFKACISPLIAEQYEASHPRAYIRTEANGERVIVDPGITYSRIYMRYYLLINVGALVGQISMVYAEKYVGFWLSYLLPTILFIFCPILMMAFSRHYVKKPPQGDVAIKSLRLYGLALKGQFSLNPIRTWKNLSSPDLWENVKPSRVSNKPKWMTFDDAWVDEVRRGFKACYVFLWLPIFWLPYGQMTSNLVSQASTMELNGVPNDIIHNLNPITLLIMIPIFDKFIYPAIAHAGLNFTPLKKISAGFVFAMFSMIAAAVIQHSIYQKSPCGKYPGTCDEPPNLSVWVQTPAYVMIAFSEIFASITGLEYAYTKAPKNMRSLVTGVFWFTHAFSSAIAQAFVPLADDPLLVWLYVSITILTFIGWVGFSWTFRSLDKENDALDKLPEGGFQSGSESGSANNVVVNKA

SEQ ID NO: 8375 - DNA, 1938 bp, Phaeosphaeria nodorum
  CDS (1)..(1938)
atgagtcgaaatacgaactgttccgaggtggatgccgaaggctcaggttcagaattatcgagcgtcaccaaacacaatgttgagctacgaagagtaagagacagtgtaccgtggcgtctttgggttgtcgccgtcataggtctttgggagaaggccgcgttctggggcatgctcgcaccatggcagaactacatggagaatccatcgcactatgggaagaatcagacccccggagcactcgggctcgggcaagcagtggcaacccgaatctactgctgcttttacatattctactacgtcacacctatatttgtcgcaatcgtggcggatagcaaactcgggcagtacaaatcgctgatcatcagtatcgttttgtactgcctaggtatcgtggcactgaccgcaagttcgataacggccaacattgacaagggttggggcgtccctggacttgttgtggccatgttcctgattggcctaggcggtggaggagtcagggcaatacttccacccttccttgccgaccaatacaagaagtcgggaccccaaatcaagacattaaagacgggcgaaaaggtcatcacggactacgagttgactctccagtacatctacaacctctacttctgggtcggaaacgttggttcactatctgcgttcggcactgttttcatcgagaagaagtatggcttcgcccaagcatacggcctcagtctcggcttcatggtcctctcacttctcatgctcatcgcaggcaagaactggtatgtgcaggtgtctcacaaagacaaccttattgtgccgcaagccacaaagattgtagcatgtgctataaagaacggctgcaagatgaagcgcgcgggccccgactaccagcgcgagcgccacagcaagaccgtctcatggaccgagaacatggtcgacgaactgactcacggactacgtggttgccgcgttctattcactttcgtaatgttctgggtttgcttcgatcaaatgcagaacaacctcatttcgcaagccggacaaatggacatgagaggtacaccaaacgacctactgccgggactcaatcaggtcggctgcatcattctaggtccagccattcagatgggcctctacccacttcttcaccgtcgcagaatctacatcgggccaataatgcgcatcacgatcggctttggctttatgatgcttgccatgttgtatgcgactatcgtgcaacacgccatctatacttcttcgctatgcttgggaagcgacagtgactgctcaagttcagccttggataaacgaagtcggccgaatgtctggttacaagcgcccatctatttcctcatctcgggaggtgagatcttcgcctacgtcactggccttgagtacgcctacgaccattcgcccaaggacatgaaagtaattgtccaggcaatcaatctactcgtcgctggcgtcggttcggtagtcgctctcgctctgacgcctgtcgcccacgatccaaacctggtcatcttctacgcctcacttacgggaggaatggcagtcacaacattcttcttctggttcagctttcgaaactacgacagaagcccaattgataccacgcagaaccattcagtagaagaggacgcgttagatgttgagaagggcatgtccgtacaagacggtgacaatgtcgatattcatgatcagaaggctgagaaagcgatgactggcgtactttcgaacgaaactgcgatcaaagaacccatgtcgttcgacaaggaaattgcctctggggactgtacgccgagccagcgaagctcttcagatacagttcaggaaccaaaaccgcacacaggcgcttggttgagtaactgcctacgccactgcttcttgcaacatctaggtcttaccacacgaactttgcacggtctcaggaagtccattttgtcgcattag

SEQ ID NO: 8376 - protein, 645 aa, Phaeosphaeria nodorum
MSRNTNCSEVDAEGSGSELSSVTKHNVELRRVRDSVPWRLWVVAVIGLWEKAAFWGMLAPWQNYMENPSHYGKNQTPGALGLGQAVATRIYCCFYIFYYVTPIFVAIVADSKLGQYKSLIISIVLYCLGIVALTASSITANIDKGWGVPGLVVAMFLIGLGGGGVRAILPPFLADQYKKSGPQIKTLKTGEKVITDYELTLQYIYNLYFWVGNVGSLSAFGTVFIEKKYGFAQAYGLSLGFMVLSLLMLIAGKNWYVQVSHKDNLIVPQATKIVACAIKNGCKMKRAGPDYQRERHSKTVSWTENMVDELTHGLRGCRVLFTFVMFWVCFDQMQNNLISQAGQMDMRGTPNDLLPGLNQVGCIILGPAIQMGLYPLLHRRRIYIGPIMRITIGFGFMMLAMLYATIVQHAIYTSSLCLGSDSDCSSSALDKRSRPNVWLQAPIYFLISGGEIFAYVTGLEYAYDHSPKDMKVIVQAINLLVAGVGSVVALALTPVAHDPNLVIFYASLTGGMAVTTFFFWFSFRNYDRSPIDTTQNHSVEEDALDVEKGMSVQDGDNVDIHDQKAEKAMTGVLSNETAIKEPMSFDKEIASGDCTPSQRSSSDTVQEPKPHTGAWLSNCLRHCFLQHLGLTTRTLHGLRKSILSH

SEQ ID NO: 8377 - DNA, 1872 bp, Phaeosphaeria nodorum
  CDS (1)..(1872)
atgacttcaactaccgcccagaatgcggtcgatatggccatgagccacgagcccaaggtcgcgacacccatgtacgaagtcactgagaagcaggcgttgtctggaaaggatgtcgcgtcaagcaccgctggcagccagcacctcgcccctgtagtcgagttcgaagccgaccttgagggcgaagagccaaccgaggaagagctggcaacactccgtcgtgtatctggaaagattccctggactgcatttaccatcgccttcgtcgagttgtgcgagcgattcggatactatggttgtcaagtgctttacacaaacttcatccaacaggaccttcctgtcatcgatggtgtcgtgcaaagcaccggccgcgaccctcgatctgatggtcaacccggtgccctcggcatggggcagcgcgcctccttcggtattggccagttcaactctttctggtcctacaccacgcccatcatcggcgccatcattgccgacgagtaccttggacgtttcaacaccatcttcattgccattgcattttccattctcggtcacattttgctcatcgtttcggcgattcccacagtgttgaccagcggcaatgcgattgcgccattcatcctgggtgttattctactcggtttcggaaccggtgctttcaaggccaacatcagtcccttgattgcggagcaatacaggcagagtaagcctagggttattgttgaggctaagacaggcgagagggttatcacggaccccaacattaccatttcacgaatcttcttgtacttctacatgtttatcaacattggatctctcactggacaaatctccatggtatacgtggagaagtatgtgggcttctggtgcgcatggttgcttcctaccatcatgttctgcttctgccccatcgtcctctggttctgcaagggcaaataccatctcaacccacctacgggctctgtccttatccgtgctatcaagctcctcaaattggcatgcaagggcaaatggtcgcttaaccccgctcagactcgcaagaacttcaagagcgagcgcttctgggaggatgtcaagcctagccatctcggtgccagcaagcctcactggatgcagtttgatgacgcgtgggtcgaccaggtcgctcgtggtctacgtgcttgctcttgcttcacatggatccctctgtactggctgtcttacaaccagatgaacaacaacctgacttctcaggccgccaccatggagcgtaacggtgtccccaacgacatcatcaccaacctcaaccccatctccctcgtcatcttcatccccattgtcgacaacttcctgtaccccgcgctccgcaaggccggcatcaagttcacgcctatcaagcgtatcgcgttcggtttcctgctcgcctccctcgccatggtcggtgccgccgtcatccagcactacatctacgcaaccggcgagtgcggcaagtacatgaactcgtgcgacaacttcgcgcccgtcaacgtgtggacgcaagccgttccctacgtgctcgtcgggttctccgagatcttcacatccatcaccggtctggaattcgccttcaccaaggcccccaagaacatgcgatcgcttgttacttcgtactggcacttcatgtctgcgttttccaacgcgcttggccaggcgtttgtctcgctatccgaggacccgttgttggtgtggaactacactaccgttgctattctggcgttcattggaggtgtcttgttttggttccatcagcgcccaacggacaagcaggaggacagcctcaacatgcttcccgactccacgtatatgggcaaggaccgcaggcacagtgttgccgaggagagtgccaggcatgcttag

SEQ ID NO: 8378 - protein, 623 aa, Phaeosphaeria nodorum
MTSTTAQNAVDMAMSHEPKVATPMYEVTEKQALSGKDVASSTAGSQHLAPVVEFEADLEGEEPTEEELATLRRVSGKIPWTAFTIAFVELCERFGYYGCQVLYTNFIQQDLPVIDGVVQSTGRDPRSDGQPGALGMGQRASFGIGQFNSFWSYTTPIIGAIIADEYLGRFNTIFIAIAFSILGHILLIVSAIPTVLTSGNAIAPFILGVILLGFGTGAFKANISPLIAEQYRQSKPRVIVEAKTGERVITDPNITISRIFLYFYMFINIGSLTGQISMVYVEKYVGFWCAWLLPTIMFCFCPIVLWFCKGKYHLNPPTGSVLIRAIKLLKLACKGKWSLNPAQTRKNFKSERFWEDVKPSHLGASKPHWMQFDDAWVDQVARGLRACSCFTWIPLYWLSYNQMNNNLTSQAATMERNGVPNDIITNLNPISLVIFIPIVDNFLYPALRKAGIKFTPIKRIAFGFLLASLAMVGAAVIQHYIYATGECGKYMNSCDNFAPVNVWTQAVPYVLVGFSEIFTSITGLEFAFTKAPKNMRSLVTSYWHFMSAFSNALGQAFVSLSEDPLLVWNYTTVAILAFIGGVLFWFHQRPTDKQEDSLNMLPDSTYMGKDRRHSVAEESARHA

SEQ ID NO: 8379 - DNA, 1656 bp, Phaeosphaeria nodorum
  CDS (1)..(1656)
atggccacggacattgagacgcagaacaaggaccttggtcgacaggatacgttcgaggagaagtcccctatagcagattcggaatgggtgagcttcagaagagttcccgacaagctgcccaagatcgctttactcattctggctgtcgagctgggtgagcgcttcacatactttggtctcagcggacctatacaaaactacatcaacaacccttatgcccctggatccgaccttccaggagcacttggcaaaggacaggccgttgcaacagctctaggaaactttttcaaattctgggcgtatgcatccaccatcatcggagctataattgccgaccaatacctcgggaagttcaaggccatcctcgcagcatctgccgtttacattgttggcctggtcattctggtcgcgacctcgacaccatcttcgatccagagcggtgctggatttggcggcctgattgctgcgatgatcacaattggtcttggtactggtggtatcaaggcaaacgtcaccccgatgtgtgcagagcagtaccagaacgctagacccgtgttgaagacgctcaagactggggagaaggtggtagttgatccggagctcactgtccagaagcttttcatgtggttctactgggttgtaaatgtcggtgcactatcgccactcatcactgtcaatgttgaggcgcatcactcgttttggcttgcatacctcattccgctcatcgccattatcatctccctggcagtattcttaacaggatccaagaaatacatcaaagtcccaccccaaagttccgccatcgtcgacgccatcaaaaccaccaccatcgcagtccgtgaaaaaggtttccaaaacgctaaaccctcagctcttgctgaatcgcgacgagacgacaagtacaagttctcccgcgagacacgctacactgacacctacgtcgaggatgtgcgccgcggcgttaagagctgcaagatcttcctcttcttccccttctacttcgtctgctggatccaaatctggaacaacctgatctcgcaagccggcgaaatggcgctgcacggcacgcccaacgaccttttgcaaaacctcgaccccatcgcgctcatcatcttcatcccgtttctcgatctcgtcgtgtacccgacgctgcgcaagttcaagatcgactttgacccaattagtcgcattttcgcgggcttcatgctcgtcagtgtgagcatggtgtatgcgagtgtgctacagcattatatttacacgagtcccgagaagagtattcacgtgtgggtgcaggcgccggcgtatgtgttggtggcgtttagtgaggcgtttattattattaccgggttggagttggcgtttacgcaagcgccgaaaaatctccgatcgttcatctcagcgctgttctggattacgatcggcatcgcagctgccatctgcattgcactcagcccggtttcccaggatccttatctggtgtggatgtatgctggtctaggcatcacgggctttgtagccggatgcacattcttcctttgctttcgcaagggcaggaagtggtcagcaacgaatgccgtgatcttggaagcggtgcctgttgatgcccatcctgctgccgttgcgtatcaggaagacaagggtgttggaaagatctag

SEQ ID NO: 8380 - protein, 551 aa, Phaeosphaeria nodorum
MATDIETQNKDLGRQDTFEEKSPIADSEWVSFRRVPDKLPKIALLILAVELGERFTYFGLSGPIQNYINNPYAPGSDLPGALGKGQAVATALGNFFKFWAYASTIIGAIIADQYLGKFKAILAASAVYIVGLVILVATSTPSSIQSGAGFGGLIAAMITIGLGTGGIKANVTPMCAEQYQNARPVLKTLKTGEKVVVDPELTVQKLFMWFYWVVNVGALSPLITVNVEAHHSFWLAYLIPLIAIIISLAVFLTGSKKYIKVPPQSSAIVDAIKTTTIAVREKGFQNAKPSALAESRRDDKYKFSRETRYTDTYVEDVRRGVKSCKIFLFFPFYFVCWIQIWNNLISQAGEMALHGTPNDLLQNLDPIALIIFIPFLDLVVYPTLRKFKIDFDPISRIFAGFMLVSVSMVYASVLQHYIYTSPEKSIHVWVQAPAYVLVAFSEAFIIITGLELAFTQAPKNLRSFISALFWITIGIAAAICIALSPVSQDPYLVWMYAGLGITGFVAGCTFFLCFRKGRKWSATNAVILEAVPVDAHPAAVAYQEDKGVGKI

SEQ ID NO: 8381 - DNA, 1878 bp, Phaeosphaeria nodorum
  CDS (1)..(1878)
atggcacaggctcacgaaaccactgcggccgagcagttggtaaacatgcaggctgaggcaaaccaaaagccgcatctcttcggcgcctccgtgaacgatgccaacgtcggcgcaaacgtccatgtcgcagacgaaaaggaaattatcgagaagcaaagcggcagtaacagctctggtgcttccgtgcgcctagccgaccacgaggaagaagatggtcttggtggtgtcgcgcccacggctgaggagctccgcactcttcgcaaggtcggcgagcctctacccaagtctgctttcttggtagctgttgtcgagctctgtgagcgcttcacgtactatggtgcctcgggtcttttccaaaactacattgcgcgcccgcgtagtggagagcttggtcgtggtgcgctcggcatgggtcatcggggcgccaccggtctttcgacgttcttccagttctggtgctatgttactccgattcttggtgccattatcgctgatcaatacctcggaaaatacaacaccatcgtcatcttctgcggcgtgtacatggttggtctcctcattttgacatgcacatccatcccagcggctcttgaccatggcgccggactcggtggtttcatcgttgccatcatcgttatcggtctaggaactggcggtatcaaatcgaacgttgcaccgctcatcgcggaccagtataagaggagaagaatggtcattggccacgacgacaagactggcgagaaagtcatcatcgaccctgcaatcaccatccagaggatctacatggtgttctacttttgcatcaacgtcggttgcttgtccctgctcgctacaccctacatggagcgcgatatcgacttctggtccgccttcctgctgtgcctctgcgtcttcttcgtgggtacgctcgtccttgttctcggtcgcaaggtctacgttgttcgaccaccgcagggctctgtcatcactgatgctttccgcgtcatgtggttgatgatcaagacgcgcaagatggatggcgcaaagccctcgtatcaggctggacttggaaagaccactgtgctgcgctgggatgaccactttgttgaggaagtgaagcgtgcgcttgtagcttgcaaggttttctgcttctatcccatctactgggtcgtctacggtcaattctcgaacaacttcatcacccaaggtggacagatggccacccacggcattcccaacgatctgatgcagaacttcgaccccatcgcaatcatcgtattcctgcccctcgtcgaccaggtgctaatgcccttcctccgcaagaagaagatccccttccctcccatcaaccgtatcgtaaccgggttctgggtcgcttccctcgccatggtctacgccgccgtcatccaatactacatctaccaaaccggcccctgctacgaccatcccaactgtgaggcagcaaagggcgccgacggcgtcctccacggcaacaacatccacatcgccgcgcaaaccggcgcatacatgctcattggtatctccgagatcttcgcctccgtcaccggtctcgaatacgcatacaccaaagcgcctccctccatgaaatccttcgtgcagtccatgtacctcctcacgaacgccttcggatccgccatttccgaagcactcaaccccgtcctgtacgacccgaagatccagtggatgtacgttggtctggcggtatcgagtttcattgctggatgtcttatttggattattttccaccatttgaatgagacggaggatgagatgaatcaacttgatcgcgattatgacaaggatgagacgttgaggaggagtagtgtgcatgcggatcggacggttggactgcatgataaggacgcggagaaggcgtag

SEQ ID NO: 8382 - protein, 625 aa, Phaeosphaeria nodorum
MAQAHETTAAEQLVNMQAEANQKPHLFGASVNDANVGANVHVADEKEIIEKQSGSNSSGASVRLADHEEEDGLGGVAPTAEELRTLRKVGEPLPKSAFLVAVVELCERFTYYGASGLFQNYIARPRSGELGRGALGMGHRGATGLSTFFQFWCYVTPILGAIIADQYLGKYNTIVIFCGVYMVGLLILTCTSIPAALDHGAGLGGFIVAIIVIGLGTGGIKSNVAPLIADQYKRRRMVIGHDDKTGEKVIIDPAITIQRIYMVFYFCINVGCLSLLATPYMERDIDFWSAFLLCLCVFFVGTLVLVLGRKVYVVRPPQGSVITDAFRVMWLMIKTRKMDGAKPSYQAGLGKTTVLRWDDHFVEEVKRALVACKVFCFYPIYWVVYGQFSNNFITQGGQMATHGIPNDLMQNFDPIAIIVFLPLVDQVLMPFLRKKKIPFPPINRIVTGFWVASLAMVYAAVIQYYIYQTGPCYDHPNCEAAKGADGVLHGNNIHIAAQTGAYMLIGISEIFASVTGLEYAYTKAPPSMKSFVQSMYLLTNAFGSAISEALNPVLYDPKIQWMYVGLAVSSFIAGCLIWIIFHHLNETEDEMNQLDRDYDKDETLRRSSVHADRTVGLHDKDAEKA

SEQ ID NO: 8383 - DNA, 1812 bp, Hebeloma cylindrosporum
  CDS (1)..(1809)
atggccaccacttactctcccgagaaagctggttcaaaagagctcgtacccaccacctcactcgacgacgagaagcttgggcactctactgacgaggtcttcattgaaggctctgagggcgttactcagcacgacctcgataccctgaggcatgtcgccgacaggcttcccgtctctgcttggttggtcgccatcgttgagttcgctgagcggtggacatattacggtactacgaacatcttcaacaactatatccgtgctcctctcccaaaattctccaccactggcgccgtcgtgattgccgctgatcgtgctaatggtgtcgctggtgcactgggtaaaggacagcagatctcgttcgccatccgtacctttaacagtttctgggtttacattacgccgtgggctggcggaattctcgcagacacaatgtggggccgatacaagactatcatgatcttctccatcgtttgcttgatcggccatattatcctcgtggcctctgcaagtcctgcctccctcgagaactcggatgcagctttgggcctgcttgcgctttcaattgtgatcatgggcctcggcgccggtggtatcaaggctaatgtctcccctatgattgctgagcaatacactgggaagttgcgcaaagtgacgctcccttcaggagaaaccgtcattatgtctcccgctgttactgttcagagtatcttcctctggttctatgctgctatcaacctcggatcctgtggtgccatctcggcgtctttcctcgctcgtgaccatgggtactgggccgcatatctcgttcccacctgcatcttcgtggctgtaccgggtgtgctccttctcggaaagaatttatacgtcaaaacacccccgcgtggttccatccttctagagacaatgcgtgtcattggctttgctcttggagccaggtggtccatcaacccgatgaagacgatccgcgctatcagagctccggacttctgggaccccgccaagccatcgaactacgaggaggggaagcggccagctaagatcacctgggatgacgaattcgttggagaggtttcccgtaccctcaacgcttgcactgtattcatgttcttccccttctactggctatgctactcccaaattgatggaaaccttggcactgttgctgctgccatgaaactcaatggtacacctaacgatctgattcagaatctgaaccctatcagcatcatcatcatgattcccattttcgattatatcatctaccccttcctccgcaagaggggcatcaacttcacaccgattaagcgtatttatgccggtttcctcgtcgctggtcttgccatgctctacgccgccgttctgcaacacttcatcttcaaagagtctccctgccacgataacgagccctccgcctgcgttggcgccgacggcaatccctggccagccaacatcaacgtctgggtcgtctcaggtccctacatcctcgtcggcatgtccgagatcttcgcgtccatcacctcgctcgaatacgcattcaccaaagcccccgcccgcatgaagtccgtcgtcatggccttctcgcagttccaaaccgccctttcctccgctctcaactttgcgcttaccgcggtgaacgtcgagccgagattcgcgtggctctttggttcgtttggtgtcactgcatggattgtcggcaccatcttcttcattgtattccgacccctcgacaggagagaaatcgagctcaatgctattggcaagggcgagcgtgcaggtttcgttgatgaaaagcccgtcgaaagttcatgatga

SEQ ID NO: 8384 - protein, 602 aa, Hebeloma cylindrosporum
MATTYSPEKAGSKELVPTTSLDDEKLGHSTDEVFIEGSEGVTQHDLDTLRHVADRLPVSAWLVAIVEFAERWTYYGTTNIFNNYIRAPLPKFSTTGAVVIAADRANGVAGALGKGQQISFAIRTFNSFWVYITPWAGGILADTMWGRYKTIMIFSIVCLIGHIILVASASPASLENSDAALGLLALSIVIMGLGAGGIKANVSPMIAEQYTGKLRKVTLPSGETVIMSPAVTVQSIFLWFYAAINLGSCGAISASFLARDHGYWAAYLVPTCIFVAVPGVLLLGKNLYVKTPPRGSILLETMRVIGFALGARWSINPMKTIRAIRAPDFWDPAKPSNYEEGKRPAKITWDDEFVGEVSRTLNACTVFMFFPFYWLCYSQIDGNLGTVAAAMKLNGTPNDLIQNLNPISIIIMIPIFDYIIYPFLRKRGINFTPIKRIYAGFLVAGLAMLYAAVLQHFIFKESPCHDNEPSACVGADGNPWPANINVWVVSGPYILVGMSEIFASITSLEYAFTKAPARMKSVVMAFSQFQTALSSALNFALTAVNVEPRFAWLFGSFGVTAWIVGTIFFIVFRPLDRREIELNAIGKGERAGFVDEKPVESS

SEQ ID NO: 8385 - DNA, 1773 bp, Hebeloma cylindrosporum
  CDS (1)..(1773)
atgtccagtgcaatcccgaaggacgaggcagctcttgcttcagcgattgatatgaagaacaacgactctgtgtctctcgaaaagaataccgaggaagaccatgagcttgacggtatccacgatggcctcgaatttccgactgaagaggagagggccacacttcgccgtgtcccagatagcattccatggaacgcctacttgatcgccgtcgttgagcttgcggaacgcttctcattctatggctccagtgtggtcttcaccaacttcatccagcgaccgctaccaccgggttcgcacacaggttctgcgggtcttcatggccaggcgggtgctttgggaatgggtcagcgtgcttcaacaggtctcacaacattctaccaattttggtgttacgttacccctttgattggggcatatatcgccgatgcccactggggtcgtttcaagacgatctgctgggccgtcttcattgccttaattgggcacatcattctcatcgtcgctgccgtgcccggcgtcatcgagaaaaagagtgccatcgggccttttgttatagcgttgatcgttatgggtttcggaacgggaatgttcaaatcaaacatctctcctctggtcgcggagcaatacaagcgcaccaagctattcgtcattaccactaggagcggggagcgcgtgattgtagacccatctttgacagtcctgagagtttacatgtacttctatcttcttattaacatcggagctctgattggtcagattgggatgacatactcagagaagtttgtcggtttctatctcgcgtacacccttccaaccgttgtgttcttgctctgcccactcatcctcttcatcggccgcaaccgttatgcacacaccccgccaactggctcggttctcgccaccgccatccggatgtggcgatatgccgctcgtggtaaatggagcctaaaccccatcacgacttataggaacctcaccgctcctggattttgggagagtgctaaacccagcaagcaggttggcgagaagccagcttggatgaactttgatgatcaatgggtcgatgaggtacaacgtggaatcaaggcctgcggtgttttcttgtggttccccatttactggttgacctataatcaacttaacaataatttgacctcgcaagctgctacaatgacccttaacggcgttccgaatgatgtcctatccaatcttgaccctttcgccttgatcatcttgatccccatctgcgatttgttcatgtaccccttcctccgtcgcatggggatcaacttcagcgctctgaagaagattactgccggtttcatgactggcgccgctgccatgatctgggctgcagtcgtccaacattacatttacaagaccaacccatgcggcaaccaagcgtctgattgcgctgacgtttctcccctcaatgtttggattcaatccggatcctacatcctcattgctatcagcgaggtcttcgcatccatcactggtcttgaatacgctttcaccaaggcacccaagaacatgcgttcacttgtcatgtccatcttcttgttcatgtcggcattatcctctgccctcggcgaggccttcgtttccctctccactgaccccttacttgtctggaactatggcgtgatgggtgtcctcgcccttgtaacgggagccattttctggtggtctgtcagcgaccttgatgccaaagaggacgagctcaacaatttggctgcgggtcatgttggaatctacgacgagaagcattga

SEQ ID NO: 8386 - protein, 590 aa, Hebeloma cylindrosporum
MSSAIPKDEAALASAIDMKNNDSVSLEKNTEEDHELDGIHDGLEFPTEEERATLRRVPDSIPWNAYLIAVVELAERFSFYGSSVVFTNFIQRPLPPGSHTGSAGLHGQAGALGMGQRASTGLTTFYQFWCYVTPLIGAYIADAHWGRFKTICWAVFIALIGHIILIVAAVPGVIEKKSAIGPFVIALIVMGFGTGMFKSNISPLVAEQYKRTKLFVITTRSGERVIVDPSLTVLRVYMYFYLLINIGALIGQIGMTYSEKFVGFYLAYTLPTVVFLLCPLILFIGRNRYAHTPPTGSVLATAIRMWRYAARGKWSLNPITTYRNLTAPGFWESAKPSKQVGEKPAWMNFDDQWVDEVQRGIKACGVFLWFPIYWLTYNQLNNNLTSQAATMTLNGVPNDVLSNLDPFALIILIPICDLFMYPFLRRMGINFSALKKITAGFMTGAAAMIWAAVVQHYIYKTNPCGNQASDCADVSPLNVWIQSGSYILIAISEVFASITGLEYAFTKAPKNMRSLVMSIFLFMSALSSALGEAFVSLSTDPLLVWNYGVMGVLALVTGAIFWWSVSDLDAKEDELNNLAAGHVGIYDEKH

SEQ ID NO: 8387 - DNA, 1674 bp, Trichoderma harzianum
  CDS (1)..(1674)
atgacttccctacccgaggaagagctgcgcactctgcgccgtgtttctggaaagatcaagtggagcatgtacaccattgccttcgttgagctttgcgagcgtttctcctactacggatcttccgtcctgtacacaaattttgtgaaccgccctctccctccgggatcaaccactggttctgctcctgatggccgccccggtgccctgggaatgggtcccaaggctgctcagggtatcagcttgttcaaccagttcttcgcctacatcatgcctctcgtcggtgcctggattgctgatgctcgcatgggtcgtttctggactcttcaccttgccattggtatctccaccattgcccacgttattctcgtcgcctctgccgcccctggtgttatcgtgaagaaggacagcgctttcgccgccttcatcattggtctcatctgcctctgcgttggtactggtttcttcaaggccaacgtctctcccctccttgccgatcagaacgaagatagacgcatgcgcgtcgagacccttgcctctggcgagaaggtcatcatcgaccctgctgtcaccaacacccgtatcttcctctacttctactttgccatcaacatcggatctcttgccggtcagattgccatggtctacgtcgagaagtacgtcggtttctgggttgctttcctcatccctaccggcatgttcctcctcgcccccgtcgtcctgtggagccagaagaagaactaccgcctgcagcctcctaccggctccctgctccagaagttcatgcagatgttcttctatgcccgcaagaggtcaaagggctttttcaagatcgactgggatgttgttcgcccctctcgcatcgccatctctgaccgacccaagtggatgacctacgacgatgcctgggttgatgaggtccgccgtggtctcatggcctgcaaggtcttcctcttcctgcccgtcttcttcctggcctacaaccagatgactggtaacctgaccatccaggctggtaccatggagctgcacggtgtccccaacgacattatccagaacctgaaccccatctccattgtcatcatgattcccctcatcgaccacctcctgtaccctggtctccgcaagatcggcgttgctttcacccccatcaagcgtatgaccactggtttcttcattgcctctctctccatggttgcctctgccgtcatgcagcactacatctacaagatgagcccttgcggtgatcacgccaacggcaccatcatcgtcgacggcgaggaggagctctgccctcctgctcctatcaatggctgggcccagtccttgccctacatcctgattggtttcgccgaaatcttcgccaacgtcacttcctacgagtatgcctactccaaggcccccgagaacatgaagtctcttgtcatgtctgtcaacctgttcatgagcgccatctctgccgctattggcgaggccttcactcctctgtccgatgaccctctgctggtctggaactacaccgctgtcgcctgcattgccttcgttggtggtgctgccttctggttctgcttccgacacctcgactccgacgaggacaagtggaacatgctcaagaagtccgagttcattggccagaaccaacctggtctgggcaaggaggccgacgaggagccttaa

SEQ ID NO: 8388 - protein, 557 aa, Trichoderma harzianum
MTSLPEEELRTLRRVSGKIKWSMYTIAFVELCERFSYYGSSVLYTNFVNRPLPPGSTTGSAPDGRPGALGMGPKAAQGISLFNQFFAYIMPLVGAWIADARMGRFWTLHLAIGISTIAHVILVASAAPGVIVKKDSAFAAFIIGLICLCVGTGFFKANVSPLLADQNEDRRMRVETLASGEKVIIDPAVTNTRIFLYFYFAINIGSLAGQIAMVYVEKYVGFWVAFLIPTGMFLLAPVVLWSQKKNYRLQPPTGSLLQKFMQMFFYARKRSKGFFKIDWDVVRPSRIAISDRPKWMTYDDAWVDEVRRGLMACKVFLFLPVFFLAYNQMTGNLTIQAGTMELHGVPNDIIQNLNPISIVIMIPLIDHLLYPGLRKIGVAFTPIKRMTTGFFIASLSMVASAVMQHYIYKMSPCGDHANGTIIVDGEEELCPPAPINGWAQSLPYILIGFAEIFANVTSYEYAYSKAPENMKSLVMSVNLFMSAISAAIGEAFTPLSDDPLLVWNYTAVACIAFVGGAAFWFCFRHLDSDEDKWNMLKKSEFIGQNQPGLGKEADEEP

SEQ ID NO: 8389 - DNA, 1827 bp, Erysiphe graminis subsp
  CDS (1)..(1827)
atgcagtcaagtccagacagagagactaaccaaaataaatcggacaatttattgactgtttctcaaagggatgttacttttaagtcaaattctgcgggacaaccggccagtatgtacgaagatgaagatcatactcagtctatctttccgtctgagctagaaatattcaccttaagaagagtgcctgatctatatacctttgagattgtatactctagcattcgtagagctgtgcgagcgcttctcctactatggaacaacggttgtgtgtcagtaatttatcctcctttagaaactggtcctcactcatggatatttacagttaccaatttcattcaacaggcacttcccttaggctcaacaactggtgccgggctggggggacaatctggcgctctgggactagggcagcaagcatcaacgggaataggaatcctcaatcaattctgggtttatcttactcccctcctcggcgcctacgttgcagacacatatcttggtcgttataagactatctgtattgccctcgctgtcgctattgtgggccatattatcttggtgatttcggcaacccctccgatcattgcgcatcccaagaactcattggcctgcttcctcgtcgggcttcttgtcatgggcttaggaacgggctctttcaagcccaatatatctccgatgatcgccgagcagttaaacctcaccgagatggtggtcagaactctacctacaggtgaaaaggttatcgtcgaccccttagttacgcagagtagagtttatcattacttttacctcttcatcaatattggctccatcgttggtcagatcgggatggtatactgtgaaaaatacgtagggttttggctcgcatttttactaccgaccatactacttggaatctgccctctcgtcatgtggtatgcacgcgacaagtactcccgcactccaccagatggtactgtgctagcaaagactatcaggctttttgtaatgggaaataagggtcgatggtccttaaatcccatatctacctacagacgcctcaatgatggcactttctggacacttctcaagccttccttaattccagaatctcagcgtccatcctggatgacatttgacgatgaatgggtcgaggaggtacgacgtggtttcggagcttgcgcagtattttgctggataccactttactggctaacttacaatcaactcaataataatctgacttcgcaagcagcagttatgcagctacatggtgtaccaaacgatgtactctccaatattgacccattcacattaattatactcattccagtatttgatatttttctttacccgcttcttcgcaaggccaggattaggttcacgccaatcaaaagaattacggctggcttcttcatgggatcggccgcaatggtctgggcggccattgttcaggctaatatttaccagaaatctatctgcgggaatagagcagctgggattcttcctgcccctctcggtggagatggccggatgctgtgtccacctgcagcaatcaatgtctggatgcaatctggctcgtatgttctcattgccattagtgaaatcttgaccagcataactacgctcgaatatgccttctctaaggcgccgaaaaacatgcgaagtctcgtcatggccttcaatattttcatgactgctatctcagctgccctaggcgaagccttcgtcgccctaagtgcggatccctttctaatctggaatttcagcgtcatggcggcactaagcgctgtgggggggacttgtttttggttgcagtttcaaaagctcgatcgtgaggacgaatga

SEQ ID NO: 8390 - protein, 608 aa, Erysiphe graminis subsp
MQSSPDRETNQNKSDNLLTVSQRDVTFKSNSAGQPASMYEDEDHTQSIFPSELEIFTLRRVPDLYTFEIVYSSIRRAVRALLLLWNNGCVSVIYPPLETGPHSWIFTVTNFIQQALPLGSTTGAGLGGQSGALGLGQQASTGIGILNQFWVYLTPLLGAYVADTYLGRYKTICIALAVAIVGHIILVISATPPIIAHPKNSLACFLVGLLVMGLGTGSFKPNISPMIAEQLNLTEMVVRTLPTGEKVIVDPLVTQSRVYHYFYLFINIGSIVGQIGMVYCEKYVGFWLAFLLPTILLGICPLVMWYARDKYSRTPPDGTVLAKTIRLFVMGNKGRWSLNPISTYRRLNDGTFWTLLKPSLIPESQRPSWMTFDDEWVEEVRRGFGACAVFCWIPLYWLTYNQLNNNLTSQAAVMQLHGVPNDVLSNIDPFTLIILIPVFDIFLYPLLRKARIRFTPIKRITAGFFMGSAAMVWAAIVQANIYQKSICGNRAAGILPAPLGGDGRMLCPPAAINVWMQSGSYVLIAISEILTSITTLEYAFSKAPKNMRSLVMAFNIFMTAISAALGEAFVALSADPFLIWNFSVMAALSAVGGTCFWLQFQKLDREDE

SEQ ID NO: 8391 - DNA, 1629 bp, Aspergillus oryzae
  CDS (1)..(1629)
atgagcacaggagacgatatcgaaggacagaaagtggccacatccaatgaaagtaaaggggatccacagcagtttcaaacggtagtaagtgcgcatgacgaagaagatttacttcctgtggtagacgacgtatccttcccagtatggttgatcgcgttcgtgggagctgccgagcgtttcgcctggtatgggccgaccacccctttgcacgagtctttctcaaagaattacatccagcattctccttccagcaatattcccggcgtactgggcctgcgcgaagcgatggcaaccaatattgtgaacgcgatgatggctgccggttatctcgcaacgatcccagcagcagtcatggctgatatgtggttgggtcgctatagaactattctggtctctgctctcgtccaactctgcggctctgcgattttgttcgagacctcctttcctcgcgccgttcaagccggtgccgcagaaggtggattagccaccgctatcgtgctcatctctccaggctcaggaggcgtgcgatcctccatcgctccatttatcggtatgtcacaatggaagcaccagttgcctggagttgacaacctcttcgagctgaccggccatagcggagcagtcaaggtagtaaagaacggacaaaaatcgagagcttacaatccaatatatctacaatgtgtactactagtatttcgtccccgtgcctcgtttcgacatctagcactgttgacacctcgccctatgatggtgaatgtgggtggactgtcggccctgatgaccacaattcttgagaagtatgttggatactgggtcgcgtacctggtgcccttgtgcatgatggttctatcggttgtgccattgctggcgtggcgacatacgctcgtccaacgcccaccaagtggctctgtgctgccacaagccagtagagcaatgatggacgaggccaagccagaaaaacaacaagagaagcaccaccgacaggtgccctggaccgatacattcattgacgagttgaagagtggattactcgcatgtcgggtttttctcctctttcccgttcattggttgtgcctgaatcaaaccttcaataacctcatttcccaggccggacagatggttaattccggagttccgaacgacaccatcaagtcacccaaccctattgccagcattatcctgactccagtggcctcaaagggatccgattcgggcccatggcccggattgccatgggattcctatttctcaacctcgctatggtttacaccgcgatcctgcagaaattatgcccggagtcagatcatggccagattcccaatcaaatctccatgttccctgcaagcaccaatctacgtcctcggtgcaattgcggaaatcttctgtttcaccacggggacagaatacgcctacaaaaaagccccaaagacgatgaaatcgatgattcaatcggtgtggatggccaccgctggagttggagcttgcctggccatggcttttacgccaataaccaaggaccttcatctggttatcatgtattcgtcattggcgggcgtcatggccatgacaacggttttgttcggggcattctttgggaagcacaatagagagaagaccctccttctatga

SEQ ID NO: 8392 - protein, 542 aa, Aspergillus oryzae
MSTGDDIEGQKVATSNESKGDPQQFQTVVSAHDEEDLLPVVDDVSFPVWLIAFVGAAERFAWYGPTTPLHESFSKNYIQHSPSSNIPGVLGLREAMATNIVNAMMAAGYLATIPAAVMADMWLGRYRTILVSALVQLCGSAILFETSFPRAVQAGAAEGGLATAIVLISPGSGGVRSSIAPFIGMSQWKHQLPGVDNLFELTGHSGAVKVVKNGQKSRAYNPIYLQCVLLVFRPRASFRHLALLTPRPMMVNVGGLSALMTTILEKYVGYWVAYLVPLCMMVLSVVPLLAWRHTLVQRPPSGSVLPQASRAMMDEAKPEKQQEKHHRQVPWTDTFIDELKSGLLACRVFLLFPVHWLCLNQTFNNLISQAGQMVNSGVPNDTIKSPNPIASIILTPVASKGSDSGPWPGLPWDSYFSTSLWFTPRSCRNYARSQIMARFPIKSPCSLQAPIYVLGAIAEIFCFTTGTEYAYKKAPKTMKSMIQSVWMATAGVGACLAMAFTPITKDLHLVIMYSSLAGVMAMTTVLFGAFFGKHNREKTLLL

SEQ ID NO: 8393 - DNA, 1827 bp, Aspergillus oryzae
  CDS (1)..(1827)
atgaatccctccgacccctcggagacggtcgaggtcgccaaagcgacagccaaccttcatgatgcccatttgaatgaaaaaaaggctccttccattgacaaggacttggacatcacaccgagtattgaagaagtaccggcgaccaaagttgttggcgccaccaccgatgataccgatctccaaaagacctatccgaccgacgaggaactgagaaccctgcgtcgagtgtgcggacaaatcccatggacctcatataccgtggcgtttgtggaactgtgcgagcgattctcctactatggaaccacagccgttttcgtcaactttatccagcgtcccatgccggcaggctcctccaccggtgcgacctatgatagttcacgagtgccgggagcgttgaacatgggccaacaggcctccactggtttgaccttgttcaattccttctggtcctacatcatgcccacggccggcgcattcgtggccgatcaatacttgggtcgattccgcaccatcatgtactccatcgctgccgctttgcttggccatttgattctggtcatctccgccattcccagcgtgatctcccacccccagggcgcgatcgcctgtttttcgatcggtctgatcatcatgggcgtgggaacgggcggtttcaaatcgaacatttcacccctcatcgccgagcagtatcgcgaggaatatccatacatcaagacccttgcctccggggaacgggtgatcgtggacccagccatcaccgtccagcggatctacctgtactactacttgactgtcaacattggttccatcaccggccaggtgagcatggtctatgccgagagatatgttgggttttggctctcgtacttcctgccgacatgcttgtttctgtggtgcccgacggtgttgttcctctgccggaacaagtactaccgggtgaaaccacaaggctccgtctacacacaggcgttccggctctggaagctggcgatgaaggggcggtggtcgctgaacccggttcggctgttcaaacgcaatgacaagccattctgggaaccagtcaagccgagtgctttgggtcctaatcgtcctcagtggatgaccttcgacgacgaatgggtcgacgaggttgctcgtgggctgaaagcgtgcaaagtgttcctgtggtaccctctgttctcggccaccatgcacctcggtggtgtccccaacgacatcatcaataacctcaacccccttgccttgattatatgcattcccatttttgatcgggtcatctaccctggcctgcgacacctgggattcaactttacgcctattaagagaatcacgtgtgggttcgtggttgccggctgctccatgatcgccgccacggtgatccaacactacatttacgtgaaaggcccttgcggcaaagaggccaactactgtctcgatgaatatggaaagtattcgcccatctccgtctggacccaggcaattatctacatcctcggtggtatctccgagatctttgcctccatcacctccctcgagtatgccttcaccaaggcccccaagaacatgcggtcgatcgtacaggccgttgcactcttcatgaacgccttctcctccgccatcggccaggcctttgtcggcttgtctaaggatcccttgctggtgtataactatatggtggtgacgatcctagcctttgtcggtgccattggattctggttgagcaactacaagctggatcggagggaagacgagttgaacaacctgccgcagagcaaatataccgaaaagaatggcgtgagtttggacgaggagaatgcccggaagtaa

SEQ ID NO: 8394 - protein, 608 aa, Aspergillus oryzae
MNPSDPSETVEVAKATANLHDAHLNEKKAPSIDKDLDITPSIEEVPATKVVGATTDDTDLQKTYPTDEELRTLRRVCGQIPWTSYTVAFVELCERFSYYGTTAVFVNFIQRPMPAGSSTGATYDSSRVPGALNMGQQASTGLTLFNSFWSYIMPTAGAFVADQYLGRFRTIMYSIAAALLGHLILVISAIPSVISHPQGAIACFSIGLIIMGVGTGGFKSNISPLIAEQYREEYPYIKTLASGERVIVDPAITVQRIYLYYYLTVNIGSITGQVSMVYAERYVGFWLSYFLPTCLFLWCPTVLFLCRNKYYRVKPQGSVYTQAFRLWKLAMKGRWSLNPVRLFKRNDKPFWEPVKPSALGPNRPQWMTFDDEWVDEVARGLKACKVFLWYPLFSATMHLGGVPNDIINNLNPLALIICIPIFDRVIYPGLRHLGFNFTPIKRITCGFVVAGCSMIAATVIQHYIYVKGPCGKEANYCLDEYGKYSPISVWTQAIIYILGGISEIFASITSLEYAFTKAPKNMRSIVQAVALFMNAFSSAIGQAFVGLSKDPLLVYNYMVVTILAFVGAIGFWLSNYKLDRREDELNNLPQSKYTEKNGVSLDEENARK

SEQ ID NO: 8395 - DNA, 1788 bp, Aspergillus oryzae
  CDS (1)..(1788)
atggctccccaggactccctagaatcaaactcattcagtggagataagaaggctgtgttcaccgtatcagacgaagaaaaggcctctccatccacgaccgagcccgtctacgatggtgaccagtatctgggtcaagcacccaccgaggaggaattaaataccctacgcaaggtcgcgggccctgtatcaggatccgggtattggctctgcaccgttgagtttgcagaacgtgcctcctattatggctgcacctgggtctttcagaatttcattcaataccctcttccgcctggtgggaatggtgcgggagcgtcggcgccagggtccgagaagcccgcaggagcattagggcagggattgcaggtctcgtccgccctgacgctgttgttcaagttccttgcgtactgtattcccatctttggtggctggctagcggatacaagactgggtcggtataagacaatctgtatcggtgtggtcatttgcggtgtttcgcatgttatcatggtggtcggtgcgattccgagcatattacaggccggccatggcatggctccgttcattgtcagtttgatgattctcgcattgggagcaggtatattcaaaccgaatatatccccgactgtcatggaacaagtcacgttcaagcatccttacattatgacgctcaagtccggagaacgggtcattgtgcaccctgaaaccactatccaacgacttacacttacattctacgctctgatcaacgtgggtgctttcttcgggctggcgaccagctacgccgcgaagcgtgtcggatattggctggcattcctgctccccggcattatttacttcttgatgccgattatcctggcgttagtatacaagaagacaattaaaactcccccacaagggaacattctgggagacaccttgcgtgttatcaaactggccatccaacaaaatgggttccggaagttcggatcggaggcgtatttcgacccagtcaagccatcggagcttgcgcggaaggggatcgcatcatacaagggaaaaccgatcagctggaacgacgggttcgtggacgatgttcgacgcacgctggtcgcttgccaaatcttcctcttctaccccctttattatctcaacaacggaggcatcggaagtattaccaactcgcaagctggatcaatgacaaccaaaggtgcaccgaacgacctcgttagcaacttcaatcctctaactatcatcatcgcatccccgatcctcaactatggtctttatcctttacttcgcaagcatcggatcgaattcggccctattaaacgtattacactcggcttcatcctcgccgctctaagctgtgtcgtcggcgccctcctccaatggcgcgtctacgaaacctcaccttgcggctactacgcgacagaatgtgacatcggcagcggcgtctccccgctctccgtctgggcccagatcccaatgtacgttctccaggccctctcagagctcttcgccgtcgtcagcggatacgaactgtccttctcgcggtctccgaagagtatgcgtgcgttggtcgtcgctctcttcctttttatgtctgccgtctcgtccgccatcagtcaggctgttgttccggcgttggcggatccacatcttatttggccgtttgtggggactgctgtccccggggtgattctggccggggtattttattggatgtatcgggatttggataaggagacgttcttgagggaggattcggatagtcaacaggagattctgtcggagaaggataaaagctag

SEQ ID NO: 8396 - protein, 595 aa, Aspergillus oryzae
MAPQDSLESNSFSGDKKAVFTVSDEEKASPSTTEPVYDGDQYLGQAPTEEELNTLRKVAGPVSGSGYWLCTVEFAERASYYGCTWVFQNFIQYPLPPGGNGAGASAPGSEKPAGALGQGLQVSSALTLLFKFLAYCIPIFGGWLADTRLGRYKTICIGVVICGVSHVIMVVGAIPSILQAGHGMAPFIVSLMILALGAGIFKPNISPTVMEQVTFKHPYIMTLKSGERVIVHPETTIQRLTLTFYALINVGAFFGLATSYAAKRVGYWLAFLLPGIIYFLMPIILALVYKKTIKTPPQGNILGDTLRVIKLAIQQNGFRKFGSEAYFDPVKPSELARKGIASYKGKPISWNDGFVDDVRRTLVACQIFLFYPLYYLNNGGIGSITNSQAGSMTTKGAPNDLVSNFNPLTIIIASPILNYGLYPLLRKHRIEFGPIKRITLGFILAALSCVVGALLQWRVYETSPCGYYATECDIGSGVSPLSVWAQIPMYVLQALSELFAVVSGYELSFSRSPKSMRALVVALFLFMSAVSSAISQAVVPALADPHLIWPFVGTAVPGVILAGVFYWMYRDLDKETFLREDSDSQQEILSEKDKS

SEQ ID NO: 8397 - DNA, 1719 bp, Aspergillus oryzae
  CDS (1)..(1719)
atgtcaactccagagcctgtgtccgatgcgagcgaacgcacccctctcctctcccccagctcagatgagacggcggatgatggtgtcatttcgccgcctactgatagtctgagaagagtcgcagattcacttccactctcggtttggctcgttgcgactatcgagatgtgtgaaagatttgctttctttgggactatggggcctatgcagaattacatccagaatcctagggatgacccgctgcgtcctggtgggattggcctgggacaagcgtatgccacgatggtgaaccagggcttcttgctgtggtgttacataaccccagtattgggcgcagttgttgcggaacagtattttgggagagtaaagactattatctattcttcaacgatttacatctgtggcttgacgatgctcttcatgtcctcgttgccaattgcacaggatctaggcgtgtcattagctggactactttcagccctgttctttattggcatcggtgccggcggcattaaggcgaatgtcagttcgttgatcgcagagcaatacgccgggcccaacgaagccaaacgcgtcttaaactctggagaagaggttatcgtggacagggctctaacaatcgaaaggatattctcaaccttctacctattcatcagcataggctccttcggccccttactcacaacaacaatcgaacaaaaacacggcttcagcgccgcatttgctctcccaatcctagtcttcctcctcggcttcatcgtcatcctatccagcaaaaaccaatacatcacccgacccccagaaagctccatcgtcttcaacgcctgccatgcattctggatcgcactcaaacacaaaggaaacctcgactacgcaagacccagctacctcgcagaagcagcatcagcgtcagggtcaaggtcagagttagaacccgaatccaacctcccctggcccgacaccttcatcgacgacctcaaaaccgctctatcttcctgcaaaatcttcctctacccaatctactgggccgcctacacccaattcgtaaccaacttcgtctcccaagccgcaacgatgaaaacccacggtatccccaacgacatcatgcccaacatcgacaccttcagcgtcctcctcctcctcccactcatcgacagggtcatcttcccctttctacgaagacacggcctcccagtccgccacatagacagaatcaccctcggcttcatcctaatcggcacatccatgctctacgccaccttcgtacaaagagccatctacgcctctccaccttgctacaaccacccccgagcccccgattgtctaggcgggaaagtcccgaaccagatttccattttcgtccaagccccagcgtatatactcgttgccgggtcggagattctggcctctgtggcggggatcgagtatgcttatacgaaggcgccggtgtctatgaagtcgttggttatggcgggttatctttcggctacttcggtgggcgcgttgttggctatgacggtttcgccgttgacggtggatccgttgttgccgtggttgtatgttactcttgggttggagaattttttggcggggggtgtgctttggtttgtttttgtaggctatgacgagatcaagaatgaacacaaaaacgtagaagatgactcgtctagacatgcaatatctagtcttaaccatgacgccaattttcagacactttaa

SEQ ID NO: 8398 - protein, 572 aa, Aspergillus oryzae
MSTPEPVSDASERTPLLSPSSDETADDGVISPPTDSLRRVADSLPLSVWLVATIEMCERFAFFGTMGPMQNYIQNPRDDPLRPGGIGLGQAYATMVNQGFLLWCYITPVLGAVVAEQYFGRVKTIIYSSTIYICGLTMLFMSSLPIAQDLGVSLAGLLSALFFIGIGAGGIKANVSSLIAEQYAGPNEAKRVLNSGEEVIVDRALTIERIFSTFYLFISIGSFGPLLTTTIEQKHGFSAAFALPILVFLLGFIVILSSKNQYITRPPESSIVFNACHAFWIALKHKGNLDYARPSYLAEAASASGSRSELEPESNLPWPDTFIDDLKTALSSCKIFLYPIYWAAYTQFVTNFVSQAATMKTHGIPNDIMPNIDTFSVLLLLPLIDRVIFPFLRRHGLPVRHIDRITLGFILIGTSMLYATFVQRAIYASPPCYNHPRAPDCLGGKVPNQISIFVQAPAYILVAGSEILASVAGIEYAYTKAPVSMKSLVMAGYLSATSVGALLAMTVSPLTVDPLLPWLYVTLGLENFLAGGVLWFVFVGYDEIKNEHKNVEDDSSRHAISSLNHDANFQTL

SEQ ID NO: 8399 - DNA, 1689 bp, Aspergillus oryzae
  CDS (1)..(1689)
atggcgaggattgttgaagctggaagcggccccgcggacattaatgacgaatctctctcgcctcgagatgctacagatgaagagattgagtctctgaggcatgtcgttgacaaactacccagaaaagtctgggtctccttgatcgtaagtggagcagagcgcttcacatactacacaatcacaactccgtggcagaactacatacagaatgctccgggtgatggtgccgtgccaggttctcttgggcttgggcagtctcgggcgaccatgatcttcaatgccttctacttattctattatttggtgcctatccccgtcgcccttgtatcggacgcatggctagggcgatacgcggttctctgtatcagcctgagcttgtatttctgtggcacgctcgtacagtttataacgtctctaccttcacttttccactatgaatcaggcctagcaggccttgtcctctctatgatactaataggtatcggtgttggaggaacgaaagcagcaatcacgcccttcatcggagatcaatacccggtcaagcctgcacaagtgaagaccctagcgaccggagaacgcgtgatcatagatcgaaccttgacgttacaatatgtgtacaacgtctactactggatcaccaatatcgccgcactttccatcctggcatcgacgtatctcgaaaaggaacgtggcttctgggcggccaatgtccttgcattgtgctcatcctggatcggggttgccttgcttgctatatttggcaaggaactcgaacggtatccagctcaaggcggtgttttgttaaaagctggaaaggttctggcctatgctatccacgataagttcaagatcgacgccgcacgaccacgctaccaattagaaaagcacaatcgggcagtcccatggacggatcgtttcgtcaccgagattaaaagtggccttcgtgcatgtcaagttatggcctggttcgtgttattccatctgggcatcaatcagatgaccaacaacctcgtttcgcaagcaggcgaaatgcaactcgacagctttcccaatgacgggattcaggttctaaacccaatcgcctgcgttttactcggtccagtcatccagaaaatactctacccaacccttacgagataccagatcccctttggtcccctcatgcgcatgaccatggccttctttacaatggcagcgacgttcgcctacgctgctggagtgcagaagatgatctacaattctggtccctgctacgaggctccattggtttgtccggcggcgcaaagagtcggacagcccgccttgcccaatagaatcaaggtctgggtgcagacgcctatatatgtgatcttagccgtgtctgaaatattcggcttcgtcactctcagtgagtatagctacagtaaggcacccaaggatatgcgcactgtagtccagtcaatgaggcagctgagtgctggcattggaagcgctatcggtatagctctcggtccggtttctcgtgatccaaaggtattgtggatggacgtcggactggcagtaagtttggcgctttcgggggtattgttttgggcggttatgggtcaccttgaaaaggataaggaagatttggacacgatgtatctgagcgaggaccaggatagggcggcacacactggggttgaggccggttcaggaagtaaaaactga

SEQ ID NO: 8400 - protein, 562 aa, Aspergillus oryzae
MARIVEAGSGPADINDESLSPRDATDEEIESLRHVVDKLPRKVWVSLIVSGAERFTYYTITTPWQNYIQNAPGDGAVPGSLGLGQSRATMIFNAFYLFYYLVPIPVALVSDAWLGRYAVLCISLSLYFCGTLVQFITSLPSLFHYESGLAGLVLSMILIGIGVGGTKAAITPFIGDQYPVKPAQVKTLATGERVIIDRTLTLQYVYNVYYWITNIAALSILASTYLEKERGFWAANVLALCSSWIGVALLAIFGKELERYPAQGGVLLKAGKVLAYAIHDKFKIDAARPRYQLEKHNRAVPWTDRFVTEIKSGLRACQVMAWFVLFHLGINQMTNNLVSQAGEMQLDSFPNDGIQVLNPIACVLLGPVIQKILYPTLTRYQIPFGPLMRMTMAFFTMAATFAYAAGVQKMIYNSGPCYEAPLVCPAAQRVGQPALPNRIKVWVQTPIYVILAVSEIFGFVTLSEYSYSKAPKDMRTVVQSMRQLSAGIGSAIGIALGPVSRDPKVLWMDVGLAVSLALSGVLFWAVMGHLEKDKEDLDTMYLSEDQDRAAHTGVEAGSGSKN

SEQ ID NO: 8401 - DNA, 1869 bp, Aspergillus oryzae
  CDS (1)..(1869)
atgtcgggccccatgtccgttgtgaacggctctgcggtagtttccgcagagtcagactccaaatcacggttggtgatggctcctcctgcacgtgatgcgggcgatgatactgaccctggtgccttgatttcttcgtcgtatatagataagaatccagaagagcttcctgagaaagatgcccccgccgttgtggatgccattcgctccctagccgactcggatgatgacagtcgcgtggcaactgaagatgaagtctgcgatcttctccatgttgtggacaagatccctgtccgactgtgggtggcatgcatcgcgggtatcttggaacgctttgtatggtatggggcgacggcccctctgcagaactacctgcaaaatgcccccggcggcgaggtacccggcgctttgggcctcggccaggcagctgcatccaatattgtgaacgcactgatcattgggtcctatattatgccagttccagcggctgtgctcgctgatagtttcttgggccgatacaagaccatgctctactctgccatcattgaggccatcggggcaacaattttatttgcgacgtcattgcccgtcgctattcatgggggagctgctcttgcaggcgtgattgctgcctgtgtgttactggctgttggatcaggggcattcaaaaccacggtggtcccgtttatcgccgaccaatatgatgcaaccgagtttcgaatccagaccaggaagaaaggagagaaggttgtcaccagtcgtgagctaaccattacgtatatctacaatgtgttctactgggctattaacgtggtgggtttcgtggccgatgctacgccgctgttggaaagatatgttgggttctggctcgcctacttgataccgtgctgtctcatgtggttggcccttattccagtccttcttgccgcaattactttggttgtggctgccctgcgctgtggaatttccgggggctttcgaatggatgctgccaagccacacgcccaacttcaacacggtcgcgtagttccttggacggattcttttgttgaggatatcaaacgaagtcttctaacatgtcaagtattgctgctattccccatccactggctatgctataaccagaccttcaacaatttgatttcccaagctgggcagatggtcacctacggtattcccaacgatatgatgaaaatcgccggggccatctccgggattattgtggcaccaataatccaaaagggattgtacccttgcctaacaaggcgaaaggtggcattcggaccgattgcacgcatgacagtcggattcatcgtcctgaccctctccatggtctataccaccgtggttcaaaagctcatttatcagacaggaccctgttacgaggcaccgctcgcgtgcccgggctcgcacgacagcacggtgcccaaccagatatccgtctttctccagatccctatctatcttggaggtgccctggcggaagtgttttgtcttaccacgggaaccgagtatgcctataaccacgcccctaagagtatgaagacactggtgcaggcgatctggctggcgatggctggcatcgggacgtgcctcgccctggcgtttaccccgttgaccaaagatccacatctaattaccatgtatgctattttggcggggcttctgggtggtgcgaccgtcttgttgtgggtgctgttccgccatttggacaaatccaaagatgtcggcgggatcaaaactgaattcagacggaatgaaacgatagacaccggtagcggcagcagcatccataaggtggatatgggaatcaccgtctatgctgacagtgcaatctatgaccgcatcctgtcccttgacagcctcggatag

SEQ ID NO: 8402 - protein, 622 aa, Aspergillus oryzae
MSGPMSVVNGSAVVSAESDSKSRLVMAPPARDAGDDTDPGALISSSYIDKNPEELPEKDAPAVVDAIRSLADSDDDSRVATEDEVCDLLHVVDKIPVRLWVACIAGILERFVWYGATAPLQNYLQNAPGGEVPGALGLGQAAASNIVNALIIGSYIMPVPAAVLADSFLGRYKTMLYSAIIEAIGATILFATSLPVAIHGGAALAGVIAACVLLAVGSGAFKTTVVPFIADQYDATEFRIQTRKKGEKVVTSRELTITYIYNVFYWAINVVGFVADATPLLERYVGFWLAYLIPCCLMWLALIPVLLAAITLVVAALRCGISGGFRMDAAKPHAQLQHGRVVPWTDSFVEDIKRSLLTCQVLLLFPIHWLCYNQTFNNLISQAGQMVTYGIPNDMMKIAGAISGIIVAPIIQKGLYPCLTRRKVAFGPIARMTVGFIVLTLSMVYTTVVQKLIYQTGPCYEAPLACPGSHDSTVPNQISVFLQIPIYLGGALAEVFCLTTGTEYAYNHAPKSMKTLVQAIWLAMAGIGTCLALAFTPLTKDPHLITMYAILAGLLGGATVLLWVLFRHLDKSKDVGGIKTEFRRNETIDTGSGSSIHKVDMGITVYADSAIYDRILSLDSLG

SEQ ID NO: 8403 - DNA, 1695 bp, Aspergillus oryzae
  CDS (1)..(1695)
atgaaagctcctacgtcaacgacactggtcggggtggattcaatgctagctgattacgaacgacgtgatgctactcaagatgagataaacgagttaccacatgtcgccgactcaatatcattcgtcgtctgggttgctcttgtggtcagcggtgcagagcggttcttattttatgccgcgacaactccttggcgtatgaccgatgccaaaatgtgtgcagagaattatgcccagtatgatcgcgagaatacctcgattccgggtgcactaggtctcggtgaagcgatggcttcgaacatctcaagtgctttctacgcctttacattcttgatgtctgtagcatttgctgttctttcggatgcctggttgggacgctatataaccttgtgtcttagcttttgtcttgacttctgtggctgtttagtcctttttgtcacatctcttccggccataacagatggctcagtcaagctagttgggtttatacttgctgttatcctaataggactcgggactggaggcgtcaaagctactatcacacccttcatcggggaccaatatccaaatgtatcgccgcagctaattatcacaaaaaagggcgagcgagttgtgacggatcggatgcttacaatgcagtatatttataatgttttctattggtatggtgcgggatcacccatacacaatcatctattgagcctgacaaacctttctaggttcacaagtattgcgaccctgtctctcatcgcttcaacctatctggagaagaaagtaggatactgggcagcttaccttatgccactctgtgcattcgctgtcgtggtccctctgttaactcataaggcattaggtagccaaagattcttcaacttcgctactctcaagctgccaccacaaggtagtgtcattccgcaattcgcaaaggtcatatgcttctcagcccgggacaggttcaggctggatgcggccaaaccaagctaccaagctgagaagtaccaccgagaagtcgactgggatgatttatttgtgtccgaaatcaaacggggccttagtgcctgtaaagtcatgttcgtcttccccgtccccacattcattgtgaataacctgattacccaagccggagagatgcgtctggacggggttccaaacgatgcgataaaggctattaatcctgtcttttgcataatactgggtccattgcttcagagatttctgtatccagggcttcgaaaggccgggatccgatttggaccaattgcacggatgacttgggcattcgttacaatgagtggatcgatggcctttgccgctggggtccagaagttggtttactcccgaggtccgtgttacgagaaaccccttgtctgtgaagcctcagatggtggcaggatagggaatgatatcagtgtttgggtgcagataccaatcttcttctttctaggcctggctgagattctgggattcaccacactagctgagtacagctattctgaagcaccgaccaatatgcggaccttagtacagtccttggtacaggtgagctcaggcataggttctgcccttggcatggcagtgtctccactttccaaggatccaaaagtcctatatctctacacggcattggcagcgacaatggtcgtggtggcgtcaggcttttgggtggtctttcacagatacgacagaaatcggaattga

SEQ ID NO: 8404 - protein, 564 aa, Aspergillus oryzae
MKAPTSTTLVGVDSMLADYERRDATQDEINELPHVADSISFVVWVALVVSGAERFLFYAATTPWRMTDAKMCAENYAQYDRENTSIPGALGLGEAMASNISSAFYAFTFLMSVAFAVLSDAWLGRYITLCLSFCLDFCGCLVLFVTSLPAITDGSVKLVGFILAVILIGLGTGGVKATITPFIGDQYPNVSPQLIITKKGERVVTDRMLTMQYIYNVFYWYGAGSPIHNHLLSLTNLSRFTSIATLSLIASTYLEKKVGYWAAYLMPLCAFAVVVPLLTHKALGSQRFFNFATLKLPPQGSVIPQFAKVICFSARDRFRLDAAKPSYQAEKYHREVDWDDLFVSEIKRGLSACKVMFVFPVPTFIVNNLITQAGEMRLDGVPNDAIKAINPVFCIILGPLLQRFLYPGLRKAGIRFGPIARMTWAFVTMSGSMAFAAGVQKLVYSRGPCYEKPLVCEASDGGRIGNDISVWVQIPIFFFLGLAEILGFTTLAEYSYSEAPTNMRTLVQSLVQVSSGIGSALGMAVSPLSKDPKVLYLYTALAATMVVVASGFWVVFHRYDRNRN

SEQ ID NO: 8405 - DNA, 1842 bp, Aspergillus oryzae
  CDS (1)..(1842)
atggttgacccacgttcagcgtccaaagagccttatgacgaaaagaccggcattccggatgtcgaagaaacctcgccttcaccagtcgagtacgacgaggacacgcccactgaggaagagttggccactctgcgccgtgtgccaggaagcctcccgattgtggcctatctcatctgtgtggtcgagttctccgagcgagcttcgtactatggtgtttcgggcctcgtttccaacttcgtcaatcgtcccctgcccgtcgggggcaatggctacggtgcacctccgcggggtacgcagcagacggctggcgccttgggcatgggcactgtcaaggccaacgccgtcaaccagtcgttcagcatgttagcatacgcccttcccatggtcttcggctacctgtccgatgctcatacgggccgcttcaagatgatctactggggtgttttcgttttcggtatcgctcatgtcctgatggtgggagcgactgcgcccaatctccttgccaatgggggtgcgaaagcgcccttcttcatctccctgtatatgttgtcggtcggtgccgccatgtttaagcccaatgtctcccccctgctgttagatcagatgcccaataccaaggcgaagatcaaggtgctgtccaatggcgaaaaggttatcgtcgaccctgaggtcacgaccgagcgtgctatgctctggttctatctgcttatcaacattggcggcttcatgcaggtcgctacctcctacgcggagaagtatgtcgggtggtggttggccttcatcctgccgctgtttttgtatctcccgcttccggccctcttgttctggctgcgtaaacgtctcgtgctccaccccccgggcggcagtgacttgctcaatgtctgccgtgtattgggcatctgcctccgtggcggcggtatcttgcgcattggacgccatggcttctgggacgcggccaagccgtccgtcatcgcagcgaagggacagaacattcggactcattggaatgaccaatttgtggaggatgtccgccgcacattccaggcgaccggcatcttttgcttcttccccatccagtacatcaatgacaacggactgggcaacgcggcgagctttttgtcgaccatgttgaccacgaacggcgtcccgaacgatgtcatcagcaacttcaactctctcagtatcatcgcgtttgcccccgtcctcaactacgggttgtatcccctcctgcgtcacttccacatccgatatggtccggtggcccgtatcacaaccggactggccctgtctactattggtggcatcggctacaccgttctgaactactacgcctacaaactcggaccctgtggcaagtatggctcttcggacacctgcgtggatgccgacggagtttccttggtggctccaatcaccatttggtggatggccattccctatgcactgggtggtatctccgaactctttgtcaatgtccccgcctacggtatcgcctactcacgcgcgcccaagaacatgcgtggcttggtctcggctatcaatctcctcaacaccgccgtggcttatgcgatcggactcgcgtgctcagccgtgatcaaggatccatacctgacctgggtctttggcggtccctccatcgtcggtggcgtcctcaccgtggttttctactttatgttccgccacattgacaaggaagaatacgtgctgagcgagaacgccgaggagacacacgtcttcgagggggctggaaacaaatttacggagaactcgcataacaaaacgaccaacccaacccctgccattgtcgagaatgaagagttcggcatctcgccgaaacagtga

SEQ ID NO: 8406 - protein, 613 aa, Aspergillus oryzae
MVDPRSASKEPYDEKTGIPDVEETSPSPVEYDEDTPTEEELATLRRVPGSLPIVAYLICVVEFSERASYYGVSGLVSNFVNRPLPVGGNGYGAPPRGTQQTAGALGMGTVKANAVNQSFSMLAYALPMVFGYLSDAHTGRFKMIYWGVFVFGIAHVLMVGATAPNLLANGGAKAPFFISLYMLSVGAAMFKPNVSPLLLDQMPNTKAKIKVLSNGEKVIVDPEVTTERAMLWFYLLINIGGFMQVATSYAEKYVGWWLAFILPLFLYLPLPALLFWLRKRLVLHPPGGSDLLNVCRVLGICLRGGGILRIGRHGFWDAAKPSVIAAKGQNIRTHWNDQFVEDVRRTFQATGIFCFFPIQYINDNGLGNAASFLSTMLTTNGVPNDVISNFNSLSIIAFAPVLNYGLYPLLRHFHIRYGPVARITTGLALSTIGGIGYTVLNYYAYKLGPCGKYGSSDTCVDADGVSLVAPITIWWMAIPYALGGISELFVNVPAYGIAYSRAPKNMRGLVSAINLLNTAVAYAIGLACSAVIKDPYLTWVFGGPSIVGGVLTVVFYFMFRHIDKEEYVLSENAEETHVFEGAGNKFTENSHNKTTNPTPAIVENEEFGISPKQ

SEQ ID NO: 8407 - DNA, 1767 bp, Aspergillus oryzae
  CDS (1)..(1767)
atgagcgacaccattagccgaggaaagtctaatgctcttgagacactcaaagctcccctctcagagcaagagactatagtgctttcggcggctccctctccgcatgatgacggctacgcaaccccaactggagaggaactggagtctcttcgtcgtgtcgctggaagtgttaaatggactgcatataccatcgcctttgttgagctgtgcgaacggttctcctactatggaaccactgctgtttttgtcaactttatccaacagcctcttccacccaactcaagtactggtgccggccatgcaggacagtctggagctctaggcatgggccagagagtctccacaggcctaactactctcaatgttttctggtgttacgtgactcctattattggtgcctgggtggccgacgagttctggggccgcctgaagacgattcaagttgccatcgcctttgccatggttggacacattgtgttgatcatcgcatctcttccccaggtgattgtgcatcccaacggtgcgttaggttgcttcatagtgggtctagtactcttcggaattggtgtgggaggtttcaagtacaggctgacctttctgattcacaaagaaaccagacactacatcaaaagacttccaaaaaccggagaacgtgtcatcgtggacccggctcagacgatcacccggatcttcctgtatttctacttcatgatcaacgttggctccttgcttggacagattgtcatggtgtatgcagagaaatatgttggattttggctctccttcgtccttcccaccatcatgttcgccctctgtccactggtgctttatgtctgccgcaagaattatgaggtcactcccccaactggttcagtggtgggaagggcgttcaagctctgggcattcgcgctcaagggcaggtgtgacttctgggagaacgtgaagcccagcaacgttcagagaaaaccagtgtggatgaccttcgacgacaaatgggtagacgaggtgcgcagagctctcaaagcatgcgccgtcttcctctggtaccccctgtactggctggcctacggacaaatgaccaacaatctcacctctcaggcggccaccatggagcttcacggtgtcccaaacgacatcatcatgaacctgaatccggtgaccctcattatcttcatacctatcatggaccaggttgtctaccctggaatccagagactaggcgtccagtttacccctctgaagcgaatgtacgcggggtacatgctcgccgctatatccatggtatctgccgccgtgatacagcactatatctaccaaacgggtaaatgtggcaagtatccgggcgagaagagctgcaagactcctgcgcctatcaatgtctgggtgcaagctgtgccgtacgtcttgattgctttttcagagattttcacctcgatcactgggtacgagtatgcattcaccaaggcgccgaagaatatgaagagcttagtgcaatctatttatctcttcatgcacgctttctcgtctgcaatccaacaaggcctaactcttctatctactgacccccttcttgtgtggaactatggtttcgtcgctgtactttcctttatcgggggcaatctcttttggattacgcatcacaagctggataaggaagaggatgagctcaacagcctcgaggcgtcttcatacttgggccgtgggccacgcgctcagaacaagaggattattgacattccaggagctcacatagtaaacaagacatga

SEQ ID NO: 8408 - protein, 588 aa, Aspergillus oryzae
MSDTISRGKSNALETLKAPLSEQETIVLSAAPSPHDDGYATPTGEELESLRRVAGSVKWTAYTIAFVELCERFSYYGTTAVFVNFIQQPLPPNSSTGAGHAGQSGALGMGQRVSTGLTTLNVFWCYVTPIIGAWVADEFWGRLKTIQVAIAFAMVGHIVLIIASLPQVIVHPNGALGCFIVGLVLFGIGVGGFKYRLTFLIHKETRHYIKRLPKTGERVIVDPAQTITRIFLYFYFMINVGSLLGQIVMVYAEKYVGFWLSFVLPTIMFALCPLVLYVCRKNYEVTPPTGSVVGRAFKLWAFALKGRCDFWENVKPSNVQRKPVWMTFDDKWVDEVRRALKACAVFLWYPLYWLAYGQMTNNLTSQAATMELHGVPNDIIMNLNPVTLIIFIPIMDQVVYPGIQRLGVQFTPLKRMYAGYMLAAISMVSAAVIQHYIYQTGKCGKYPGEKSCKTPAPINVWVQAVPYVLIAFSEIFTSITGYEYAFTKAPKNMKSLVQSIYLFMHAFSSAIQQGLTLLSTDPLLVWNYGFVAVLSFIGGNLFWITHHKLDKEEDELNSLEASSYLGRGPRAQNKRIIDIPGAHIVNKT

SEQ ID NO: 8409 - DNA, 1653 bp, Aspergillus oryzae
  CDS (1)..(1653)
atggcttcccaggccaaagacagccaagtggaaagctcctcgccttcgttgaccgtgacagaaaagcaggcaggagatattgttcctataaatcacacaggcgatgaaacatcatgtcggcccacgaaccaagaattgaaagagcttgttcatgtcgccgacaacgttccctacccagtttggctggtcattctagtcggatcagccgagagatttgtcttctatggcgcctcgacctgcctgcaaaactacttgcagaacagcccaaatgatctcgttcctggagcactcggtatggggcagtcgaacgccacggctgtgaactatgcgttcatggtgttggttaactttgcaccggtgccgctggcggtggtggccgacggttggctggggcgatataagctgattttgctaagtacagtcatctacctcgtggggtctctcgttctttttacgacagctctgccttcggctctacaccaagcaggcgcgtccgccgcagggctgggtgtgtccctcgtcttgatcgcgctgggcataggcggcgtgaaggcctcgatctatccctttatcgcagatcaatacccccatcatgagccattcattcgcgagctcccatccggagaacgggtggttgtggaccgatctctcacgatacaatacatgtacaattggtacttctggttcattaatgtcgcctctctgtccgggatagccaccacctttatggaaaaatattcgagcttttggtctgcctttttactctgcttctgctttctatgggtaggactggtccttatgttggtcttcaaaaataaatactacaaagcacctcccgcaggctcagtggttccgaaagtgttgcgagtcatttggctcgggattcgaggtgggatgtcgctcagcgccgcccagccagcggtgcaacaggagaagtacggtcgccaggttccgtgggatgatgaattcctacagggagtccgcaatgccctcatagcgtgtcaaatctgtctcgcattcccagttgtctggctctgctggggacaaacatacaataacttgatctcacaagccggtcaaatggaaacttacgggatccccaacgacgtgatgcctaattttaacccgattatctgcatcatcgcaggaccgctgatccaacaatgtctgtttccctttctcaaccgccgcaaaattccgtttcgccccattgctcgtatttccgtcggtttcttcctcatgggtgcctcgttggcctgggcgacgggtctccaggcctttatctaccgcgctgggccgtgtcctgaccatcccctggcctgtccggattcgaagaacggcaccatcccgcagcatatcaatgtgtttctgcaggtgccgtgttacgtgcttatggcgattggggagatcttctgcgtgacgactgggtcagagttctgctattcgaaagccccacggagcatgaagtctatcgtgcaggcattatttgtgggaacggcctcgatcagctatgcattgggcattgcgatctcgccggctgcaaaagatccttatatgactattttctacgggtgtttgaccggcgtccaactcgctattacggctgggttttggttgatgtttcggaagttggacaagaatattattgtttga

SEQ ID NO: 8410 - protein, 550 aa, Aspergillus oryzae
MASQAKDSQVESSSPSLTVTEKQAGDIVPINHTGDETSCRPTNQELKELVHVADNVPYPVWLVILVGSAERFVFYGASTCLQNYLQNSPNDLVPGALGMGQSNATAVNYAFMVLVNFAPVPLAVVADGWLGRYKLILLSTVIYLVGSLVLFTTALPSALHQAGASAAGLGVSLVLIALGIGGVKASIYPFIADQYPHHEPFIRELPSGERVVVDRSLTIQYMYNWYFWFINVASLSGIATTFMEKYSSFWSAFLLCFCFLWVGLVLMLVFKNKYYKAPPAGSVVPKVLRVIWLGIRGGMSLSAAQPAVQQEKYGRQVPWDDEFLQGVRNALIACQICLAFPVVWLCWGQTYNNLISQAGQMETYGIPNDVMPNFNPIICIIAGPLIQQCLFPFLNRRKIPFRPIARISVGFFLMGASLAWATGLQAFIYRAGPCPDHPLACPDSKNGTIPQHINVFLQVPCYVLMAIGEIFCVTTGSEFCYSKAPRSMKSIVQALFVGTASISYALGIAISPAAKDPYMTIFYGCLTGVQLAITAGFWLMFRKLDKNIIV

SEQ ID NO: 8411 - DNA, 1614 bp, Aspergillus oryzae
  CDS (1)..(1614)
atgtcgagtggagagcccacaacaatgacaccgtctccaagtgaacgcactccacttctctccaatgggtccggtggggcagcagatgatggagggactactgtgacgatctcgaagcataatgacggggtgaggagaatcgcggattcgctgccgctttctgtctggctcatttccaccatcgagctgtgcgaacgatttgcctattttgggaccatcgcaccgatgcaaaattatatccaaaatcccaggaatgatccattacgaccgggcggaattgggctgggacaggcatctgcgaccatggtgaaccaggcgttcatgctgtggtgttatatcactcctgtacttggggccgtggttgcagaacagtatattggaagagtgaaaactatcatttattcctcgtcagtctacctctgtggattggtaactctatttctatcttcattgccaactgcatatgcgatgggaatatctctacctggattactagtgtctttattcttaatcggtatcggcactggtggtataaaaacaaacgtcagttcgctaatagcagagcaatatactggtcctaaggagtccagacgtattctaaagtcaggcgaggaagttatagtcgatagagatctcactattcagaggatattcacaacgtttttcttatatatcaatattggatctttctcacctctactcataacaataattgagaaagagtacggcttttcagcagcattttctctgtcagctataaccttttccattggatttataatagtcctggtcagcagacatctatacatcagccgggaccctgatagctctatcatcttcaacgcctgcaaggcattttggatagctattaagcataagggcaatctggactatgcaagaccaagctatcagacagaacaagcagcaaccaggaggctctcctgggacgattccttcattgacgacttacggcgtgctatcgcttcatgcaaaatcttcatcctatatccaatctattgggcagcctattcacaattcctaacgaattttatctcccaggccgcaactatggagacacacggagtgcctaatgatattatgacaaatatagaccctataacagtcctaattcttcttcctgttctagaccgcattgtatttcctttcctacgaaggcagggggttcctgttcgccacgtggatagaattacaatagggttcctggtgtgtggcatctcaatgttgtatgctgcctttgttcaacgaactatttacgctgcccctccttgctacgaccacccaagagctccagactgcatgggcgggcaggtcccgaatcgggtttctgtattcctccaatcgcctgcgtacgtcttagtcgcaatctcagagatactagcgtctgtggcaggtgtcgaatatgcctacacgcaagctcccaagtcaatgaaatccctgattatggccgtgtacttgtctgctgtatcggctggggcactgatagcaatcactgtgtcgccactaacagtcgatccaaagctgccatggatgtatttcactctcggggtggagaactttctagctggtgcttttctttggattttcccggcctga

SEQ ID NO: 8412 - protein, 537 aa, Aspergillus oryzae
MSSGEPTTMTPSPSERTPLLSNGSGGAADDGGTTVTISKHNDGVRRIADSLPLSVWLISTIELCERFAYFGTIAPMQNYIQNPRNDPLRPGGIGLGQASATMVNQAFMLWCYITPVLGAVVAEQYIGRVKTIIYSSSVYLCGLVTLFLSSLPTAYAMGISLPGLLVSLFLIGIGTGGIKTNVSSLIAEQYTGPKESRRILKSGEEVIVDRDLTIQRIFTTFFLYINIGSFSPLLITIIEKEYGFSAAFSLSAITFSIGFIIVLVSRHLYISRDPDSSIIFNACKAFWIAIKHKGNLDYARPSYQTEQAATRRLSWDDSFIDDLRRAIASCKIFILYPIYWAAYSQFLTNFISQAATMETHGVPNDIMTNIDPITVLILLPVLDRIVFPFLRRQGVPVRHVDRITIGFLVCGISMLYAAFVQRTIYAAPPCYDHPRAPDCMGGQVPNRVSVFLQSPAYVLVAISEILASVAGVEYAYTQAPKSMKSLIMAVYLSAVSAGALIAITVSPLTVDPKLPWMYFTLGVENFLAGAFLWIFPA

SEQ ID NO: 8413 - DNA, 1653 bp, Aspergillus oryzae
  CDS (1)..(1653)
atgaccgcgccagccggctcgacagaaaagtcggagacgtcggagacaacgaccctacagacaacggaggtttctacggtggatgtcgatcctgacctgcctcgtgttctagcgaaggtcccaggaactgtatgggtagtggctttcattgctgcagcggaacgattcacatactggggcatcacaactccctggcagaactacatgcaaaacccccctgggcatcagagtttgcccggtgcattaggcctcggcgaagcgaaagcatccacgatatacaatgtcttcatgtttttctcctatttaacaccaattcctttcgcgataatctcggacgtctatctcggtcgttatcggacattgcgcctgagtttgatcttctatttaatcggatgcgtcattttaattgcgacttcggtgagctccgccacagagtatcgggtcacttttggcgggctaattgcagccatggttctcattggattggcggtagggggtgtgagggcgacagtgacacctctgatgagtgatgataccttgctcaccatcttggaatcagtggaccagtatgcgccgaccgaagtcaaagtgacaacattacccaacggcaagcaggttgtatatgatcgtggcctaacaacgcagtacatatataacgcacaatactggtacataaggctcgtcaacattgcaagtctgtccgcgatcccgacgacttttatagagaagaacgtttctttttgggcagcatatcttctccccagctgctttcttgccgcaggacttgtcttgcttatcataggacagaaacggtttcgcaaactcccgccaaccggtaatattctaccgaaagcaggaagtgtgctctcttgtgccatccgtggccgcttccagcttgatgctgccatgccatcttatcagcgcgagcatttcgccaaagaggtttcatgggacgaaacctttgtgaacgagatacgacgcggactcgtggcttgtcgagtcatactggggttcattctattcttcacctgcctcagtcaagcatccaataacctgatttctcaagcggggcagatgaaaacgtatggaatcccgaacgacacgatcactgcgatgaatcccatattttgcgtcataatgggcccagttatccaaaagggattgtaccccttgctgaacaagaacaatgtgaaattccagtccatcacacgcatggcaacgggattcatcatgatgagcgcatcaatggcattcgctgccggggtccaaaagattatctacgacactggaccctgttatgatcggcctcttacgtgccccggggctgagaatggtcggattccaaaccaggtcaacgtctttcttcagactccaacatatatcatccttgcggtggcagagatcttctctttcgtgaccctgtcggaatacacctatacaaaggccccgacagacatgaaagctgtggtccaagcgctcggtcaactgggtgcggcggcaggatcagccattggtatcgcgatcactccgttagctcatgatcccagcctgatatggatgtatactgggctagcggtagctatgttcttggtagcggttgttttttggatcttgttcaagaaatataatgcgatcgatcgggaggataaatga

SEQ ID NO: 8414 - protein, 550 aa, Aspergillus oryzae
MTAPAGSTEKSETSETTTLQTTEVSTVDVDPDLPRVLAKVPGTVWVVAFIAAAERFTYWGITTPWQNYMQNPPGHQSLPGALGLGEAKASTIYNVFMFFSYLTPIPFAIISDVYLGRYRTLRLSLIFYLIGCVILIATSVSSATEYRVTFGGLIAAMVLIGLAVGGVRATVTPLMSDDTLLTILESVDQYAPTEVKVTTLPNGKQVVYDRGLTTQYIYNAQYWYIRLVNIASLSAIPTTFIEKNVSFWAAYLLPSCFLAAGLVLLIIGQKRFRKLPPTGNILPKAGSVLSCAIRGRFQLDAAMPSYQREHFAKEVSWDETFVNEIRRGLVACRVILGFILFFTCLSQASNNLISQAGQMKTYGIPNDTITAMNPIFCVIMGPVIQKGLYPLLNKNNVKFQSITRMATGFIMMSASMAFAAGVQKIIYDTGPCYDRPLTCPGAENGRIPNQVNVFLQTPTYIILAVAEIFSFVTLSEYTYTKAPTDMKAVVQALGQLGAAAGSAIGIAITPLAHDPSLIWMYTGLAVAMFLVAVVFWILFKKYNAIDREDK

SEQ ID NO: 8415 - DNA, 1686 bp, Aspergillus oryzae
  CDS (1)..(1686)
atgccggaaagcacaagaactccagacgtcccggatcttcaaatccagtcaacggtgacccactcggatataccgaaacctctccaagcagaccaggcgtatgaaccgggtttgcgtcgggtgcctgaccgtattccttgggttgttggactcatcattgtcgtggagcttggggaaagattcacctactttggccttagcggaccactgcagaattacatcaaaaatccatacgtgcctggtgcggacctgccaggtgctcttggtaaaggacaggcaattgcatccgctctaggtaactttttcaagttttgggcgtatgcctccaccatcgtgggggctgttatagctgatcagtatgtcggcaagttcaaagctatagtcatagcttccgggatttatatcgtcggcttgactatccttgtggcaactgcgaccccagcagctatcaatggcggatctgcatttggtgggctcattgcctcgatggttatcattggacttggaacaggtggaatcaaagcgaacgttacccctttctgtgccgagcagtatcagaaagggagcgcttttgtcaagacactgaaatcaggagaacgtgttgttgtcgaccctgagctcaccgtagagcgaatgttcatgtggttctactgggccgttaatatcggcgctctatcaccactgattaccgtcaacgtagaagccaaagtgtcattttggctagcctttctcatacctttgattgtgattgtccttgctgccgtcgtctttctatgcagcagcaatttgtatatcaaaaccaaaccacaaggttcaccaattgtcgaaaccgccagaactgtatatgttgctatatcggaaaggggcttcgagaacgcaaagccgagttccctgagccagcggggtcggttagagaaatactctgttgcctccagcgccaactacaccgatcaaagtgtcgatggggttaagaagggcatcagagcctgcaaactcttcctcctcttcccgttttatttcatttgttgggtccagatctggaataaccttatttctcaggctggtcaaatggctttgcacggcactccgaatgatttgctgcaaaatctggaccctatagccttgattatctttggtccgttgctcgatctcgtggtctacccaacgttgcgtcatttcaagattgatttccgaccagagttgaagattactgtcgggttcttcatggcttccatgtcgatggtgtacgccagtgtgctccagcactacatctacatctcccctgctcaaagcattcatgtttgggttcagacacctgcatacgttcttgtcgccttttcagaagctttcgttgtggtgactggcttggagatcgcatataccaacgcgcccgaaagtctgcgctccctggtttcttctctgttctggttaactattggcgtggcggcggccatttgtatcggactcgctccagtttcccaggatccctacttagtttggatgtatggatccctagcaattgtaggtttcgtggcgggaatcctcttctatgtactctacggaaggacatcgaagcagccggttccagtgttagattcggtggagaccacttcgggccagcgggaagacgaagaggcccaaattgagagtggtaaacgtatggtggtgacggcgaaagattcatag

SEQ ID NO: 8416 - protein, 561 aa, Aspergillus oryzae
MPESTRTPDVPDLQIQSTVTHSDIPKPLQADQAYEPGLRRVPDRIPWVVGLIIVVELGERFTYFGLSGPLQNYIKNPYVPGADLPGALGKGQAIASALGNFFKFWAYASTIVGAVIADQYVGKFKAIVIASGIYIVGLTILVATATPAAINGGSAFGGLIASMVIIGLGTGGIKANVTPFCAEQYQKGSAFVKTLKSGERVVVDPELTVERMFMWFYWAVNIGALSPLITVNVEAKVSFWLAFLIPLIVIVLAAVVFLCSSNLYIKTKPQGSPIVETARTVYVAISERGFENAKPSSLSQRGRLEKYSVASSANYTDQSVDGVKKGIRACKLFLLFPFYFICWVQIWNNLISQAGQMALHGTPNDLLQNLDPIALIIFGPLLDLVVYPTLRHFKIDFRPELKITVGFFMASMSMVYASVLQHYIYISPAQSIHVWVQTPAYVLVAFSEAFVVVTGLEIAYTNAPESLRSLVSSLFWLTIGVAAAICIGLAPVSQDPYLVWMYGSLAIVGFVAGILFYVLYGRTSKQPVPVLDSVETTSGQREDEEAQIESGKRMVVTAKDS

SEQ ID NO: 8417 - DNA, 1878 bp, Phaeosphaeria nodorum
  CDS (1)..(1878)
atggcacaggctcacgaaaccactgcggccgagcagttggtaaacatgcaggctgaggcaaaccaaaagccgcatctcttcggcgcctccgtgaacgatgccaacgtcggcgcaaacgtccatgtcgcagacgaaaaggaaattatcgagaagcaaagcggcagtaacagctctggtgcttccgtgcgcctagccgaccacgaggaagaagatggtcttggtggtgtcgcgcccacggctgaggagctccgcactcttcgcaaggtcggcgagcctctacccaagtctgctttcttggtagctgttgtcgagctctgtgagcgcttcacgtactatggtgcctcgggtcttttccaaaactacattgcgcgcccgcgtagtggagagcttggtcgtggtgcgctcggcatgggtcatcggggcgccaccggtctttcgacgttcttccagttctggtgctatgttactccgattcttggtgccattatcgctgatcaatacctcggaaaatacaacaccatcgtcatcttctgcggcgtgtacatggttggtctcctcattttgacatgcacatccatcccagcggctcttgaccatggcgccggactcggtggtttcatcgttgccatcatcgttatcggtctaggaactggcggtatcaaatcgaacgttgcaccgctcatcgcggaccagtataacaggaaaaaaatggtcattggccacgacaacaatactggcgaaaaattcatcatcgaccctgcaatcaccatccacaggatctacatggtgttctacttttgcatcaacgtcggttgcttgtccctgctcgctacaccctacatggagcgcgatatcgacttctggtccgccttcctgctgtgcctctgcgtcttcttcgtgggtacgctcgtccttgttctcggtcgcaaggtctacgttgttcgaccaccgcagggctctgtcatcactgatgctttccgcgtcatgtggttgatgatcaagacgcgcaagatggatggcgcaaagccctcgtatcaggctggacttggaaagaccactgtgctgcgctgggatgaccactttgttgaggaagtgaagcgtgcgcttgtagcttgcaaggttttctgcttctatcccatctactgggtcgtctacggtcaattctcgaacaacttcatcacccaaggtggacagatggccacccacggcattcccaacgatctgatgcagaacttcgaccccatcgcaatcatcgtattcctgcccctcgtcgaccaggtgctaatgcccttcctccgcaagaagaagatccccttccctcccatcaaccgtatcgtaaccgggttctgggtcgcttccctcgccatggtttacgccgccgtcatccaatactacatgtaccaaaccggcccctgctacgaccatcccaactgtgaggcagcaaagggcgccgacggcgtcctccacggcaacaacatccacatcgccgcgcaaaccggcgcatacatgctcattggtatctccgagatcttcgcctccgtcaccggtctcgaatacgcatacaccaaagcgcctccctccatgaaatccttcgtgcagtccatgtacctcctcacgaacgccttcggatccgccatttccgaagcactcaaccccgtcctgtacgacccgaatatccagtggatgtacgttggtctggcggtaacgagtttcattgctggatgtcttatttggattattttccaccatttgaatgagacggaggatgagatgaatcaacttgatcgcgattatgacaaggatgagacgttgaggaggagtagtgtgcatgcggatcggacggttggactgcatgataaggacgcggagaaggcgtag

SEQ ID NO: 8418 - protein, 625 aa, Phaeosphaeria nodorum
MAQAHETTAAEQLVNMQAEANQKPHLFGASVNDANVGANVHVADEKEIIEKQSGSNSSGASVRLADHEEEDGLGGVAPTAEELRTLRKVGEPLPKSAFLVAVVELCERFTYYGASGLFQNYIARPRSGELGRGALGMGHRGATGLSTFFQFWCYVTPILGAIIADQYLGKYNTIVIFCGVYMVGLLILTCTSIPAALDHGAGLGGFIVAIIVIGLGTGGIKSNVAPLIADQYNRKKMVIGHDNNTGEKFIIDPAITIHRIYMVFYFCINVGCLSLLATPYMERDIDFWSAFLLCLCVFFVGTLVLVLGRKVYVVRPPQGSVITDAFRVMWLMIKTRKMDGAKPSYQAGLGKTTVLRWDDHFVEEVKRALVACKVFCFYPIYWVVYGQFSNNFITQGGQMATHGIPNDLMQNFDPIAIIVFLPLVDQVLMPFLRKKKIPFPPINRIVTGFWVASLAMVYAAVIQYYMYQTGPCYDHPNCEAAKGADGVLHGNNIHIAAQTGAYMLIGISEIFASVTGLEYAYTKAPPSMKSFVQSMYLLTNAFGSAISEALNPVLYDPNIQWMYVGLAVTSFIAGCLIWIIFHHLNETEDEMNQLDRDYDKDETLRRSSVHADRTVGLHDKDAEKA

SEQ ID NO: 8419 - DNA, 1785 bp, Nicotiana tabacum
  CDS (1)..(1785)
atggcacttcctgagacacagcaagattcaaaagctttaccagacgcttgggattacaaaggcagaccagcccttagatcctcctctggtggttgggctagtggtgcaatgattttaggtgttgaagctgtggagaggctaacaacactagggattgctgtaaacttagtgacatatttgactggaactatgcatttagggaatgcttcttcagccaacaatgttaccaattttcttggaacttctttcatgctcactttacttggtggttttgtcgccgacactttcctcggaaggtatcttacaattggtatctttgccactgttcaagcaatgggtgttacaatcttgaccatctcaactataatcccaagcctacgaccaccaaaatgtgaacaagttggtagctcatcatgcatccccgcaaatagcaaacaactcatggtcctatatattgccctatacatgacggccctcggcaccggcggcctaaaatcgagcgtctccggctttggcaccgaccaattcgacgattctgacaagaaagaaaagggtcaaatgataaaattcttcgattggttctttttctttattaatgttggctcgctcggtgcagttacggtattggtttatattcaagataatttgggaagagagtggggttatggaatatgtgcatgtgctattgttattgcacttgttgtgttcttatttgggacaaggaaatataggttcaagaaacttggggggagtccattgacacaaattgcttcagttattgtggctgcttggaagaaaaggcatttggaattaccctcagattcttcacttctctttgaaattgatgatatttttggtgaaggaaataaaaaaagcaaacaaaagttgccccatagcaaggagtaccgattcttggacaaggcagccattaaggaagatgatgaccttgaatctaatggcactaacgttgtaatcaacaagtggaaattagcaaccttaaccgatgttgaagaagtaaaaatattaatcagaatgttgccaacttgggccacaactattatgttctggactgtctatgcacaaatgaccacattttctgtgtcacaagctacaacaatggatcgtcacattggaacctttgaaattccacctgctacactcaccgtatttttcgtcggaagtatactcttgaccgtaattttctacgataggattatcgttccgatttgtcgtcgtttcatgaataaacctcatggacttaccccattacaaagaattttcacaggcctagttctttcaattttggccatgattgctgctgccctaacagaggttaagaggctaaaagttgcacatttgcatggattgaccaatgatgcaaatgccacgattccattgactgtattttggttagttccgcaattcttgctagtgggcgcaggtgaagcatttacatatattggccaacttgattttttcttaagggaatgtccaaaagggatgaagacaatgagtacagggctatttttgagtacacttgcacttggatttttctttagttcaattttggttacaattgtgcatgttgtgactgggacaacaaatccatggctagctgataatttgaaccaagggaggttatatgatttctattggcttttggcaatattgagtgtgtttaatttgatgtttttcttgtattcctcaagaaaatatgtgtacaaggaaaagagacttgctgaaatggggattgaattggaagatgatggaccggtttgtcattga

SEQ ID NO: 8420 - protein, 594 aa, Nicotiana tabacum
MALPETQQDSKALPDAWDYKGRPALRSSSGGWASGAMILGVEAVERLTTLGIAVNLVTYLTGTMHLGNASSANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDSDKKEKGQMIKFFDWFFFFINVGSLGAVTVLVYIQDNLGREWGYGICACAIVIALVVFLFGTRKYRFKKLGGSPLTQIASVIVAAWKKRHLELPSDSSLLFEIDDIFGEGNKKSKQKLPHSKEYRFLDKAAIKEDDDLESNGTNVVINKWKLATLTDVEEVKILIRMLPTWATTIMFWTVYAQMTTFSVSQATTMDRHIGTFEIPPATLTVFFVGSILLTVIFYDRIIVPICRRFMNKPHGLTPLQRIFTGLVLSILAMIAAALTEVKRLKVAHLHGLTNDANATIPLTVFWLVPQFLLVGAGEAFTYIGQLDFFLRECPKGMKTMSTGLFLSTLALGFFFSSILVTIVHVVTGTTNPWLADNLNQGRLYDFYWLLAILSVFNLMFFLYSSRKYVYKEKRLAEMGIELEDDGPVCH

SEQ ID NO: 8421 - DNA, 1785 bp, Nicotiana tabacum
  CDS (1)..(1785)
atggcacttcctgagacacagcaagattcaaaagctttaccagatgcttgggattacaaaggaagaccagctcttagatcctcctctggtggttgggctagtggtgcaatgattttaggtgttgaagctgtggagaggctaacaacactagggattgctgtaaatttggtgacatatttgactggaactatgcatttagggaatgctactgcagccaacaatgttaccaattttcttggaacttctttcatgctcactttatttggtggttttgttgctgacacttttctcggaaggtatcttacaattggtatctttgccactgttcaagcaatgggtgttacaatcttgaccatttccaccataatcccaagcctacggccaccaaaatgcgaacaagttggtagctcatcatgcatccccgcaaatagcaaacaacttatggtcctatacattgccctatacatgacggcgctcggcaccggcggcctaaaatcgagcgtctccggctttggcaccgaccaattcgacgatgctgacaaaaaagaaaaaggtcaaatgataaaattcttcgattggttctttttctttattaatgtaggctcgctcggtgctgttacagtattggtgtatattcaagataatttgggaagagaatggggttatggaatatgtgcatgtgctattgtaattggacttgttgtgttcttatctgggacaagaaaatataggttcaagaaacttgtggggagtccattgacacaaattgcttcagttattgtggctgcttggaaaaaaagacatttggaattactttcagattcttcacttctctttgaaattgatgatatttttggtgaaggaaataaaaaaaacaagcaaaagttgcctcatagcaaggaataccgattcttggacaaggcagcaattaaggaagatcatgatcttgaatctaatggcactaacgttgtaatcaacaagtggaaattagcaaccttaaccgatgttgaagaagtaaaattattaatcagaatgttaccaacttgggccacaactattatgttctggactgtctatgcacaaatgaccacattttctgtgtcacaagctacaacaatggatcgtcacattggaacctttgaaattccaccggcttcactcacagtatttttcgtcggaagtatactcttgaccgtaattttctacgatagggttatcgttcccatttgtcgtcgtttcatgaataaacctcatggacttaccccattacaaagaattttcacagggctagttctttcaattttggccatgatagccgctgccctaacggaggttaagaggctaaaagtggcacatttgcatggattgaccaatgatgcaaatgctacaattcctttgagtgtattttggctagttccgcaattcttgctagtgggggcaggtgaagcatttacatatattggccaacttgattttttcttaagggaatgtccaaaaggaatgaagacaatgagtacagggctgtttttgagtacacttgcattggggtttttctttagttcaattttggttacaattgtgcatgttgtgactgggacaacaaatccatggctagctgataatttgaaccaagggaggttatatgatttctattggcttttggctatattgagtgtgttgaatttgatgtttttcttgtacttttcaagaaaatatgtgtacaaggagaagagacttgctgaaatggggattgaattggaagatgatggaccggtttgtcattga

SEQ ID NO: 8422 - protein, 594 aa, Nicotiana tabacum
MALPETQQDSKALPDAWDYKGRPALRSSSGGWASGAMILGVEAVERLTTLGIAVNLVTYLTGTMHLGNATAANNVTNFLGTSFMLTLFGGFVADTFLGRYLTIGIFATVQAMGVTILTISTIIPSLRPPKCEQVGSSSCIPANSKQLMVLYIALYMTALGTGGLKSSVSGFGTDQFDDADKKEKGQMIKFFDWFFFFINVGSLGAVTVLVYIQDNLGREWGYGICACAIVIGLVVFLSGTRKYRFKKLVGSPLTQIASVIVAAWKKRHLELLSDSSLLFEIDDIFGEGNKKNKQKLPHSKEYRFLDKAAIKEDHDLESNGTNVVINKWKLATLTDVEEVKLLIRMLPTWATTIMFWTVYAQMTTFSVSQATTMDRHIGTFEIPPASLTVFFVGSILLTVIFYDRVIVPICRRFMNKPHGLTPLQRIFTGLVLSILAMIAAALTEVKRLKVAHLHGLTNDANATIPLSVFWLVPQFLLVGAGEAFTYIGQLDFFLRECPKGMKTMSTGLFLSTLALGFFFSSILVTIVHVVTGTTNPWLADNLNQGRLYDFYWLLAILSVLNLMFFLYFSRKYVYKEKRLAEMGIELEDDGPVCH

SEQ ID NO: 8423 - DNA, 1773 bp, Nicotiana tabacum
  CDS (1)..(1773)
atggcacttcctgaaacacaacaagatacaaaaactctcccagatgcctgggattacaaaggtcgaccagctgttcgatcctcgtccggcggttggtccagcgccgccatgattttagggattgaggcagtggagaggctaacgacgttaggtattgctgtaaatctggtgacatacttgactggaaccatgcatttaggaaatgctagttcggccaacaacgttacaaattttcttggaacttcatttatgctcactttgcttggtggtttcgtagccgacacttttcttggacgatatcttacaattggcatctttaccactattcaagccatgggtgttaccatattgaccatctccacaataatcccaagcctacgaccaccaaagtgttccccagggagctcaacatgcattccagcaagttccaaacaactcatggttctatacatagcactatacatgacggcgctcggcaccggcggcctgaaatccagcgtctccggcttcggttcagaccagttcgacgaaaccgacaagaaagaaagaggacagatgataaaattcttcaactggttctttttcttcattaatgtgggatcacttggtgcagtgacagtactagtgtatattcaagataatttgggaagagaatatggttatggaatatgtgcttgtgctattgttattggtttggtcatattcttatcgggcacaagaaaatatcgtttcaagaaacttgtgggaagtccattgacacaaattgcttcagtttttgtggctgcttggaacaaaaggcatatggaattgccttctgattcttctcttttatacaatattgatgatattcctggggatggaaacaaaaaagctaagcagaggttgcctcacagcaaggaattccgtttcttggacaaggcagccattaaagtacaggaccctgaatccgctggaattaccgtggtaaataaatggaacttatcaactttaaccgacgttgaagaagtaaaattggtagtccgaatgttaccaacatgggccacgaccattatgttttggactgtctatgctcaaatgacaacattttccgtgtcacaagctacaaccatggaccgtcacatcggaaatttcgaaattcctccggcttcattgacactcttcttcgtcggaagtatcctcctaacgtgcatattctacgaccgcgctgtcgttccggtttgccgacgtgtcctcaacaaccctcacggtacaagcccgttgcaacgtattgcagttggcttaatcctttcaattatagccatgattgctgctgctttaactgaagtgaaaagattgaatgttgcacatttgcatggattgaccaatgatgctaatgcaaaggttcctttgagtgttttttggttagtcccacaattcttgctagtaggggcaggtgaggcatttacttacattggacaacttgatttctttctaagggaatgtcctaaagggatgaagacaatgagcacagggttattcttgagtacactttcactagggtttttctttagttctattttggtgactatagtgcacaaggtgacagggaaaaacccatggttagctgataatttaaaccaagggaggctctatgatttctattggctattggcaacgttgagtgtgttgaatttgatgattttcttgtttatttcgagacggtatgtgtacaaggagaagaggcttgctgagtgtgggattgaaatggaggattcagaaccagcttgccactaa

SEQ ID NO: 8424 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMELPSDSSLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTSPLQRIAVGLILSIIAMIAAALTEVKRLNVAHLHGLTNDANAKVPLSVFWLVPQFLLVGAGEAFTYIGQLDFFLRECPKGMKTMSTGLFLSTLSLGFFFSSILVTIVHKVTGKNPWLADNLNQGRLYDFYWLLATLSVLNLMIFLFISRRYVYKEKRLAECGIEMEDSEPACH

SEQ ID NO: 8425 - DNA, 1773 bp, Nicotiana tabacum
  CDS (1)..(1773)
atggcacttcctgaaacacaacaagatactaaaactctcccagatgcctgggattacaaaggtcgaccagctgttcgttcctcgtccggcggttggtccagcgccgccatgattttagggattgaggcagtggagaggctgacgacgttaggtattgctgtaaatctggtgacatatttgactggaaccatgcatttaggaaatgctagttcggccaacaatgttactaattttcttggaacttcatttatgctcactttgcttggtggtttcgtagccgacacttttcttggacggtatcttacaattggtatctttaccactattcaagccatgggtgttaccatattgaccatctccaccataatcccaagcctacgaccaccaaagtgttccccagggagctcaacatgcattccagcaagttccaaacaactcatggttctatacatagcactatacatgacggcgctcggcaccggcggcctgaaatccagcgtctccggcttcggttccgatcaattcgacgaaaccgacaagaaagaaagaggacagatgataaaattcttcaactggttctttttcttcattaacgtgggatcccttggtgcagtgacagtactagtgtatattcaagataatttgggaagagaatatggttatggaatatgtgcttgtgctattgttattggtttggtcatattcttatcgggcacaagaaaatatcgtttcaagaaacttgtgggaagtccattgacacaaattgcttcagtttttgtggctgcttggaacaaaagacatatggatttgccttctgattcttatcttctatataatattgatgatattcctggggatggaaataaaaaagctaagcagagattgcctcacagcaaggaattccgtttcttggacaaggcagctattaaagtacaggaccctgaatccgctggaattaccgtggtaaataaatggaacttatcaactttaaccgacgttgaagaagtaaaattggtagtccgaatgttaccaacatgggccacgaccattatgttttggactgtctatgctcaaatgacaacattttcagtgtcacaagctacaacaatggaccgtcacatcggaaatttcgaaattcctccggcctcattgacacttttcttcgtcggaagtatcctcttaacgtgcatattctacgaccgtgccgtcgtaccggtttgtcgacgtgtcctaaacaatcctcacggtacaaccccgttgcaacgtattgcagttggattaatactttcaattatagccatggttgctgctgctttaactgaagtgaagagattgaatgttgcacatttgcatggattgaccaatgatgcaaatgccaaggttcctttgagtgttttttggttagttccgcaattcttgctagtaggggcaggtgaggcatttacttatatcggacaacttgatttcttcctaagggagtgtcctaaaggaatgaagacaatgagcacggggttattcttgagtacactttcattagggtttttctttagttctattttggtgactatagtgcataaggtgacagtgaaaaacccatggttagctgataatttaaaccaaggaagactctatgatttctattggctattggcaacgttgagtgtgttgaatttgatgattttcttgtttatttcaagacggtatgtgtacaaggagaagagacttgctgaatgtgggattgaaatggaggattcagaaccagcttgccactaa

SEQ ID NO: 8426 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSYLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFFSSILVTIVHKVTVKNPWLADNLNQGRLYDFYWLLATLSVLNLMIFLFISRRYVYKEKRLAECGIEMEDSEPACH

SEQ ID NO: 8427 - DNA, 1725 bp, Aspergillus fumigatus
  CDS (1)..(1725)
atgagcgatcctgtcgacgctgcagacttggtggccgtggctcaggctcacgcccccaagcagtctctggaggtcgtcccagtgaaagaacacgagactagggtggttgctacagctcgtagacttgatgatcaaggtcgtgaaattccaactgaagaggaagaacacactcttcgtcgcgtcgctggcaaggttcattggactgcgtacacgatcgcctttgtcgaactctgcgagcgtttctcctactatggaaccactgctgtctgtacttgtcaacttcattcagcagcctctccccgatggttcgagcactggagccgtgtatgcctgacacttgccatagtcaacacattctggtgttatttgatgcctattctgggtgcttacattgccgacgagttctggggacggctgaagacgattcaggtttccatcgccttcgcgatggttggacacataattctgattatttccgccttgccatctgttatcgctcatccacatggcgctctgggatgcttcgccgtcggtttggtcatctttggaattggtgtcggaggtttcaagtcaaacattgcccctctgatagctgaacagcacaaggaaacaaggtccttcatcaaggtgatacccaagacaggcgagcgtgtcattgtggaccctgctcagacgatcactcggattttcctgtacttctacttcatgattaacgtcggcgccttggttggctcaatcgccatggtgtatgccgagaaatacgtgggattctggcttgcatttcttctcccaaccatcatgtttgcgttctgccctgctgtgatctttgcatgccgcaacaagtacgaggtcacacccgctaccggctcggtttccgcgaaagcattcaagctctgggcttttgctctccaaggccgctggtcgtggaatccagtgcgattggttcaaaataagccagagtggatgacatttgatgaccaatgggtcgatgaagtacgcagagctgtcaaagcgtgtgctgtctttctctggtatcctgtctactggttggcctatgggcagatgaccaacaatctgacctcgcaggcagccacaatgcagctgaacggtgtccctaacgacttgatcaataacctggaccctcttgcattaatcatcttcattccaatcatggatcagttcatctaccccggcatccgcaggatgggattcaacttcaccccgctcaagaggatttatgttggctacttccttgcctccatgtccatgatagcggctgccgtcacgcaatactacatctacaagatgagcccatgtggcgaccaccccagcgactgtgacaaaccggcaccaatcaacgtgtgggttcagactctgccgtatgtcctgatcgccttctcggagatcttcacttccatcacgggctatgagtacgcattcacgaaggctcccaagaacatgaagagtttagtccaatcgatttacctcttcatgaacgccatctcgtctgcaatccagcaaggacttacggcgttgtccactgatccgctcctgatctggaactatggattcgtggctgttctggcgtttgttgctggtaacctcttttacctaacccactattcgctggacaaggaggaggaccgactcaacaatctcgaggcttcggcgtacttgggtactaaccctggtgctcgagatgaaaagattgacccggagccgtag

SEQ ID NO: 8428 - protein, 574 aa, Aspergillus fumigatus
MSDPVDAADLVAVAQAHAPKQSLEVVPVKEHETRVVATARRLDDQGREIPTEEEEHTLRRVAGKVHWTAYTIAFVELCERFSYYGTTAVCTCQLHSAASPRWFEHWSRVCLTLAIVNTFWCYLMPILGAYIADEFWGRLKTIQVSIAFAMVGHIILIISALPSVIAHPHGALGCFAVGLVIFGIGVGGFKSNIAPLIAEQHKETRSFIKVIPKTGERVIVDPAQTITRIFLYFYFMINVGALVGSIAMVYAEKYVGFWLAFLLPTIMFAFCPAVIFACRNKYEVTPATGSVSAKAFKLWAFALQGRWSWNPVRLVQNKPEWMTFDDQWVDEVRRAVKACAVFLWYPVYWLAYGQMTNNLTSQAATMQLNGVPNDLINNLDPLALIIFIPIMDQFIYPGIRRMGFNFTPLKRIYVGYFLASMSMIAAAVTQYYIYKMSPCGDHPSDCDKPAPINVWVQTLPYVLIAFSEIFTSITGYEYAFTKAPKNMKSLVQSIYLFMNAISSAIQQGLTALSTDPLLIWNYGFVAVLAFVAGNLFYLTHYSLDKEEDRLNNLEASAYLGTNPGARDEKIDPEP

SEQ ID NO: 8429 - DNA, 1868 bp, Arabidopsis thaliana
  CDS (76)..(1824)
gacattaaaaaaaaaacagaaactaccaaacaaattagagagagaaaagaaagaaagaaagaaggtagagaggaaatgacagtagaagaggtaggagacgattacacaaaagatggaacagttgatcttcaaggcaatcctgttcgaagatccattagaggtcgttggaaagcttgctctttcgttgttgtgtacgaggtgtttgaacggatggcttattacgggatatcaagcaacctgtttatttacatgacaaccaaattgcaccaaggaacggtcaagtcgtcgaacaatgtgaccaattgggttgggactagttggctcactccaatcttgggtgcttacgttggagacgctcttctcggtcgctacatcactttcgtcatctcttgtgctatctatttctcggggatgatggtgttaacattatcagtaactataccgggaattaagccaccagaatgttccacgactaatgtggaaaattgcgaaaaagcttcggttttacaattagcagttttctttggagcgttatacacattagcaatcggtacaggcggtacgaaaccgaacatatcaacaataggagctgatcaattcgatgtattcgacccaaaggagaagactcaaaaactatcattcttcaactggtggatgtttagtatcttctttggtactctcttcgccaacactgttcttgtctatgttcaagataatgttggctggaccttgggttatggacttccaacattaggtttggctatttccattaccattttcttgttgggcactccgttttaccgccataaacttcccactggaagcccattcaccaagatggctcgagtcatcgtggcttcatttcgcaaagccaatgcaccaatgacgcatgacatcacgagcttccatgagctgccttctcttgaatatgagcggaaaggcgcctttccgatccaccctactccaagtttacgattcttagacagagcttcactcaaaacaggaacaaatcataaatggaatctttgtactaccacagaagttgaagaaacaaaacaaatgctgagaatgttaccagtcttgttcataactttcgtcccaagtatgatgcttgcacaaatcaacacattgtttgtgaaacaaggaaccactctagaccgaaaggttaccggatctttcagcatcccaccagcgagtctctccggatttgtcacactctcaatgcttatttccatagtcttgtatgaccgagttttcgtcaagataacccgaaaattcactggtaatccaagaggcattactttgcttcaacgaatgggaattggtcttatctttcatatcctcatcatgatcgtcgcatctgtcactgaaaggtatagactcaaagtcgctgctgatcatggtctcatccaccaaaccggagtaaaactaccattaaccatctttgctttgcttccacaattcgtcctaatgggtatggctgattcgttcttagaagttgcaaagcttgagtttttctacgatcaagctcccgagagcatgaaaagcctcgggacatcatattcgacaacgagtttggcgattgggaatttcatgagcagtttcttgttatctacggtatctgagataacaaagaaacgaggaagaggatggattttgaacaaccttaatgagtctaggttggattactattacctgttctttgcggtacttaatctggttaacttcattttgttcttggtcgtggttaagttttatgtttatagagctgaggttactgattcggttgatgtgaaagaggtggaaatgaaagagactgaataacaaataatgaataatatagatttctctgaaaaaaaaaaaaaaaa

SEQ ID NO: 8430 - protein, 582 aa, Arabidopsis thaliana
MTVEEVGDDYTKDGTVDLQGNPVRRSIRGRWKACSFVVVYEVFERMAYYGISSNLFIYMTTKLHQGTVKSSNNVTNWVGTSWLTPILGAYVGDALLGRYITFVISCAIYFSGMMVLTLSVTIPGIKPPECSTTNVENCEKASVLQLAVFFGALYTLAIGTGGTKPNISTIGADQFDVFDPKEKTQKLSFFNWWMFSIFFGTLFANTVLVYVQDNVGWTLGYGLPTLGLAISITIFLLGTPFYRHKLPTGSPFTKMARVIVASFRKANAPMTHDITSFHELPSLEYERKGAFPIHPTPSLRFLDRASLKTGTNHKWNLCTTTEVEETKQMLRMLPVLFITFVPSMMLAQINTLFVKQGTTLDRKVTGSFSIPPASLSGFVTLSMLISIVLYDRVFVKITRKFTGNPRGITLLQRMGIGLIFHILIMIVASVTERYRLKVAADHGLIHQTGVKLPLTIFALLPQFVLMGMADSFLEVAKLEFFYDQAPESMKSLGTSYSTTSLAIGNFMSSFLLSTVSEITKKRGRGWILNNLNESRLDYYYLFFAVLNLVNFILFLVVVKFYVYRAEVTDSVDVKEVEMKETE

SEQ ID NO: 8431 - DNA, 1916 bp, Cucumis sativus
  CDS (19)..(1833)
gcaaagaggtaaataagaatggagattgagtccctcagagtgagtgttgatgagaaggttctgaaagatgaagagaaaaatgagaaagaagaaatgaagatgaagatgaagatgaagagaaagcttggtggtgtcaagacaatgcctttcattcttggaaatgaagtgtgcgatagatttgcaagctcagggtttcattccaacattataacatatttgacacaagatcttaacatgcctcttgttcctgcctccaacattctcaccaactttgctgcaacttctagcttcacttcccttatcggcgctctcattgccgattcctttgctggtcgcttctggaccatcaccatcgcctccatcatctatgagctcggaatggttaccatcaccatttcagctatactcccatcgctccacccgccaccttgccccacccaaatcaattgcacgcaagcatccggcacgcaactaatgatcctttatctcgccctactcctcacatctcttggcgcaggcggtattcgaccctgtgttgttgcatttgccgccgaccaattcgacatgacgaaggtcggtattgcagggcgaacgtggaacttcttcaattggtactatttttgcatgggaatggcgactctcacagccctgaccgtggtggtgtatattcaagacaacgtggggtgggggtgggggttcggccttccgaccatagccatggccttgtctgttgtggcatttgttgtgggctcgccactttacaacaaactcaagccaagtgggagccctttggttcgattggctcaggttgtggttgcggccttcaagaaccgaaaggctgttttgcctgatgactctaagcttttgtataggaaccatgagcttgatgctgccattgctattcaaggaaggcttgtccacactgatcagttcaagtggttggacaaggctgcagtcataacaagtccggattcaacagccaatccaccgaatctgtggcggctggccaccgtgcacagagtcgaagagctaaaatccatcattagaatgcttccaatatgggcggccggaatcctcctagtgacagcctcatctcatcaacacagcttcacaatccaacaagctagaacaatgaaccgtcatctaacacccaccttccaaattccacccgccaccctctccatcttcggcatcctatcgatgctcaccggcctcgttctctacgaccgtctcctcgtccccttcgccaaaaagctcacccacaacccctcgggcatcacttgcctccaacgaatgggtgtaggtttcgccatcaacatcctcgccaccctagtctcatccattgttgaaatcaaacgaaaaaaagtcgctgcaaaccatggtttgctcgacaatccaaccgcaacaattccatttagcgtgttttggttggtaccacagttttggcttcatgggatcgcggaggtgttcatgtcggttgggcatttggagttcatgtacgaccagtcgccggagagcttgaggagtacagcaacggcgttgtattggctcgcaatatcggtgggaaattatatagggacattgatggtttatcttgtgcataagtatactggggaagagcataattggttgcctgataggaatttgaatagaggaagattggagtattattattggttagtgagtgggattcaagttatgaatcttgtgtattatgtgatttgtgcttggttttatacttataagcctttggaagaggagaagattaacatagagaacaaagatggtgatcaagagtgggagaggtgtgaagacacaattaagatagcttaatttaattttaagtactatttgtaattttcagtaattagggggtcaagtacttgtttggaaaagatatagggttttgaaatatg

SEQ ID NO: 8432 - protein, 604 aa, Cucumis sativus
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 8433 - DNA, 1785 bp, Oryza sativa subsp
  CDS (1)..(1785)
atggtgttgccggagacggcggcggaggggaaggcgctgacggacgcgtgggactacaaggggaggccggcggggagggcggccaccggcgggtggggctgcgcggcgatgatcctcggggcggagctgttcgagcggatgacgacgctgggcatcgccgtcaacctggtgccgtacatgaccgggacgatgcacctcggcaatgccgccgccgccaacacggtcaccaacttcatcggcacctccttcatgctctgcctcctcggcggcttcgtcgccgacacctacctcggccgctacctcaccatcgccatcttcgaggccgtccaggccaccggcgtgatgatactcacgatctccacggcggcgccggggctgcggccgccggcgtgcggcgacccgaagggggcgagcgcggagtgcgtggcggcggacgggacgcagctcggggtgctctacctggggctctacctgacggcgctgggcacgggggggctcaagtccagcgtctccggcttcggctccgaccagttcgacgagtccgacgtcgacggcgagaggaagaagatgatgcgcttcttcaactggttctacttcttcgtcagcctcggcgcgctgctcgccgtcaccgtgctggtgtacgtgcaggacaacgtcggacgccggtgggggtacggcatctgcgccgccggcatcctcgccggcctcgccgtgttcctctccgggaccaggaggtacaggttcaagaagctggtggggagccccctcacccaggtcgccgccgtcaccgccgccgcctggagcaagaggtcgctgccgctgccgtccgacccagacatgctctacgacgtcgacgacgccgccgccgccggccatgacgtcaagggcaagcagaggatgccacacagcaaggagtgccggttcctggaccatgcggcgatcatcgacaggtcggcggcggagtcgccggcgacggcgagcaagtggaggctgtgcacgaggacggacgtggaggaggtgaagcaggtggtgcggatgctccccatctgggcgaccaccatcatgttctggaccatccacgcccagatgaccaccttcgccgtcgcgcaggccgagctcatggaccgccgcctcgccggcggcttcctcatcccggcgggctccctcaccgtcttcctcatcgcctccatcctcctcaccgtccccttctacgaccgcctcgtcgtccccgtcgcgcgccgcgccacggccaacccgcacggcctcaccccgctccagcgcgtcttcgtgggcctctccctctccatcgccggcatggccgtcgccgcggccgtcgagcgccaccgcgccaccgcctccgcctccgccgccgccgccgcgcccacggtgttcctcctcatgccgcagttcctcctcgtcggcgccggcgaggcgttcacctacatgggccagctcgacttcttcctccgcgagtgccccaaggggatgaagaccatgagcacgggcctcttcctcagcacctgcgccatcggcttcttcttcagcacgctgctcgtcaccatcgtccacaaggtcaccggccatggcgcccgcggcggcggctggctcgccgacaacctcgacgacggcaggctcgactacttctactggctgctcgccgtcatcagcgccatcaacctcgtcctcttcaccgtcgccgccagggggtacgtctacaaggagaagcgcctcgccgacgccggcatcgagctcgccgacgaggagaccatcgccgtcggccactaa

SEQ ID NO: 8434 - protein, 594 aa, Oryza sativa subsp
MVLPETAAEGKALTDAWDYKGRPAGRAATGGWGCAAMILGAELFERMTTLGIAVNLVPYMTGTMHLGNAAAANTVTNFIGTSFMLCLLGGFVADTYLGRYLTIAIFEAVQATGVMILTISTAAPGLRPPACGDPKGASAECVAADGTQLGVLYLGLYLTALGTGGLKSSVSGFGSDQFDESDVDGERKKMMRFFNWFYFFVSLGALLAVTVLVYVQDNVGRRWGYGICAAGILAGLAVFLSGTRRYRFKKLVGSPLTQVAAVTAAAWSKRSLPLPSDPDMLYDVDDAAAAGHDVKGKQRMPHSKECRFLDHAAIIDRSAAESPATASKWRLCTRTDVEEVKQVVRMLPIWATTIMFWTIHAQMTTFAVAQAELMDRRLAGGFLIPAGSLTVFLIASILLTVPFYDRLVVPVARRATANPHGLTPLQRVFVGLSLSIAGMAVAAAVERHRATASASAAAAAPTVFLLMPQFLLVGAGEAFTYMGQLDFFLRECPKGMKTMSTGLFLSTCAIGFFFSTLLVTIVHKVTGHGARGGGWLADNLDDGRLDYFYWLLAVISAINLVLFTVAARGYVYKEKRLADAGIELADEETIAVGH

SEQ ID NO: 8435 - DNA, 2000 bp, Nicotiana plumbaginifolia
  CDS (54)..(1838)
cattgctcattgggtccatttttgtgggcaaaaaggcaaaaaaagttgctaaaatggcacttcctgagacacagcaagattcaaaagctttaccagatgcctgggattataaaggcagaccagctcttagatcctcctctggtggttgggctagtggtgcaatgattttaggtgttgaagctgtggagaggctaacaacactagggattgctgtaaatttggtgacatatttgactggaactatgcatttagggaatgctactgcagccaacaatgttaccaattttcttggaacttctttcatgctcactttacttggtggttttgttgctgacactttcctcggaaggtatcttacaattggtatctttgccactgttcaagcaatgggtgttacaatcttgaccatttccaccataatcccaagcctacgtccaccaaaatgtgaacaagttggtagctcatcatgcattcccgcaaatagcaaacaacttatggtcctatacattgccctatacatgacggcgctcggcaccggcggcctaaaatcgagcgtctccggctttggcaccgaccaattcgacgatggtgacaaaaaagaaaaaggtcaaatgataaaattcttcgattggttctttttctttattaatgtaggctcgctcggcgcagttacagtattggtgtatattcaagataatttgggaagagaatggggttatggaatatgtgcatgtgctattgttattggacttgttgtgttcttatctgggacaagaaaatataggttcaagaaacttgtgggcagtccattgacacaaatcgcttcagttattgtggctgcttggaaaaaaacacatttggaattaccttcaaattcttcacttctctttgaaattgataatatttttggtgaaggaaataaaaaaagcaagcaaaagttgcctcatagcaaggaataccgattcttggacaaggcagccattaaggaagataatgaccttgaatctaatggcactaaagtggtaatcaacaagtggaaattagcaaccttaaccgatgttgaagaagtaaaattattaatcagaatgttaccaacttgggccacaactattatgttctggactgtgtatgcacaaatgaccacattttctgtgtcaaaagctacaacaatggatcgtcacattggaacctttgaaattccaccggcttcactcaccgtatttttcgtcggaagtatactcttgaccgtaattttctacgatagaattatcgttcctatttgtcgtcgtttcatgaataaacctcatggacttaccccattacatagaattttcacagggctagttctttcaattttggccatgattgctgctgccctaacggaggttaagaggctaaaagtggcacatttgcatggattgaccaatgatgcaaatgccacaattccattgactgtattttggctagttccgcaattcttgctagttggggcaggtgaagcatttacatatattggccaacttgattttttcttgagggaatgtccaaaagggatgaagacaatgagtacagggctatttttgagtacacttgcacttggattttttgttagttctattttggttacaattgtgcatgttgtgactgggacaaaaaatccatggctagctgataatttgaaccaagggaggttatatgatttctattggcttttggcaatattgagtgtgtttaatttgatgtttttcttgtattcgtcgagaaaatatgtgtacaaggagaagaggcttgctgaaatggggattgaattggaagatgatggaccggtttgtcattgaaaagtcataaaccaatacatcatcaccaataattggtctattgaaagcagtctgtctatctttgactgcactagatatgctattgttactctaccatcaacaaaaaattaaaaaaaatctttttttcttttggctttaacttttggcttctttggttgagct

SEQ ID NO: 8436 - protein, 594 aa, Nicotiana plumbaginifolia
MALPETQQDSKALPDAWDYKGRPALRSSSGGWASGAMILGVEAVERLTTLGIAVNLVTYLTGTMHLGNATAANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDGDKKEKGQMIKFFDWFFFFINVGSLGAVTVLVYIQDNLGREWGYGICACAIVIGLVVFLSGTRKYRFKKLVGSPLTQIASVIVAAWKKTHLELPSNSSLLFEIDNIFGEGNKKSKQKLPHSKEYRFLDKAAIKEDNDLESNGTKVVINKWKLATLTDVEEVKLLIRMLPTWATTIMFWTVYAQMTTFSVSKATTMDRHIGTFEIPPASLTVFFVGSILLTVIFYDRIIVPICRRFMNKPHGLTPLHRIFTGLVLSILAMIAAALTEVKRLKVAHLHGLTNDANATIPLTVFWLVPQFLLVGAGEAFTYIGQLDFFLRECPKGMKTMSTGLFLSTLALGFFVSSILVTIVHVVTGTKNPWLADNLNQGRLYDFYWLLAILSVFNLMFFLYSSRKYVYKEKRLAEMGIELEDDGPVCH

SEQ ID NO: 8437 - DNA, 1975 bp, Nicotiana plumbaginifolia
  CDS (190)..(1962)
tttttttatcaagaactcaatatattcttgcttggaagctaaaatatcctttaccacattcactagctacgatataccagatggtattaacaattatcattgtacaaagcttagttcaatccaacaattactggtcaaaatgaaaacccttttcctctgcaacctttttctcttattatcgttcaaaatatggcacttcctgaaacacaacaagatactaaaactctaccagatgcctgggattacaaaggtcgaccagctgttcgttcctcgtcaggcggttggtccagcgccgccatgattttagggattgaggcagtggagaggctgacgacgttaggtattgctgtaaatttggtgacatatttgactggaaccatgcatttaggaaatgctagttcggccaacaatgttactaattttcttggaacttcatttatgctcactttgcttggtggtttcgtagccgacacttttcttggacggtatcttacaattggtatctttaccactattcaagccatgggtgttaccatattgaccatctccaccataatcccaagcctacgaccaccaaagtgttccccaggtagctcaacatgcattccagcaagttccaaacaactcatggttttatacatagcattatacatgacggcgctcggcactggcggcctgaaatccagcgtctccggcttcggttccgatcagttcgacgaaaccgacaagaaagaaagaggacagatgataaaattcttcaactggttctttttcttcattaatgtgggatcacttggtgcagtgacagtattagtgtatattcaagataatttgggaagagaatatggttatggaatatgtgcttgtgctattgttattggtttggtcatattcttatcggggacaagaaaatatcgtttcaagaaacttgtgggaagtccattgacacaaattgcttcagtttttgtggctgcttggaacaaaagacatatggatttgccttctgattctactcttttatataatattgatgatattcctggggatggaaataaaaaagctaagcagagattgcctcacagcaaagaattccgtttcttggacaaggcagctattaaagtacaggacactgaatccgctggaattactgtggtaaataaatggaatttatcaactttaaccgatgttgaagaagtaaaattagtagtccgaatgttaccaacatgggccacgaccattatgttttggactgtctatgctcaaatgacaacattttccgtgtcacaagctacaaccatggaccgtcacataggaaatttcgaaattcctccggcatcattgacgctcttcttcgtcggaagtatcctcttaacgtgcatattctacgaccgtgccgtcgtgccggtttgtcgacgtgtcctcaacaatcctcacggtacaaccccgttgcaacgtattgcagttggtttaattctttcaattatagccatggttgctgctgctttaactgaagtgaagagattgaacgttgcacatttgcatggattgaccaatgatgctaatgccaaagttcctttgagtgttttttggttagttccgcaattcttgctagtaggggcaggtgaggcatttacttatattggacaacttgatttctttctaagggaatgtcctaaaggaatgaagacaatgagtacagggttattcttgagtacactttcattagggtttttcgttagttctattttggtgactatagtgcataaggtgacagtgaaaaacccatggttagctgataatttaaaccaagggaggctctatgatttctattggttattggcaacgttgagtgtgttgaatttgatggttttcttgtttatatcaagacggtatgtgtacaaggaaaagagacttgctgagtgtgggattgaaatggaggattcagaaccagcttgccactaaattaggtttcttt

SEQ ID NO: 8438 - protein, 590 aa, Nicotiana plumbaginifolia
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSTLLYNIDDIPGDGNKKAKQRLPHSKEFRFLDKAAIKVQDTESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFVSSILVTIVHKVTVKNPWLADNLNQGRLYDFYWLLATLSVLNLMVFLFISRRYVYKEKRLAECGIEMEDSEPACH

SEQ ID NO: 8439 - DNA, 1952 bp, Solanum lycopersicum
  CDS (51)..(1793)
gaagagtgagatccatcaatttgaagctttgcatatgggtagtcaaacagatgaaatacctcttctcgaagaatggtggccttcttgaggatgagaatagtggactctatactagggatggttctgttgatataaagggtaatcctgtcttaaaaagtgagacagggaactggagagcttgcccatttattcttggtaatgaatgttgtgaacgtttggcatactatggcattgctgctaatcttgttacttatcttactaaaaagttacatgagggaaacgtttcagctgctagaaatgtcactacttggcaaggcacttgttacataacgcccctaattggggctgtactggcagatgcatactggggaagatattggacgattgctaccttctcaactatctacttcatcggcatgtgcacgttgacactatcggcttcagttcctgcttttaagccccctcaatgtgtgggctctgtgtgcccttcggcatctcctgcccagtatgccatattcttttttggcctctatctgattgctcttggtactggtgggatcaaaccatgtgtttcgtcatttggagctgatcaatttgatgacacagatccaaaagagagggttaaaaagggatccttcttcaattggttctatttttctatcaacattggagctttgatatcaagcagtttgatcgtgtggattcaagaaaatgctggatggggccttgggtttggcatccctgcagttttcatgggcattgccattgcaagtttcttttttggtacaccactctacagatttcagaagcctgggggaagtcctctcacaagaatgtgccaggttttggttgcagtattccacaaatggaacttgtctgtccccgatgatagtacactactttatgagaccccagacaaaagctctgcaattgaagggagccgaaagctgttgcacactgatgaactaaggtgcctcgacaaagctgctgtagtttcagacaacgaattgacgactggggactattccaatgcttggaggctctgtactgttacgcaggttgaggaactgaaaattttgatccgcatgtttccgatatgggcaactggtatagtcttttctgctgtttatgcacaaatgtctacaatgtttgtggagcaagggatggtgatggacactgccgttggttccttcaaaattcctgcagcatctctttctactttcgataccattagtgttattgtgtgggtcccagtctatgataagatccttgttccaattgcaaggaggtttactggaatagagaggggattttccgagttacagaggatgggtattggacttttcctttcaatgttgtgcatgtctgctgctgctatcgttgagatcaggcgcctacaacttgcaagagaccttggattggtggatgaagccgtttcagtacctctcagtatcttttggcagattccgcaatattttatactgggtgcagctgagatatttactttcattgggcagcttgagtttttttatgatcaatcacctgatgcaatgcgtagcttgtgcagtgcattgtcactgctgacaactgctttgggtaattacttgagctctttcatcctgactgtagtaacgtccattacaactcgaggtggcaaacctggatggattccaaacaacttgaacggtgggcatcttgattatttcttctggcttttggctgcacttagcttcttcaacttagtaatctatgtttttctgtgccaaatgtataaatccaagaaggcatcctaagttgaagttggttttagccaccctcttatgtttctaaatgaaagaaaacataatgtgattcttatagaacttttgtaagttatgagctgccaaactttcaaaagatcttttaattaatggtgttactgtcttattgttctttcaaagttgctttgcttc

SEQ ID NO: 8440 - protein, 580 aa, Solanum lycopersicum
MKYLFSKNGGLLEDENSGLYTRDGSVDIKGNPVLKSETGNWRACPFILGNECCERLAYYGIAANLVTYLTKKLHEGNVSAARNVTTWQGTCYITPLIGAVLADAYWGRYWTIATFSTIYFIGMCTLTLSASVPAFKPPQCVGSVCPSASPAQYAIFFFGLYLIALGTGGIKPCVSSFGADQFDDTDPKERVKKGSFFNWFYFSINIGALISSSLIVWIQENAGWGLGFGIPAVFMGIAIASFFFGTPLYRFQKPGGSPLTRMCQVLVAVFHKWNLSVPDDSTLLYETPDKSSAIEGSRKLLHTDELRCLDKAAVVSDNELTTGDYSNAWRLCTVTQVEELKILIRMFPIWATGIVFSAVYAQMSTMFVEQGMVMDTAVGSFKIPAASLSTFDTISVIVWVPVYDKILVPIARRFTGIERGFSELQRMGIGLFLSMLCMSAAAIVEIRRLQLARDLGLVDEAVSVPLSIFWQIPQYFILGAAEIFTFIGQLEFFYDQSPDAMRSLCSALSLLTTALGNYLSSFILTVVTSITTRGGKPGWIPNNLNGGHLDYFFWLLAALSFFNLVIYVFLCQMYKSKKAS

SEQ ID NO: 8441 - DNA, 1857 bp, Schizosaccharomyces pombe
  CDS (1)..(1857)
atgagtagcattgaagaacaaattacgaaatcggactccgatttcatcatttcagaagatcaatcctacttaagcaaggagaaaaaggctgatggttctgccaccatcaacaccgctgacgaacaatcctccaccgatgaactccaaaaatccatgtccaccggcgtcctcgtcaatggtgacttatacccttctcctaccgaagaagaattagccacccttcctcgtgtttgcggtactattccttggaaagcctttattatcattattgtcgagctttgcgaacgtttcgcttactatggtctcactgttccctttcaaaattatatgcaattcggtcctaaggatgctactccaggtgcccttaatttaggcgaaagcggtgctgacggtctttctaatttcttcacattttggtgttatgtcaccccggttggcgctgcacttattgctgatcaattccttggtaggtacaataccattgtttgctctgctgtcatttactttattggtatcttgattcttacatgtactgctattccttctgtcattgatgccggaaaaagtatgggtgggtttgtcgtctctttgatcatcattggtcttggaaccggtggtatcaaatccaatgtttcccccttgatggctgaacagcttccaaaaattcctccttatgtaaagaccaagaaaaatggtagcaaggtcattgttgaccccgtcgtcaccacctctcgtgcctatatgattttctactggtcaattaacgtcggttctctctccgtattagccaccactagtttggaaagtactaaaggttttgtttacgcatacttgcttcccttgtgcgtctttgttatccccttaattattttggctgttagtaagcgcttttacaagcacactcctccctccggttccatctttgttcgtgttggtcaagtgttcttccttgctgctcaaaacaaatttaatctcgaaaaaactaaaccatcttgcactactactgttggacgcgttacgctcaaggatcagtgggatgacttgtttatcgacgaattgaaacgtgccttacgcgcctgcaaaacttttctcttttaccctatctattgggtatgctatggtcaaatgaccaacaacttaatttctcaagctggacaaatgcaaacgggtaatgtctctaacgatcttttccaagccttcgattcaatcgccttgattattttcattcccatttgtgacaatatcatctatccattattgcgtaagtataacatccctttcaaacccatccttcgtattactttagggtttatgtttgctactgcttccatgatttacgctgctgttttacaagcaaagatttatcaaagaggcccttgctatgcaaattttactgatacatgtgtttccaatgacatcagtgtttggatccaaatccctgcttacgttttgattgctttctctgaaatttttgccagtattactggtttagaatttgcatttaccaaggcccctccttcaatgaaatccattattactgctttgttcttgttcaccaatgcattcggtgccattctatctatttgcatttcttctactgctgtcaatcctaagcttacttggatgtacactggtattgccgtcactgcctttattgctggtattatgttttgggtttgcttccaccactatgatgctatggaagatgaacaaaatcaacttgagttcaagcgtaatgatgcgttaacgaagaaggacgttgaaaaggaagttcatgatagttatagcatggcagatgagtcccaatacaatttggaaaaagcaactgctgaagaggaaatcatgaaaagcacataa

SEQ ID NO: 8442 - protein, 618 aa, Schizosaccharomyces pombe
MSSIEEQITKSDSDFIISEDQSYLSKEKKADGSATINTADEQSSTDELQKSMSTGVLVNGDLYPSPTEEELATLPRVCGTIPWKAFIIIIVELCERFAYYGLTVPFQNYMQFGPKDATPGALNLGESGADGLSNFFTFWCYVTPVGAALIADQFLGRYNTIVCSAVIYFIGILILTCTAIPSVIDAGKSMGGFVVSLIIIGLGTGGIKSNVSPLMAEQLPKIPPYVKTKKNGSKVIVDPVVTTSRAYMIFYWSINVGSLSVLATTSLESTKGFVYAYLLPLCVFVIPLIILAVSKRFYKHTPPSGSIFVRVGQVFFLAAQNKFNLEKTKPSCTTTVGRVTLKDQWDDLFIDELKRALRACKTFLFYPIYWVCYGQMTNNLISQAGQMQTGNVSNDLFQAFDSIALIIFIPICDNIIYPLLRKYNIPFKPILRITLGFMFATASMIYAAVLQAKIYQRGPCYANFTDTCVSNDISVWIQIPAYVLIAFSEIFASITGLEFAFTKAPPSMKSIITALFLFTNAFGAILSICISSTAVNPKLTWMYTGIAVTAFIAGIMFWVCFHHYDAMEDEQNQLEFKRNDALTKKDVEKEVHDSYSMADESQYNLEKATAEEEIMKST

SEQ ID NO: 8443 - DNA, 1713 bp, Brassica napus
  CDS (1)..(1713)
atggaagaaaaggatgtgtatacggaagatggaactgtcgatattcacaaaaaccctgccaacaagaagaagaccggaaactggaaagcttgccgcttcatccttggcaatgagtgctgtgaaagattggcatactatggaatgggaactaacctcgtgaactatcttgagagtcgtctgaatcaaggcaacgctactgctgcaaacaacgtcaccaactggtccggaacatgttatataactcctttgattggtgcctttctagctgatgcttatcttggacgttactggactattgcaacctttgttttcatctatgtctccggcatgactctgttgacattatcagcctcagttcctggacttaaacccggtaactgcaacggcgacacgtgtcaccccaactctggccaaacagctgttttcttcgttgcactttacatgatcgcgcttggaacgggaggtattaagccgtgtgtttcctcctttggagctgatcagttcgatgagaatgacgaagccgagaagctgaagaaaagctctttcttcaactggttttacttctccattaacgtcggagctcttgttgccgccactgttcttgtctggatacaaatgaacgttggttggggatgggggttcggtgttccgacagtggctatggtcattgcggttgtgtttttcttcctggggagtcgttactacaggcttcaaagacctggtgggagtccactcacgaggatctttcaggttattgttgctgctttcaggaaggtgagtgttaaggttccagaggacaagtctctgctctttgaaactgcagatgatgagagtaatatcacaggtagcaggaagcttgagcacacagacaacttaatgtttttcgacaaggcagcggttgagagtcattcagatagcatcaaagacggtgaggtgaatccatggagactctgctcagtaacacaagtagaagagctcaagtccataatcactcttcttccagtatgggcctcagggatagtctttgcaacagtgtacagccaaatgaacacaatgttcgtcttacaaggaaacacaatggaccaacacatggggaaaaatttcgagatcccatcggcttccctctcgcttttcgacacggtcagtgtactcttctggactcctgtctacgaccagtttattgtcccgttcgctagaaagttcacacgtcaagaacgtggcttcactcagcttcaacgtatgggaataggtctcgtgatctccatctttgccatggtcactgcaggtgttttggaggtcgttaggctcgactacgtcaaaagccacaatgcatacgatgataaaaagatccccatgtcgattttctggcagatacctcagtatttacttgttgggtgtgctgaagttttcacatttataggtcagcttgagtttttctatgaccaggctccagatgccatgaggagtctctgctctgctttgtctttaaccacggttgcgcttgggaactacttaagcacggttcttgtaacggttgtgatgaaactgactaagaagaatggtaaaccgggttggataccggataacttgaaccgggggcatcttgattactttttctacttgctggcggttctgagtttcctcaacttcttggtgtacctatggatctctaaacgctacaagtataagaaagctataggtcgggcacattga

SEQ ID NO: 8444 - protein, 570 aa, Brassica napus
MEEKDVYTEDGTVDIHKNPANKKKTGNWKACRFILGNECCERLAYYGMGTNLVNYLESRLNQGNATAANNVTNWSGTCYITPLIGAFLADAYLGRYWTIATFVFIYVSGMTLLTLSASVPGLKPGNCNGDTCHPNSGQTAVFFVALYMIALGTGGIKPCVSSFGADQFDENDEAEKLKKSSFFNWFYFSINVGALVAATVLVWIQMNVGWGWGFGVPTVAMVIAVVFFFLGSRYYRLQRPGGSPLTRIFQVIVAAFRKVSVKVPEDKSLLFETADDESNITGSRKLEHTDNLMFFDKAAVESHSDSIKDGEVNPWRLCSVTQVEELKSIITLLPVWASGIVFATVYSQMNTMFVLQGNTMDQHMGKNFEIPSASLSLFDTVSVLFWTPVYDQFIVPFARKFTRQERGFTQLQRMGIGLVISIFAMVTAGVLEVVRLDYVKSHNAYDDKKIPMSIFWQIPQYLLVGCAEVFTFIGQLEFFYDQAPDAMRSLCSALSLTTVALGNYLSTVLVTVVMKLTKKNGKPGWIPDNLNRGHLDYFFYLLAVLSFLNFLVYLWISKRYKYKKAIGRAH

SEQ ID NO: 8445 - DNA, 1758 bp, Brassica napus
  CDS (1)..(1758)
atgggctccattgaagaagaatcacctctcatcgaagaaggtttaatctcacaggaaccaaaactgtatgctcaagatggttcagtggaccttcatggaaacccaccgttgaaggagaagacaggcaactggaaagcttgtcctttcattttaggcaatgaatgctgcgagaggctagcttactatggtatcgctgggaatctaatcacttacctcaccactaaactccaccaaggaaacgtttcagctgctagaaacgtcaccacatggcaggggacttgttatctcacccctctcattggtgctgtcttagccgatgcttactggggcagatactggaccatcgcttgtttctccggcatttacttcatcggcatgtctgcgctaactctctcagcgtcagttccagcattgaaaccagctgaatgcattggcggtttctgtccatcagcaacaccagctcagtacgcaatgttctttggcgggctttacctcatcgccctcggcactggaggcatcaaaccatgcgtctcatccttcggtgcagaccagttcgatgacactgactcgcgcgaacgagttaagaaagcttccttcttcaactggttctacttctccatcaacattggagcgctagtctcttctagtcttcttgtctggatccaagagaaccgcggctggggtttaggttttggtataccaacagtgttcatgggactcgccattgcaagtttcttctttggcacacctctttacaggtttcagaagcctggaggcagccctatcactcgaatctctcaagtggtggtcgcctcgttccgtaaatccactctcaaagtccctgaagacgctatgcttctgtatgaaacgcaggacaagaactctgctattgctggaagtcgaaaaatcgaacataccgatgattgccagtatcttgacaaagctgctgtgatctcagaagaagaatccaaagccggagacgtttccaactcgtggagactatgtactgtcactcaagtcgaagaactcaagattctgatacgaatgttccctatctgggcttctggtatcatcttctcagctgtatacgcacaaatgtccacgatgtttgttcaacaaggccgagccatggactgcaaaataggatcgttccagcttcctcctgcagccctcgggacgtttgacacagctagtgtcatcatctgggttcctctctacgacaggttcatcgtccctttagctagacggtttactggagtagacaaaggattcactgagatacaaagaatgggggtcggtttgtttgtctctgttctctgtatggcagctgcagccgttgttgaaatcatcaggctccatttagccaacgagctcgggttggttgagtctggagctcctgttcctatatctgtgttatggcagatcccacagtacttcatcctcggtgcagcggaagtgttctacttcattgggcagctggagtttttctatgatcagtctccagatgcaatgaggagcttgtgcagtgcgttggctcttttgaccaatgcgcttgggaactacttgagttcgttgatcctcacgctggtgacttacttcacgacgaggaacggtggagaaggttggatatcagataatctgaactcgggtcatcttgattactacttctggcttttggctggtcttagccttgtgaacatggctgtttacttcttctctgcggctaggtataagcagaagaaggcgtccaagttataa

SEQ ID NO: 8446 - protein, 585 aa, Brassica napus
MGSIEEESPLIEEGLISQEPKLYAQDGSVDLHGNPPLKEKTGNWKACPFILGNECCERLAYYGIAGNLITYLTTKLHQGNVSAARNVTTWQGTCYLTPLIGAVLADAYWGRYWTIACFSGIYFIGMSALTLSASVPALKPAECIGGFCPSATPAQYAMFFGGLYLIALGTGGIKPCVSSFGADQFDDTDSRERVKKASFFNWFYFSINIGALVSSSLLVWIQENRGWGLGFGIPTVFMGLAIASFFFGTPLYRFQKPGGSPITRISQVVVASFRKSTLKVPEDAMLLYETQDKNSAIAGSRKIEHTDDCQYLDKAAVISEEESKAGDVSNSWRLCTVTQVEELKILIRMFPIWASGIIFSAVYAQMSTMFVQQGRAMDCKIGSFQLPPAALGTFDTASVIIWVPLYDRFIVPLARRFTGVDKGFTEIQRMGVGLFVSVLCMAAAAVVEIIRLHLANELGLVESGAPVPISVLWQIPQYFILGAAEVFYFIGQLEFFYDQSPDAMRSLCSALALLTNALGNYLSSLILTLVTYFTTRNGGEGWISDNLNSGHLDYYFWLLAGLSLVNMAVYFFSAARYKQKKASKL

SEQ ID NO: 8447 - DNA, 1719 bp, Glycine max
  CDS (1)..(1719)
atggcagaggatgatggttacacgaaagatggaacagtcgattactgtggaaatccagctaataaaaaggaaactggaacctggaaagcctgcccctatatcttaggaaacgaatgttgtgagagattggcttattatgggatgagcacaaacctggtgctttatttcaagaaccggctaaatcagcatagtgctactgcttccaagaatgtctctaattggagtggaacttgctatatcacaccattgattggggcatatttggctgattcctaccttggaagatattggacaattgctgttttttcaataatttatgctattggaatgacactcttgacattgtctgcatcagttcctggcataaaaccaacatgtcatggacatggagatgaaaattgtcgtgctactactctagagagtgcagtgtgcttcctagctctttaccttattgctcttggcaccggtggcattaagccttgtgtctcatcctatggagcagatcagtttgatgacactgactcggctgagaaggaacgcaagagttctttcttcaattggttctatttttcaatcaacattggcgctcttattgcatcttctctattggtttggatacaagataatgtgggttggggatggggctttggtattcctgctgtagccatggcaattgctgtggtgagtttcttttcaggcactaggttgtataggaatcagaagcctggaggcagtgccatcactagaatctgtcaggtggtaatggcatccataagaaaatacaatgttgaagtacctgctgacgagtcacttttatatgagactgctgaaactgaatctgctataaaaggaagccgaaagcttgaccacacaaatgagctaagattttttgacaaagcagcagtgctagcacagtcagataaagtgaaggaatcaacaaacccttggagactttgcactgtaactcaagtggaagagctgaaatccattttaagaatacttcctgtatgggccactggcatcatattttccactgtctatggtcaaatgagcaccttatttgtgttgcaaggacaaaccatggacactcgtgttggcaactccactttcaaaatcccaccagcttcactgtccatctttgacaccctcagtgtcatattttgggtcccagtgtatgacaggatcattgtgccaattgctacaaagttcactgggaacaaaaatggcctaactcagctccagagaatgggaattggcctcttcatatccatattttccatggtagctgcagcaatattggagctcatacggcttagaatggtgaggaggcacaactactatcaacttgaggagataccaatgacaatattttggcaggttcctcaatatttcatcataggctgtgcagaagtcttctatttcattggtcagttggagttcttctatgagcaagcccctgatgctatgcgaagcttttgttctgctctctcacttaccactgttgcgcttggacagtacttgagctctctgcttgtgacaattgtgacaaagatcagcactaggaatggaagtccagggtggatacctgataatctaaactttggtcacatagattatttcttctggctattggcattgctaagtgtagtgaacttgatagcattccttgtggtgtctatgttgtatacatataagagacctgtgggaactctgcgctga

SEQ ID NO: 8448 - protein, 572 aa, Glycine max
MAEDDGYTKDGTVDYCGNPANKKETGTWKACPYILGNECCERLAYYGMSTNLVLYFKNRLNQHSATASKNVSNWSGTCYITPLIGAYLADSYLGRYWTIAVFSIIYAIGMTLLTLSASVPGIKPTCHGHGDENCRATTLESAVCFLALYLIALGTGGIKPCVSSYGADQFDDTDSAEKERKSSFFNWFYFSINIGALIASSLLVWIQDNVGWGWGFGIPAVAMAIAVVSFFSGTRLYRNQKPGGSAITRICQVVMASIRKYNVEVPADESLLYETAETESAIKGSRKLDHTNELRFFDKAAVLAQSDKVKESTNPWRLCTVTQVEELKSILRILPVWATGIIFSTVYGQMSTLFVLQGQTMDTRVGNSTFKIPPASLSIFDTLSVIFWVPVYDRIIVPIATKFTGNKNGLTQLQRMGIGLFISIFSMVAAAILELIRLRMVRRHNYYQLEEIPMTIFWQVPQYFIIGCAEVFYFIGQLEFFYEQAPDAMRSFCSALSLTTVALGQYLSSLLVTIVTKISTRNGSPGWIPDNLNFGHIDYFFWLLALLSVVNLIAFLVVSMLYTYKRPVGTLR

SEQ ID NO: 8449 - DNA, 1761 bp, Brassica napus
  CDS (1)..(1761)
atgggttccattgaagaagaagaagcgcctctcatcgaacaaggtttaatctcacaggcaccgaaactgtatgctgaagatggttcagtagaccttcatgggaacccaccattgaaggctaaaacaggaaactggaaagcttgccctttcattctcggcaatgagtgctgcgagaggctagcttactatggcatcgccgggaacctaatcacttacctcaccaccaaactacaccaaggaaacgtctccgctgctacaaacgtcaccacatggcaaggcacttgctatctcacccctctcatcggtgctgtcttagccgatgcttactggggtcgttactggaccatcgcttgtttctccggcatttacttcatcggcatgtcggcgctaactctctcagcttcagttccagcactgaagccagcagaatgcattggcacctactgtccatcagcaacgccagctcagtacgcaatgttcttcagcgggctttacctgatcgccctcggcactggaggcatcaaaccatgcgtctcatccttcggtgcagaccagttcgacgacactgactcccgagaacgagtcagaaaagcttccttcttcaactggttttacttctccatcaacattggagcgctcgtgtcctctagtcttctagtttggatccaagagaatcgcgggtggggtttagggtttggtataccgacagtgttcatgggtctagccattgtgagtttcttctttggcacgccgctttacaggtttcagaagcctggaggcagtcccataactcgaatctcccaagtcgtggtcgcctccttccgtaaatccactctcaaagtccctgaagacgcaacacttctgtatgaaacgcaggacaagaactctgctattgctggaagtagaaaaatcgaacataccgatgattgcaagtatcttgacaaagctgctgtgatctcagaagaagaatccaaagcaggagacttttcaaactcgtggagactatgcacggtcactcaagtcgaagaactcaagattctgatacgaatgttcccaatatgggcctcagggatcatcttctcagccgtatacgcacaaatgtcaacaatgtttgttcaacaaggccgagccatggactgcaaaataggatccttccagcttcctccagcagcactagggacattcgacacagctagcgtcatcatctgggttccgctctacgacagattcatcgtccctttagctagacggttcactggagtagacaaaggattcactgagatacagagaatgggggttggtctgttcgtctctgttctctgtatggcagctgcagccattgttgagatcatcaggctccatttagccaacgagctcgggttggttgagtctggagctcctgttcccatatcggtgttatggcagatcccacagtacttcatcctcggtgcggcggaagtgttctacttcattgggcagcttgagtttttctatgatcagtctccagatgcaatgagaagcttgtgcagtgcgttggctcttttgaccaatgcgcttgggaactacttgagttcgttgatcctcacgctggtgacttactttacgacgaggaacggtggagaaggttggatatcagataatctgaactcgggtcatcttgattactacttctggcttttggctggtcttagccttgtgaacatggctgtttacttcttctctgcggctaggtataagcagaagaaggcgtccaagttataa

SEQ ID NO: 8450 - protein, 586 aa, Brassica napus
MGSIEEEEAPLIEQGLISQAPKLYAEDGSVDLHGNPPLKAKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGTYCPSATPAQYAMFFSGLYLIALGTGGIKPCVSSFGADQFDDTDSRERVRKASFFNWFYFSINIGALVSSSLLVWIQENRGWGLGFGIPTVFMGLAIVSFFFGTPLYRFQKPGGSPITRISQVVVASFRKSTLKVPEDATLLYETQDKNSAIAGSRKIEHTDDCKYLDKAAVISEEESKAGDFSNSWRLCTVTQVEELKILIRMFPIWASGIIFSAVYAQMSTMFVQQGRAMDCKIGSFQLPPAALGTFDTASVIIWVPLYDRFIVPLARRFTGVDKGFTEIQRMGVGLFVSVLCMAAAAIVEIIRLHLANELGLVESGAPVPISVLWQIPQYFILGAAEVFYFIGQLEFFYDQSPDAMRSLCSALALLTNALGNYLSSLILTLVTYFTTRNGGEGWISDNLNSGHLDYYFWLLAGLSLVNMAVYFFSAARYKQKKASKL

SEQ ID NO: 8451 - DNA, 1713 bp, Brassica napus
  CDS (1)..(1713)
atggaagaaaaggatgtgtatacggaagatggaactgtcgatattcacaaaaaccctgccaacaagaagaagaccggaaactggaaagcttgccgcttcatccttggcaatgagtgctgtgaaagattggcatactatggaatgggaactaacctcgtgaactatcttgagagtcgtctgaatcaaggcaacgctactgctgcaaacaacgtcaccaactggtccggaacatgttatataactcctttgattggtgcctttctagctgatgcttatcttggacgttactggactattgcaacctttgttttcatctatgtctccggcatgactctgttgacattatcagcctcagttcctggacttaaacccggtaactgcaacggcgacacgtgtcaccccaactctggccaaacagctgttttcttcgttgcactttacatgatcgcgcttggaacgggaggtattaagccgtgtgtttcctcctttggagctgatcagttcgatgagaatgacgaagccgagaagctgaagaaaagctctttcttcaactggttttacttctccattaacgtcggagctcttgttgccgccactgttcttgtctggatacaaatgaacgttggttggggatgggggttcgggtttccgacagtggctatggtcattgcggttgtgtttttcttcctggggagtcgttactacaggcttcaaagacctggtgggagtccactcacgaggatctttcaggttattgttgctgctttcaggaaggtgagtgttaaggttccagaggacaagtctctgctctttgaaactgcagatgatgagagtaatatcacaggtagcaggaagcttgagcacacagacaacttaatgtttttcgacaaggcagcggttgagagtcattcagatagcatcaaagacggtgaggtgaatccatggagactctgctcagtaacacaagtagaagagctcaagtccataatcactcttcttccagtatgggcctcagggatagtctttgcaacagtgtacagccaaatgaacacaatgttcgtcttacaaggaaacacaatggaccaacacatggggaaaaatttcgagatcccatcggcttccctctcgcttttcgacacggtcagtgtactcttctggactcctgtctacgaccagttcattgtcccgttcgcaagaaagttcacacgtcaagaacgaggcttcactcagcttcaacgtatgggaataggtctcgtgatctcgatctttgccatggtcactgcaggggttcttgaggtcgtgaggctcgactacgtcaaaagccacaatgcatatgatgataaaaagatccccatgtcgatcttctggcagatacctcagtatttacttattgggtgtgctgaagttttcacctttataggccagcttgagtttttctatgaccaggctcctgatgccatgaggagtctctgctctgctttgtctttgaccactgttgcgcttgggaactacttaagcacggttcttgtaacggttgtgatgaaactgactaagaagaatggtaaaccgggttggataccggataacttgaaccgggggcatcttgattactttttctacttgctggcggttctgagtttcctcaacttcttggtgtacctatggatctctaaacgctacaagtataagaaagctataggtcgggcacattga

SEQ ID NO: 8452 - protein, 570 aa, Brassica napus
MEEKDVYTEDGTVDIHKNPANKKKTGNWKACRFILGNECCERLAYYGMGTNLVNYLESRLNQGNATAANNVTNWSGTCYITPLIGAFLADAYLGRYWTIATFVFIYVSGMTLLTLSASVPGLKPGNCNGDTCHPNSGQTAVFFVALYMIALGTGGIKPCVSSFGADQFDENDEAEKLKKSSFFNWFYFSINVGALVAATVLVWIQMNVGWGWGFGFPTVAMVIAVVFFFLGSRYYRLQRPGGSPLTRIFQVIVAAFRKVSVKVPEDKSLLFETADDESNITGSRKLEHTDNLMFFDKAAVESHSDSIKDGEVNPWRLCSVTQVEELKSIITLLPVWASGIVFATVYSQMNTMFVLQGNTMDQHMGKNFEIPSASLSLFDTVSVLFWTPVYDQFIVPFARKFTRQERGFTQLQRMGIGLVISIFAMVTAGVLEVVRLDYVKSHNAYDDKKIPMSIFWQIPQYLLIGCAEVFTFIGQLEFFYDQAPDAMRSLCSALSLTTVALGNYLSTVLVTVVMKLTKKNGKPGWIPDNLNRGHLDYFFYLLAVLSFLNFLVYLWISKRYKYKKAIGRAH

SEQ ID NO: 8453 - DNA, 1713 bp, Brassica napus
  CDS (1)..(1713)
atggaagaaaaggatgtgtatacggaagatggaactgtcgatattcacaaaaaccctgccaacaagaagaagaccggaaactggaaagcttgccgcttcatccttggcaatgagtgctgtgaaagattggcatactatggaatgggaactaacctcgtgaactatcttgagagtcgtctgaatcaaggcaacgctactgctgcaaacaacgtcaccaactggtccggaacatgttatataactcctttgattggtgcctttctagctgatgcttatcttggacgttactggactattgcaacctttgttttcatctatgtctccggcatgactctgttgacattatcagcctcagttcctggacttaaacccggtaactgcaacggcgacacgtgtcaccccaactctggccaaacagctgttttcttcgttgcactttacatgatcgcgcttggaacgggaggtattaagccgtgtgtttcctcctttggagctgatcagttcgatgagaatgacgaagccgagaagctgaagaaaagctctttcttcaactggttttacttctccattaacgtcggagctcttgttgccgccactgttcttgtctggatacaaatgaacgttggttggggatgggggttcgggtttccgacagtggctatggtcattgcggttgtgtttttcttcctggggagtcgttactacaggcttcaaagacctggtgggagtccactcacgaggatctttcaggttattgttgctgctttcaggaaggtgagtgttaaggttccagaggacaagtctctgctctttgaaactgcagatgatgagagtaatatcacaggtagcaggaagcttgagcacacagacaacttaatgtttttcgacaaggcagcggttgagagtcattcagatagcatcaaagacggtgaggtgaatccatggagactctgctcagtaacacaagtagaagagctcaagtccataatcactcttcttccagtatgggcctcagggatagtctttgcaacagtgtacagccaaatgaacacaatgttcgtcttacaaggaaacacaatggaccaacacatggggaaaaatttcgagatcccatcggcttccctctcgcttttcgacacggtcagtgtactcttctggactcctgtctacgaccagtttattgtcccgttcgctagaaagttcacacgtcaagaacgtggcttcactcagcttcaacgtatgggaataggtctcgtgatctcgatctttgccatggtcactgcaggtgttttggaggtcgttaggctcgactacgtcaaaagccacaatgcatacgatgataaaaagatccccatgtcgattttctggcagatacctcagtatttacttgttgggtgtgctgaagttttcacatttataggtcagcttgagtttttctatgaccaggctcctgatgccatgaggagtctctgctctgctttgtctttgaccactgttgcgcttgggaactacttaagcacggttcttgtaacggttgtgatgaaactgactaagaagaatggtaaaccgggttggataccggataacttgaaccgggggcatcttgattactttttctacttgctggcggttctgagtttcctcaacttcttggtgtacctatggatctctaaacgctacaagtataagaaagctataggtcgggcacattga

SEQ ID NO: 8454 - protein, 570 aa, Brassica napus
MEEKDVYTEDGTVDIHKNPANKKKTGNWKACRFILGNECCERLAYYGMGTNLVNYLESRLNQGNATAANNVTNWSGTCYITPLIGAFLADAYLGRYWTIATFVFIYVSGMTLLTLSASVPGLKPGNCNGDTCHPNSGQTAVFFVALYMIALGTGGIKPCVSSFGADQFDENDEAEKLKKSSFFNWFYFSINVGALVAATVLVWIQMNVGWGWGFGFPTVAMVIAVVFFFLGSRYYRLQRPGGSPLTRIFQVIVAAFRKVSVKVPEDKSLLFETADDESNITGSRKLEHTDNLMFFDKAAVESHSDSIKDGEVNPWRLCSVTQVEELKSIITLLPVWASGIVFATVYSQMNTMFVLQGNTMDQHMGKNFEIPSASLSLFDTVSVLFWTPVYDQFIVPFARKFTRQERGFTQLQRMGIGLVISIFAMVTAGVLEVVRLDYVKSHNAYDDKKIPMSIFWQIPQYLLVGCAEVFTFIGQLEFFYDQAPDAMRSLCSALSLTTVALGNYLSTVLVTVVMKLTKKNGKPGWIPDNLNRGHLDYFFYLLAVLSFLNFLVYLWISKRYKYKKAIGRAH

SEQ ID NO: 8455 - DNA, 1743 bp, Zea mays
  CDS (1)..(1743)
atgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccgtcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacactatcagcgtcatcgtctgggtccccgtgtacgaccgcgccatcgtgcccctggtgcgctcttacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactga

SEQ ID NO: 8456 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 8457 - DNA, 1716 bp, Glycine max
  CDS (1)..(1716)
atggcagaggatgatggttacacgaaagatggaacagtcgattactgtggaaatccagctaataaaaaggaaactggaacctggaaagcctgcccctatatcttaggaaacgaatgttgtgagagattggcttattatgggatgagcacaaacctggtgctttatttcaagaaccggctaaatcagcatagtgctactgcttccaagaatgtctctaattggagtggaacttgctatatcacaccattgattggggcatatttggctgattcctaccttggaagatattggacaattgctgttttttcaataatttatgctattggaatgacactcttgacattgtctgcatcagttcctggcataaaaccaacatgtcatggacatggagatgaaaattgtcgtgctactactctagagagtgcagtgtgcttcctagctctttaccttattgctcttggcaccggtggcattaagccttgtgtctcatcctatggagcagatcagtttgatgacactgactcggctgagaaggaacgcagttctttcttcaattggttctatttttcaatcaacattggcgctcttattgcatcttctctattggtttggatacaagataatgtgggttggggatggggctttggtattcctgctgtagccatggcaattgctgtggtgagtttcttttcaggcactaggttgtataggaatcagaagcctggaggcagtgccatcactagaatctgtcaggtggtaatggcatccataagaaaatacaatgttgaagtacctgctgacgagtcacttttatatgagactgctgaaactgaatctgctataaaaggaagccgaaagcttgaccacacaaatgagctaagattttttgacaaagcaacagtgctagcacagtcagataaagtgaaggaatcaacaaacccttggagactttgcactgtaactcaagtggaagagctgaaatccattttaagaatacttcctgtatgggcaaccggcatcatattttccactgtctatggtcaaatgagcaccttatttgtgttgcaaggacaaaccatggacactcgtgttggcaactccactttcaaaatcccaccagcttcactgtccatctttgacaccctcagtgtcatattttgggtcccagtgtatgacaggatcattgtgccaattgctacaaagttcactgggaacaaaaatggcctaactcagctccagagaatgggaattggcctcttcatatccatattttccatggtagctgcagcaatattggagctcatacggcttagaatggtgaggaggcacaactactatcaacttgaggagataccaatgacaatattttggcaggttcctcaatatttcatcataggctgtgcagaagtcttctatttcattggtcagttggagttcttctatgagcaagcccctgatgctatgcgaagcttttgttctgctctctcacttaccactgttgcgcttggacagtacttgagctctctgcttgtgacaattgtgacaaagatcagcactaggaatggaagtccagggtggatacctgataatctaaactttggtcacatagattatttcttctggctattggcattgctaagtgtagtgaacttgatagcattccttgtggtgtctatgttgtatacatataagagacctgtgggaactctgcgctga

SEQ ID NO: 8458 - protein, 571 aa, Glycine max
MAEDDGYTKDGTVDYCGNPANKKETGTWKACPYILGNECCERLAYYGMSTNLVLYFKNRLNQHSATASKNVSNWSGTCYITPLIGAYLADSYLGRYWTIAVFSIIYAIGMTLLTLSASVPGIKPTCHGHGDENCRATTLESAVCFLALYLIALGTGGIKPCVSSYGADQFDDTDSAEKERSSFFNWFYFSINIGALIASSLLVWIQDNVGWGWGFGIPAVAMAIAVVSFFSGTRLYRNQKPGGSAITRICQVVMASIRKYNVEVPADESLLYETAETESAIKGSRKLDHTNELRFFDKATVLAQSDKVKESTNPWRLCTVTQVEELKSILRILPVWATGIIFSTVYGQMSTLFVLQGQTMDTRVGNSTFKIPPASLSIFDTLSVIFWVPVYDRIIVPIATKFTGNKNGLTQLQRMGIGLFISIFSMVAAAILELIRLRMVRRHNYYQLEEIPMTIFWQVPQYFIIGCAEVFYFIGQLEFFYEQAPDAMRSFCSALSLTTVALGQYLSSLLVTIVTKISTRNGSPGWIPDNLNFGHIDYFFWLLALLSVVNLIAFLVVSMLYTYKRPVGTLR

SEQ ID NO: 8459 - DNA, 1743 bp, Zea mays
  CDS (1)..(1743)
atgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactga

SEQ ID NO: 8460 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 8461 - DNA, 1743 bp, Zea mays
  CDS (1)..(1743)
atgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcgtcatcggtgaaggggctggtgcctacgtcgtgcggcgacaaggacgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggagacgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgcagtgctcagcctcctcaacttccttgcctacctcgtcatcgccagctggtacaagtacaagaagacggccgatgattaccctggcgccaaaggggagcacggtacagagcactga

SEQ ID NO: 8462 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAETSPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 8463 - DNA, 22 bp, Artificial sequence
  primer
atgctcaaccatcccagccaag

SEQ ID NO: 8464 - DNA, 25 bp, Artificial sequence
  primer
ctaatatttggtggtggatcttaga

SEQ ID NO: 8465 - protein, 595 aa, Artificial sequence
  consensus sequence
  Variant (2)..(3): Xaa in position 2 to 3 is any amino acid
  Variant (6)..(9): Xaa in position 6 to 9 is any amino acid
  Variant (11)..(44): Xaa in position 11 to 44 is any amino acid
  Variant (45)..(68): Xaa in position 45 to 68 is any or no amino acid
  Variant (70)..(71): Xaa in position 70 to 71 is any amino acid
  Variant (73)..(75): Xaa in position 73 to 75 is any amino acid
  Variant (78)..(80): Xaa in position 78 to 80 is any amino acid
  Variant (82)..(84): Xaa in position 82 to 84 is any amino acid
  Variant (87)..(95): Xaa in position 87 to 95 is any amino acid
  Variant (97)..(99): Xaa in position 97 to 99 is any amino acid
  Variant (101)..(119): Xaa in position 101 to 119 is any amino acid
  Variant (120)..(144): Xaa in position 120 to 144 is any or no amino acid
  Variant (146)..(146): Xaa in position 146 is any amino acid
  Variant (148)..(149): Xaa in position 148 to 149 is any amino acid
  Variant (151)..(157): Xaa in position 151 to 157 is any amino acid
  Variant (158)..(171): Xaa in position 158 to 171 is any or no amino acid
  Variant (173)..(188): Xaa in position 173 to 188 is any amino acid
  Variant (189)..(206): Xaa in position 189 to 206 is any or no amino acid
  Variant (208)..(227): Xaa in position 208 to 227 is any amino acid
  Variant (228)..(246): Xaa in position 228 to 246 is any or no amino acid
  Variant (248)..(339): Xaa in position 248 to 339 is any amino acid
  Variant (340)..(398): Xaa in position 340 to 398 is any or no amino acid
  Variant (400)..(402): Xaa in position 400 to 402 is any amino acid
  Variant (404)..(424): Xaa in position 404 to 424 is any amino acid
  Variant (425)..(433): Xaa in position 425 to 433 is any or no amino acid
  Variant (435)..(441): Xaa in position 435 to 441 is any amino acid
  Variant (443)..(444): Xaa in position 443 to 444 is any amino acid
  Variant (446)..(450): Xaa in position 446 to 450 is any amino acid
  Variant (451)..(458): Xaa in position 451 to 458 is any or no amino acid
  Variant (460)..(462): Xaa in position 460 to 462 is any amino acid
  Variant (464)..(495): Xaa in position 464 to 495 is any amino acid
  Variant (496)..(529): Xaa in position 496 to 529 is any or no amino acid
  Variant (531)..(536): Xaa in position 531 to 536 is any amino acid
  Variant (538)..(538): Xaa in position 538 is any amino acid
  Variant (540)..(545): Xaa in position 540 to 545 is any amino acid
  Variant (547)..(552): Xaa in position 547 to 552 is any amino acid
  Variant (554)..(555): Xaa in position 554 to 555 is any amino acid
  Variant (557)..(581): Xaa in position 557 to 581 is any amino acid
  Variant (582)..(594): Xaa in position 582 to 594 is any or no amino acid
EXXERXXXXGXXXXXXXXXXXXXXXXXXXXXXXXXXXXXXXXXXXXXXXXXXXXXXXXXXXXXXXXXXPXXGXXXADXXXGXXXTIXXXXXXXXXGXXXLXXXXXXXXXXXXXXXXXXXXXXXXXXXXXXXXXXXXXXXXXXXXGXGXXKXXXXXXXXXXXXXXXXXXXXXQXXXXXXXXXXXXXXXXXXXXXXXXXXXXXXXXXXYXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXMXXXXXXXXXXXXXXXXXXXXXXXXXXXXXXPXXXXXXXPXXRXXXXXXXXXXXXXRXXXGXXXXXXXXXXXXXXXXXXXXXXXXXXXXXXXXXXXXXXXXXXXXXXXXXXXXXXXXXXXXXXXXXXYXXXXXXEXFXXXXXXEXXXXXXPXXMXXXXXXXXXXXXXXXXXXXXXXXXXXXXXXXXXXXXXXW

SEQ ID NO: 8466 - protein, 42 aa, Artificial sequence
  protein pattern
  Variant (2)..(4): Xaa in position 2 to 4 is any amino acid
  Variant (5)..(5): Xaa in position 5 is Ala, Gly, Ser or Thr
  Variant (6)..(6): Xaa in position 6 is any amino acid
  Variant (7)..(7): Xaa in position 7 is Ala, Gly or Ser
  Variant (9)..(9): Xaa in position 9 is any amino acid
  Variant (10)..(10): Xaa in position 10 is Phe or Leu
  Variant (11)..(13): Xaa in position 11 to 13 is any amino acid
  Variant (14)..(14): Xaa in position 14 is Ala, Gly, Pro, Ser or Thr
  Variant (15)..(16): Xaa in position 15 to 16 is any amino acid
  Variant (17)..(17): Xaa in position 17 is Glu or Gly
  Variant (18)..(19): Xaa in position 18 to 19 is any amino acid
  Variant (20)..(20): Xaa in position 20 is Phe or Tyr
  Variant (21)..(23): Xaa in position 21 to 23 is any amino acid
  Variant (25)..(26): Xaa in position 25 to 26 is any amino acid
  Variant (27)..(27): Xaa in position 27 is Leu or Met
  Variant (28)..(28): Xaa in position 28 is any amino acid
  Variant (29)..(29): Xaa in position 29 is Ala, Gly, Ser, Thr or Val
  Variant (30)..(32): Xaa in position 30 to 32 is any amino acid
  Variant (33)..(33): Xaa in position 33 is Ala, Gly or Ser
  Variant (34)..(39): Xaa in position 34 to 39 is any amino acid
  Variant (40)..(40): Xaa in position 40 is Ala, Gly, Ser or Thr
  Variant (41)..(41): Xaa in position 41 is any amino acid
  Variant (42)..(42): Xaa in position 42 is Ala, Gly or Ser
YXXXXXXEXXXXXXXXXXXXXXXPXXXXXXXXXXXXXXXXXX

SEQ ID NO: 8467 - protein, 15 aa, Artificial sequence
  protein pattern
  Variant (2)..(2): Xaa in position 2 is Ala or Gly
  Variant (3)..(3): Xaa in position 3 is any amino acid
  Variant (4)..(4): Xaa in position 4 is Phe, Ile, Leu or Val
  Variant (5)..(5): Xaa in position 5 is Ala, Gly or Ser
  Variant (6)..(6): Xaa in position 6 is Asp or Glu
  Variant (7)..(7): Xaa in position 7 is Ala, Glu, Gln, Ser or Thr
  Variant (8)..(9): Xaa in position 8 to 9 is any amino acid
  Variant (11)..(11): Xaa in position 11 is Lys or Arg
  Variant (12)..(13): Xaa in position 12 to 13 is any amino acid
  Variant (15)..(15): Xaa in position 15 is Phe, Ile, Leu or Val
GXXXXXXXXGXXXTX

SEQ ID NO: 8468 - DNA, 2436 bp, Saccharomyces cerevisiae
  CDS (1)..(2436)
atgtcgaatataagtaccaaagatatacgaaaaagtaagccaaaaagaggatccggcttcgatttacttgaagtgactgaatcacttggctatcagacacacaggaaaaatggaagaaattcatggtcaaaggacgacgataatatgctacgatcgctagtaaacgaatccgcaaaggagttaggctatgagaatggacttgaagacgtaaaaacaattcaacaatccaaccatctttctaaatgtattgcttgggatgttttagctacacgattcaaacacaccgtaagaacttcaaaggatgtaagaaagcgttggacaggatctctggacccaaacttgaagaaaggtaaatggacacaagaagaggatgagcagctcttgaaagcttatgaagaacatgggcctcactggctgagtatctccatggatatccctggaagaacagaggatcaatgtgcgaaaaggtacattgaagtgttgggacctggaagtaaaggtagattaagagaatggacgctcgaggaagatttaaatctgataagtaaagtgaaggcatacggcacgaaatggagaaagatttcgtcggaaatggaattcagaccaagtttaacgtgcaggaacagatggcggaaaattattactatggttgtgcgaggacaagcatcagaagtaataacaaaggctataaaagaaaacaagaacatagacatgacagacggaaaactccgacaacatccaatcgccgattctgatatacgctcagattctacaccgaataaagaagaacagttgcagctatctcaacagaacaacccttcattgataaagcaggatatattgaatgttaaagagaacgaatcgagcaaactaccaagattaaaggataatgatggacccattttaaatgacagcaagccacaagcattacctcccttaaaagagatatctgcacctccaccaatcaggatgacgcaagtcggtcagactcataccagtggtagcattaggagcaaagtatctttaccaattgaaggtctttctcaaatgaacaagcaaagtcctggaggaatctcagatagcccacagacaagccttcccccagcattcaatccagcatctctcgatgagcatatgatgaatagtaatagtatttcagattctccgaagcatgcttattctactgtgaaaactagagaaccaaattcctctagcacacaatggaaatttacattaaaagatggtcaaggtttgtcaatttctaacggaactattgacagcacaaaattagtaaaagaattggttgaccaagctaagaagtactctttaaaaatttcgatacatcaacatattcacaatcattatgttacatccacagaccatcctgtcagcagcaatactggattgtcaaatataggaaatataaatggaaaccctctattaatggatagtttcccacatatgggtagacaactgggaaatggtcttccagggttaaattcaaatagtgacacttttaacccagaatataggacttctctggacaacatggatagcgattttttatcaagaacacccaactataacgcattcagcttggaagcaacttcacacaatcccgctgacaatgcaaatgaacttggttcacaaagcaatagagaaacaaacagcccgtctgtattttatcctcaagcaaatacattgatcccaactaattctaccgctacaaataatgaaatcattcaaggaaacgttagtgctaatagtatgtcaccgaatttcaatggaacaaatggcaaggcaccaagttcgacggcatcatatacaacgagcggttcagaaatgccacctgatgtaggtcctaatagaatagcgcatttcaactatttgccaccaactatacggcctcatttaggctcatcagatgcgacaagaggtgctgacttgaataagttactcaatccatctccaaattcagtaagaagtaacggcagtaaaactaagaaaaaagaaaaaagaaaaagtgaatcatctcagcatcattcttcatcatctgtgacaaccaataaattcaatcacattgatcagtcggagatatcaaggactacatccagatctgatactccattgagagatgaagacggcctggatttttgggaaacgttaagatccttggctactacgaatccaaatcctccagttgaaaagtcagctgaaaatgatggtgccaagcctcaagtggtacatcaagggattggctcacatacagaagatagcagcctaggttcccatagcggaggatacgatttttttaacgaactgttggataaaaaggcagatacactgcataatgaggctaagaagacgagcgagcatgatatgacgtcaggaggttctaccgataatgggtcagtcctgccactgaatcctagttga

SEQ ID NO: 8469 - protein, 811 aa, Saccharomyces cerevisiae
MSNISTKDIRKSKPKRGSGFDLLEVTESLGYQTHRKNGRNSWSKDDDNMLRSLVNESAKELGYENGLEDVKTIQQSNHLSKCIAWDVLATRFKHTVRTSKDVRKRWTGSLDPNLKKGKWTQEEDEQLLKAYEEHGPHWLSISMDIPGRTEDQCAKRYIEVLGPGSKGRLREWTLEEDLNLISKVKAYGTKWRKISSEMEFRPSLTCRNRWRKIITMVVRGQASEVITKAIKENKNIDMTDGKLRQHPIADSDIRSDSTPNKEEQLQLSQQNNPSLIKQDILNVKENESSKLPRLKDNDGPILNDSKPQALPPLKEISAPPPIRMTQVGQTHTSGSIRSKVSLPIEGLSQMNKQSPGGISDSPQTSLPPAFNPASLDEHMMNSNSISDSPKHAYSTVKTREPNSSSTQWKFTLKDGQGLSISNGTIDSTKLVKELVDQAKKYSLKISIHQHIHNHYVTSTDHPVSSNTGLSNIGNINGNPLLMDSFPHMGRQLGNGLPGLNSNSDTFNPEYRTSLDNMDSDFLSRTPNYNAFSLEATSHNPADNANELGSQSNRETNSPSVFYPQANTLIPTNSTATNNEIIQGNVSANSMSPNFNGTNGKAPSSTASYTTSGSEMPPDVGPNRIAHFNYLPPTIRPHLGSSDATRGADLNKLLNPSPNSVRSNGSKTKKKEKRKSESSQHHSSSSVTTNKFNHIDQSEISRTTSRSDTPLRDEDGLDFWETLRSLATTNPNPPVEKSAENDGAKPQVVHQGIGSHTEDSSLGSHSGGYDFFNELLDKKADTLHNEAKKTSEHDMTSGGSTDNGSVLPLNPS

SEQ ID NO: 8470 - DNA, 2322 bp, Candida glabrata CBS 138
  CDS (1)..(2322)
atggcagcctctgttaaaggaaataaggaatctgtaaaaaagaatgaaaattttgatcttctctctattactgagtctttaggttataagactaatagaaaagctagtaaaaactattggagcaaagaagaagatcagaaactagctgacttagtgaacgatgagctgctagggatgggtttggtgaatggtattaaggatctgaaaaccatacatgactcaatgaattattccagacagatcaagtgggaaaaactcatacacgcttttaaagataaagatagaaccccaaagctgttacgaaaaagatggattagtgctctggatccaaatatcaaaagagggaaatggacaccggaagaggaccagaagcttatttccgcttatgaaaaacatggacctaaatggcttgacatctcatcagaaatattaggtagaacagaagatcaatgttctaagagatacgtagaggttttaggaccgagcagcaaggaaagactacgtgaatggacattagacgaagaattgagtttaataagtaaggtcaagaagtatggaacaaaatggagaacaatatcttcagagatggaaagtagaccaagtttgacatgtcgtaatcgttggcgtagaattataactatggtggtaagaggcctggcacctgaagagattatgaaagcagtaaaagaagataaaaatatagattttggtatcggacagttcaagaaatacaaaagaaggtcaaaattaaaagaaaatgggaactctagtaatagcacgtctcaaattagtttacttacggaaacaacgagcgatacaatgagttatgctagtttgacctcgccttcccaagatttcagcagtagtaatgctaaggatattggaatagaggtggctactgaaatgaagaatgaagataacaaattcaaccagaaacagagatcaaatactaattctatcagctcacaggacaatgtaagggaaggtcttgaaactagggcattaagcttattcgaaatgaagcaatcaaaaaggccttacaaaagtgcttctcctgtacaagttgcaagtcacttgaagacaagtaatgtcatgaaaacagcaatgaaatcgccaagtagtttaacatccccaggatcagtattagcagattccagatgtgatacaccttcccttgagcaacaatttgctgaaacaaccatagatgatcaaagcaaacctaagattacaacacatcaatggaaatttaccctaaaggatagtcaggattattcaatttccaatggaagtatcagtaactcccagcttgttaaagaactggtcgagcaggctaaaaagcataacttgaaaatttcaattcatcagcatatacataatcattacggtagtccagctgccaagcaatcatctcaggtaaatttgaatgattccatttcaaggagccagtctgtgaaaccagtagcagatgcattagctcagcatctagaagtttccaacgatttatctgtatttgaaactccaaatgattatgggcatgtatttaatgtatctgataatgcctttatggcaacctccccaaattacaacccctttggattagatgcggacacgccggtttcgaacgattattacagtaagccatcgaatgaagctaatatgtcaccagaccagagaggttcgcaaatatcaaatgagcatggacatacaggcacttcaagttcagctggttcgttcagcacccccggcagcgaattaccagaaggtggtccgaaccggatgacacactttacatacttgccttctacaatgaaaccacaattagaatcttcgggatctactagatcaactaatcttcagtacctattaggtgagaacggtcataaacataaaaagcgtaagcgtagaacaagcagacagcatgaagttgatagtgagagagcactggatgaggagaataaaagaattaaattggaatatgaaaaaaccagcgatgattctaaacaaacaacagttaatggccaatcaaattacaacaatttctatagtcttgaagaagacgaagaagatttttgggagtcattgaggtcccttgcagataatccagcatctcctggaaagcaagatatgtctcagtcctacgtatctgctggcaaagacaacaccttaaatgcagtatcacaaactggtcaccacctacatggacgtggattagctgaaatcaataccctagatagtttcttagggaatgaggatgatgaaggtatatcgatgggcggctctgaagatggagaggcattttttcttcctcttaacccaagttag

SEQ ID NO: 8471 - protein, 773 aa, Candida glabrata CBS 138
MAASVKGNKESVKKNENFDLLSITESLGYKTNRKASKNYWSKEEDQKLADLVNDELLGMGLVNGIKDLKTIHDSMNYSRQIKWEKLIHAFKDKDRTPKLLRKRWISALDPNIKRGKWTPEEDQKLISAYEKHGPKWLDISSEILGRTEDQCSKRYVEVLGPSSKERLREWTLDEELSLISKVKKYGTKWRTISSEMESRPSLTCRNRWRRIITMVVRGLAPEEIMKAVKEDKNIDFGIGQFKKYKRRSKLKENGNSSNSTSQISLLTETTSDTMSYASLTSPSQDFSSSNAKDIGIEVATEMKNEDNKFNQKQRSNTNSISSQDNVREGLETRALSLFEMKQSKRPYKSASPVQVASHLKTSNVMKTAMKSPSSLTSPGSVLADSRCDTPSLEQQFAETTIDDQSKPKITTHQWKFTLKDSQDYSISNGSISNSQLVKELVEQAKKHNLKISIHQHIHNHYGSPAAKQSSQVNLNDSISRSQSVKPVADALAQHLEVSNDLSVFETPNDYGHVFNVSDNAFMATSPNYNPFGLDADTPVSNDYYSKPSNEANMSPDQRGSQISNEHGHTGTSSSAGSFSTPGSELPEGGPNRMTHFTYLPSTMKPQLESSGSTRSTNLQYLLGENGHKHKKRKRRTSRQHEVDSERALDEENKRIKLEYEKTSDDSKQTTVNGQSNYNNFYSLEEDEEDFWESLRSLADNPASPGKQDMSQSYVSAGKDNTLNAVSQTGHHLHGRGLAEINTLDSFLGNEDDEGISMGGSEDGEAFFLPLNPS

SEQ ID NO: 8472 - DNA, 2310 bp, Kluyveromyces lactis NRRL Y-1140
  CDS (1)..(2310)
atgaatgaatcgtcgagtgagaaaggaactgtagctagcagtgtgagtgacgattcgggtgatatgtcagaggagcatatgagcaatttgaggaagagagttaagaaggaaccagtcaatgctcttgaggtttcagaatctttagggtatcaaacgtttagaagaaagatgaggaaaatatggaccaaagaagaagatgatctgcttagaaaattggttaacgaatcgttagtaaatttgggatatccggatggtatcaaatctattaaaacaattcagcaatctagtaatgttgtcaaaaaaattccctgggatcagcttgccaagcaattcgaattggataataagaaagcgacggatgtgaaaaagagatggactagttctttagatcctgtattgaagaaaggtaaatggacaccagaggaggatgagcttctcttaaaatcatatgaacaccatggtccgcaatggtttaagatttcctacgttttagagaatagaactgaagaccaatgcgcgaagaggtacatcgaagtgcttgatcccagtactaaagaccgactacgaccttgggatgagacggaagatcttctacttatagcgaaggtcaagaaatatggtacgaaatggaggcaaatatcgacggaaatggatgctaggccaagtttaacctgtagaaatcgttggaggaaaattatcactatggttgttagaggcgttgcatctgaaaccataaaaagcgctgtacaagctggaaacatggatgcaggtaacgagatgaccagattaggtgaagaaaacgaaaaggaaaacaagactgatgatgacgaagatgtttcacgtcctatgtcaacttcaaatacgccacaaccttcaatgaagagcccgagtggtactgtaaagagagaagaatcgacacctatgatatttgacatgactaacagaactaattctagtgcggcattgttggatgtcttgaaaactggaaaaatcaatgcgaatgatggacaacaaccacaccaatctaacgaaagatcgacagccaccccagatccagctgttttaaatagcataatatcgccttcaccgcattacaactctccacatccttctatttttgttggcagcatcaacaaaaaagaatctgcattaccatcacctagcacatttcttccaatacccaatgtcgaaactaggaaacaacaaccagaaacaacagttgactggaaatttagtctgaaggaatcttcaggtcataccttatccaacggtgttatatcaaacgctgacttggtaaaacagttaataaatcatgccaaggccaatgatttgaaaatatcaattcaccagcatattcacaaccattatctggctcccagacaaatatctccacctccgttaatgttaccacagcaacaacaaaataaacacattggtaatactacttcaaattcacaagatcttccaaaaattagaagcccgtccttctctgacttcgaaactgattttctatccaaaactccaaacttcaacaattggggattggacgatgaaactcaaagtccatcggctctcaacgataaactacaacgattttatcatcatcatcaccatcatcatcatgattcgctagatgaagctcaagagcagaacataaaacaacagcatttaatgaacggggctaattatgcacaaaacggcttaagccagttgccaccaaatcctacaagttccactgcatcttatccatcgcctacagctccagaaatcagagaaatagggccaagtaggcactcacatttcaattatttaccacccacggtcaagccacagcttggatccagtgaaaacgccaagacagttgaattaagccgattgttaaatccaagtccgaatggacttcatggacataagaggaaacaaacaaagagaagaggtaaaaatgaatccagaaactctagtgctgcaggatcgacaggaaatacaccagctgaagattttgatcgcaatggacccaagaataaagtaaccccaagcaccgtgtcctcaatatcaattatggaagaagatggtaatgatttctgggagaatctacgctcactgggaggtaacattggcagtgatggaaaaagctcagaacggaagtctcctagtatttcacacataaatgatctctttcaaaatacagaaaatgctgctgatacaccaactggctacgatgccatctttaaattttgcgagcagaagcaaatggacgacaagcaatcaaccgaagaagttgtagctgaattcgccatcaatccaagctga

SEQ ID NO: 8473 - protein, 769 aa, Kluyveromyces lactis NRRL Y-1140
MNESSSEKGTVASSVSDDSGDMSEEHMSNLRKRVKKEPVNALEVSESLGYQTFRRKMRKIWTKEEDDLLRKLVNESLVNLGYPDGIKSIKTIQQSSNVVKKIPWDQLAKQFELDNKKATDVKKRWTSSLDPVLKKGKWTPEEDELLLKSYEHHGPQWFKISYVLENRTEDQCAKRYIEVLDPSTKDRLRPWDETEDLLLIAKVKKYGTKWRQISTEMDARPSLTCRNRWRKIITMVVRGVASETIKSAVQAGNMDAGNEMTRLGEENEKENKTDDDEDVSRPMSTSNTPQPSMKSPSGTVKREESTPMIFDMTNRTNSSAALLDVLKTGKINANDGQQPHQSNERSTATPDPAVLNSIISPSPHYNSPHPSIFVGSINKKESALPSPSTFLPIPNVETRKQQPETTVDWKFSLKESSGHTLSNGVISNADLVKQLINHAKANDLKISIHQHIHNHYLAPRQISPPPLMLPQQQQNKHIGNTTSNSQDLPKIRSPSFSDFETDFLSKTPNFNNWGLDDETQSPSALNDKLQRFYHHHHHHHHDSLDEAQEQNIKQQHLMNGANYAQNGLSQLPPNPTSSTASYPSPTAPEIREIGPSRHSHFNYLPPTVKPQLGSSENAKTVELSRLLNPSPNGLHGHKRKQTKRRGKNESRNSSAAGSTGNTPAEDFDRNGPKNKVTPSTVSSISIMEEDGNDFWENLRSLGGNIGSDGKSSERKSPSISHINDLFQNTENAADTPTGYDAIFKFCEQKQMDDKQSTEEVVAEFAINPS

SEQ ID NO: 8474 - DNA, 27 bp, Artificial sequence
  primer
atgtcgaatataagtaccaaagatata

SEQ ID NO: 8475 - DNA, 23 bp, Artificial sequence
  primer
tcaactaggattcagtggcagga

SEQ ID NO: 8476 - protein, 801 aa, Artificial sequence
  consensus sequence
  Variant (2)..(4): Xaa in position 2 to 4 is any amino acid
  Variant (10)..(10): Xaa in position 10 is any amino acid
  Variant (12)..(12): Xaa in position 12 is any amino acid
  Variant (14)..(19): Xaa in position 14 to 19 is any amino acid
  Variant (21)..(21): Xaa in position 21 is any amino acid
  Variant (23)..(24): Xaa in position 23 to 24 is any amino acid
  Variant (26)..(27): Xaa in position 26 to 27 is any amino acid
  Variant (29)..(30): Xaa in position 29 to 30 is any amino acid
  Variant (34)..(39): Xaa in position 34 to 39 is any amino acid
  Variant (41)..(43): Xaa in position 41 to 43 is any amino acid
  Variant (45)..(48): Xaa in position 45 to 48 is any amino acid
  Variant (52)..(53): Xaa in position 52 to 53 is any amino acid
  Variant (55)..(60): Xaa in position 55 to 60 is any amino acid
  Variant (62)..(62): Xaa in position 62 is any amino acid
  Variant (64)..(65): Xaa in position 64 to 65 is any amino acid
  Variant (67)..(69): Xaa in position 67 to 69 is any amino acid
  Variant (71)..(81): Xaa in position 71 to 81 is any amino acid
  Variant (85)..(87): Xaa in position 85 to 87 is any amino acid
  Variant (91)..(92): Xaa in position 91 to 92 is any amino acid
  Variant (94)..(94): Xaa in position 94 is any amino acid
  Variant (99)..(99): Xaa in position 99 is any amino acid
  Variant (103)..(104): Xaa in position 103 to 104 is any amino acid
  Variant (106)..(108): Xaa in position 106 to 108 is any amino acid
  Variant (111)..(111): Xaa in position 111 is any amino acid
  Variant (115)..(115): Xaa in position 115 is any amino acid
  Variant (117)..(118): Xaa in position 117 to 118 is any amino acid
  Variant (121)..(125): Xaa in position 121 to 125 is any amino acid
  Variant (132)..(132): Xaa in position 132 is any amino acid
  Variant (136)..(136): Xaa in position 136 is any amino acid
  Variant (140)..(140): Xaa in position 140 is any amino acid
  Variant (142)..(143): Xaa in position 142 to 143 is any amino acid
  Variant (145)..(145): Xaa in position 145 is any amino acid
  Variant (149)..(149): Xaa in position 149 is any amino acid
  Variant (151)..(153): Xaa in position 151 to 153 is any amino acid
  Variant (155)..(155): Xaa in position 155 is any amino acid
  Variant (157)..(157): Xaa in position 157 is any amino acid
  Variant (160)..(160): Xaa in position 160 is any amino acid
  Variant (164)..(164): Xaa in position 164 is any amino acid
  Variant (171)..(171): Xaa in position 171 is any amino acid
  Variant (174)..(174): Xaa in position 174 is any amino acid
  Variant (177)..(178): Xaa in position 177 to 178 is any amino acid
  Variant (190)..(190): Xaa in position 190 is any amino acid
  Variant (199)..(199): Xaa in position 199 is any amino acid
  Variant (201)..(201): Xaa in position 201 is any amino acid
  Variant (203)..(203): Xaa in position 203 is any amino acid
  Variant (205)..(206): Xaa in position 205 to 206 is any amino acid
  Variant (208)..(211): Xaa in position 208 to 211 is any amino acid
  Variant (212)..(212): Xaa in position 212 is any or no amino acid
  Variant (214)..(214): Xaa in position 214 is any amino acid
  Variant (216)..(305): Xaa in position 216 to 305 is any amino acid
  Variant (306)..(330): Xaa in position 306 to 330 is any or no amino acid
  Variant (332)..(341): Xaa in position 332 to 341 is any amino acid
  Variant (343)..(370): Xaa in position 343 to 370 is any amino acid
  Variant (372)..(390): Xaa in position 372 to 390 is any amino acid
  Variant (391)..(393): Xaa in position 391 to 393 is any or no amino acid
  Variant (397)..(397): Xaa in position 397 is any amino acid
  Variant (400)..(406): Xaa in position 400 to 406 is any amino acid
  Variant (410)..(410): Xaa in position 410 is any amino acid
  Variant (412)..(415): Xaa in position 412 to 415 is any amino acid
  Variant (419)..(419): Xaa in position 419 is any amino acid
  Variant (421)..(423): Xaa in position 421 to 423 is any amino acid
  Variant (426)..(428): Xaa in position 426 to 428 is any amino acid
  Variant (442)..(472): Xaa in position 442 to 472 is any amino acid
  Variant (473)..(481): Xaa in position 473 to 481 is any or no amino acid
  Variant (483)..(496): Xaa in position 483 to 496 is any amino acid
  Variant (497)..(506): Xaa in position 497 to 506 is any or no amino acid
  Variant (508)..(511): Xaa in position 508 to 511 is any amino acid
  Variant (514)..(514): Xaa in position 514 is any amino acid
  Variant (516)..(518): Xaa in position 516 to 518 is any amino acid
  Variant (520)..(558): Xaa in position 520 to 558 is any amino acid
  Variant (559)..(588): Xaa in position 559 to 588 is any or no amino acid
  Variant (591)..(592): Xaa in position 591 to 592 is any amino acid
  Variant (594)..(604): Xaa in position 594 to 604 is any amino acid
  Variant (605)..(605): Xaa in position 605 is any or no amino acid
  Variant (608)..(608): Xaa in position 608 is any amino acid
  Variant (610)..(611): Xaa in position 610 to 611 is any amino acid
  Variant (614)..(614): Xaa in position 614 is any amino acid
  Variant (618)..(618): Xaa in position 618 is any amino acid
  Variant (620)..(621): Xaa in position 620 to 621 is any amino acid
  Variant (623)..(623): Xaa in position 623 is any amino acid
  Variant (625)..(625): Xaa in position 625 is any amino acid
  Variant (628)..(634): Xaa in position 628 to 634 is any amino acid
  Variant (636)..(637): Xaa in position 636 to 637 is any amino acid
  Variant (640)..(690): Xaa in position 640 to 690 is any amino acid
  Variant (691)..(691): Xaa in position 691 is any or no amino acid
  Variant (693)..(698): Xaa in position 693 to 698 is any amino acid
  Variant (699)..(701): Xaa in position 699 to 701 is any or no amino acid
  Variant (704)..(705): Xaa in position 704 to 705 is any amino acid
  Variant (710)..(710): Xaa in position 710 is any amino acid
  Variant (715)..(724): Xaa in position 715 to 724 is any amino acid
  Variant (725)..(742): Xaa in position 725 to 742 is any or no amino acid
  Variant (744)..(786): Xaa in position 744 to 786 is any amino acid
  Variant (787)..(787): Xaa in position 787 is any or no amino acid
  Variant (789)..(797): Xaa in position 789 to 797 is any amino acid
  Variant (798)..(798): Xaa in position 798 is any or no amino acid
LXXXESLGYXTXRXXXXXXWXKXXDXXLXXLVNXXXXXXGXXXGXXXXKTIXXSXXXXXXIXWXXLXXXFXXXXXXXXXXXKRWXXXLDPXXKXGKWTXEEDXXLXXXYEXHGPXWXXISXXXXXRTEDQCXKRYXEVLXPXXKXRLRXWXXXEXLXLIXKVKXYGTKWRXISXEMXXRPSLTCRNRWRXIITMVVRGXAXEXIXXAXXXXXNXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXSXXXXXXXXXXXXXXXXXXXXXXXXXXXXSXXXXXXXXXXXXXXXXXXXXXXWKFXLKXXXXXXXSNGXIXXXXLVKXLXXXAKXXXLKISIHQHIHNHYXXXXXXXXXXXXXXXXXXXXXXXXXXXXXXXXXXXXXXXXLXXXXXXXXXXXXXXXXXXXXXXXXFXXXXPNXNXXXLXXXXXXXXXXXXXXXXXXXXXXXXXXXXXXXXXXXXXXXXXXXXXXXXXXXXXXXXXXXXXXXXXXXXXSSXXSXXXXXXXXXXXXGPXRXXHFXYLPXTXXPXLXSSXXXXXXXLXXLLXXXXXXXXXXXXXXXXXXXXXXXXXXXXXXXXXXXXXXXXXXXXXXXXXXXXSXXXXXXXXXEDXXDFWEXLRSLXXXXXXXXXXXXXXXXXXXXXXXXXXXXSXXXXXXXXXXXXXXXXXXXXXXXXXXXXXXXXXXXXXXXXXXXXSXXXXXXXXXXNPS

SEQ ID NO: 8477 - protein, 58 aa, Artificial sequence
  protein pattern
  Variant (4)..(4): Xaa in position 4 is Ile or Val
  Variant (8)..(8): Xaa in position 8 is Asp or Gly
  Variant (10)..(10): Xaa in position 10 is any or no amino acid
  Variant (12)..(12): Xaa in position 12 is any or no amino acid
  Variant (14)..(14): Xaa in position 14 is Asp, Glu or Gly
  Variant (18)..(18): Xaa in position 18 is Glu or Pro
  Variant (20)..(20): Xaa in position 20 is Asp or Thr
  Variant (21)..(21): Xaa in position 21 is any amino acid
  Variant (22)..(22): Xaa in position 22 is Asp, Glu or Thr
  Variant (24)..(24): Xaa in position 24 is Asp or Glu
  Variant (26)..(26): Xaa in position 26 is any amino acid
  Variant (29)..(29): Xaa in position 29 is Ala or Ser
  Variant (33)..(33): Xaa in position 33 is any amino acid
  Variant (40)..(40): Xaa in position 40 is any amino acid
  Variant (43)..(43): Xaa in position 43 is Ser or Thr
  Variant (46)..(46): Xaa in position 46 is Asp or Glu
  Variant (47)..(47): Xaa in position 47 is any amino acid
KRYXEVLXPXSXKXRLRXWXXXEXLXLIXKVKXYGTKWRXISXEMXXRPSLTCRNRWR

SEQ ID NO: 8478 - protein, 61 aa, Artificial sequence
  protein pattern
  Variant (2)..(2): Xaa in position 2 is any amino acid
  Variant (4)..(4): Xaa in position 4 is Asp or Glu
  Variant (5)..(5): Xaa in position 5 is any amino acid
  Variant (7)..(8): Xaa in position 7 to 8 is any or no amino acid
  Variant (10)..(11): Xaa in position 10 to 11 is any or no amino acid
  Variant (13)..(13): Xaa in position 13 is Glu or Lys
  Variant (14)..(15): Xaa in position 14 to 15 is any amino acid
  Variant (16)..(16): Xaa in position 16 is Asp, Asn or Val
  Variant (17)..(17): Xaa in position 17 is Lys or Arg
  Variant (18)..(18): Xaa in position 18 is any amino acid
  Variant (19)..(19): Xaa in position 19 is Ala, Pro or Ser
  Variant (20)..(21): Xaa in position 20 to 21 is any amino acid
  Variant (22)..(22): Xaa in position 22 is Leu or Val
  Variant (23)..(23): Xaa in position 23 is Lys or Arg
  Variant (27)..(27): Xaa in position 27 is any amino acid
  Variant (28)..(28): Xaa in position 28 is Gly or Ser
  Variant (29)..(29): Xaa in position 29 is Ala or Ser
  Variant (33)..(33): Xaa in position 33 is Asn or Val
  Variant (34)..(34): Xaa in position 34 is Ile or Leu
  Variant (36)..(36): Xaa in position 36 is Lys or Arg
  Variant (41)..(41): Xaa in position 41 is Pro or Gln
  Variant (45)..(45): Xaa in position 45 is Glu or Gln
  Variant (46)..(46): Xaa in position 46 is any amino acid
  Variant (48)..(48): Xaa in position 48 is Ile or Leu
  Variant (49)..(49): Xaa in position 49 is any amino acid
  Variant (50)..(50): Xaa in position 50 is Ala or Ser
  Variant (53)..(53): Xaa in position 53 is Glu, His or Lys
  Variant (57)..(57): Xaa in position 57 is any amino acid
  Variant (59)..(59): Xaa in position 59 is Phe or Leu
  Variant (60)..(60): Xaa in position 60 is any amino acid
IXWXXLXXAXXFXXXXXXXXXXXKRWXXXLDPXXKXGKWTXEEDXXLXXXYEXHGPXWXXI

SEQ ID NO: 8479 - protein, 47 aa, Artificial sequence
  protein pattern
  Variant (3)..(3): Xaa in position 3 is Ser or Thr
  Variant (6)..(6): Xaa in position 6 is Asp or Glu
  Variant (7)..(7): Xaa in position 7 is Gly or Ser
  Variant (8)..(8): Xaa in position 8 is Gln or Ser
  Variant (9)..(9): Xaa in position 9 is Asp or Gly
  Variant (10)..(10): Xaa in position 10 is any amino acid
  Variant (11)..(11): Xaa in position 11 is Ser or Thr
  Variant (12)..(12): Xaa in position 12 is Ile or Leu
  Variant (16)..(16): Xaa in position 16 is Ser, Thr or Val
  Variant (18)..(18): Xaa in position 18 is Asp or Ser
  Variant (19)..(19): Xaa in position 19 is Asn or Ser
  Variant (20)..(20): Xaa in position 20 is Ala, Ser or Thr
  Variant (21)..(21): Xaa in position 21 is any amino acid
  Variant (25)..(25): Xaa in position 25 is Glu or Gln
  Variant (27)..(27): Xaa in position 27 is Ile or Val
  Variant (28)..(28): Xaa in position 28 is Asp, Glu or Asn
  Variant (29)..(29): Xaa in position 29 is any amino acid
  Variant (32)..(33): Xaa in position 32 to 33 is any amino acid
  Variant (34)..(34): Xaa in position 34 is Asp, Asn or Ser
KFXLKXXXXXXXSNGXIXXXXLVKXLXXXAKXXXLKISIHQHIHNHY

SEQ ID NO: 8480 - protein, 54 aa, Artificial sequence
  protein pattern
  Variant (2)..(2): Xaa in position 2 is Glu or Ser
  Variant (3)..(3): Xaa in position 3 is Ile or Val
  Variant (4)..(4): Xaa in position 4 is Ser or Thr
  Variant (10)..(10): Xaa in position 10 is any amino acid
  Variant (12)..(12): Xaa in position 12 is any amino acid
  Variant (14)..(14): Xaa in position 14 is any or no amino acid
  Variant (16)..(19): Xaa in position 16 to 19 is any amino acid
  Variant (20)..(20): Xaa in position 20 is any or no amino acid
  Variant (22)..(22): Xaa in position 22 is Ser or Thr
  Variant (24)..(24): Xaa in position 24 is any amino acid
  Variant (25)..(25): Xaa in position 25 is any or no amino acid
  Variant (27)..(27): Xaa in position 27 is Asp, Asn or Gln
  Variant (28)..(28): Xaa in position 28 is any amino acid
  Variant (30)..(31): Xaa in position 30 to 31 is any amino acid
  Variant (35)..(35): Xaa in position 35 is Asp or Glu
  Variant (36)..(36): Xaa in position 36 is Glu or Ser
  Variant (37)..(37): Xaa in position 37 is Ala or Leu
  Variant (38)..(38): Xaa in position 38 is any amino acid
  Variant (39)..(39): Xaa in position 39 is Glu, Gly or Asn
  Variant (40)..(40): Xaa in position 40 is Leu or Met
  Variant (42)..(43): Xaa in position 42 to 43 is any amino acid
  Variant (44)..(44): Xaa in position 44 is Asp or Asn
  Variant (46)..(46): Xaa in position 46 is Ile or Leu
  Variant (47)..(47): Xaa in position 47 is Glu or Lys
  Variant (48)..(48): Xaa in position 48 is Asp or Ser
  Variant (49)..(49): Xaa in position 49 is Ile, Leu or Val
  Variant (53)..(53): Xaa in position 53 is any amino acid
  Variant (54)..(54): Xaa in position 54 is Asp or Gln
LXXXESLGYXTXRXKXXXXXWXKXXDXXLXXLVNXXXXXXGXXXGXXXXKTIXX

SEQ ID NO: 8481 - protein, 19 aa, Artificial sequence
  protein pattern
  Variant (9)..(9): Xaa in position 9 is any amino acid
  Variant (11)..(11): Xaa in position 11 is Pro or Ser
  Variant (13)..(13): Xaa in position 13 is any amino acid
  Variant (15)..(15): Xaa in position 15 is any or no amino acid
  Variant (17)..(17): Xaa in position 17 is any or no amino acid
  Variant (19)..(19): Xaa in position 19 is Ile or Val
IITMVVRGXAXEXIXKXAX

SEQ ID NO: 8482 - protein, 19 aa, Artificial sequence
  protein pattern
  Variant (2)..(5): Xaa in position 2 to 5 is any or no amino acid
  Variant (8)..(8): Xaa in position 8 is Asn or Thr
  Variant (12)..(12): Xaa in position 12 is Pro or Ser
  Variant (14)..(14): Xaa in position 14 is Ile, Met or Val
  Variant (15)..(15): Xaa in position 15 is Lys or Arg
  Variant (17)..(17): Xaa in position 17 is any amino acid
  Variant (19)..(19): Xaa in position 19 is Glu or Gly
PXXXXHFXYLPXTXXPXLX

SEQ ID NO: 8483 - protein, 14 aa, Artificial sequence
  protein pattern
  Variant (3)..(3): Xaa in position 3 is Glu or Gly
  Variant (4)..(4): Xaa in position 4 is any amino acid
  Variant (9)..(9): Xaa in position 9 is Asn, Ser or Thr
  Variant (14)..(14): Xaa in position 14 is Ala or Gly
EDXXDFWEXLRSLX

SEQ ID NO: 8484 - DNA, 726 bp, Saccharomyces cerevisiae
  CDS (1)..(726)
atgactgccagcacatcagttgcggtgggttgtgcggtgggtatacccgtcggtgtaggtattataatagcagtatgtttctggtttaacctacaaaaaagatacaagagggaggaacaagacgatagagaattggaaagggctatttatgatgaaagtggtttcgtgtcctttgacaattttggacccttaagagacagtaaagatgaagcagcactagccagctccgagctaaaaaatcctgatcacacttctggttcatcggaaggatctgctcatccagaagaaaaagatggaaaatcgcgagatcaagagaaaccgttagggaaaaagaatagtaaatactatgtgccagcataccgtaggaaaataaatttacttcaagtacgaaataataactacggcaataatgccaggcagaagtccgttgtggatttaccaagtataaataacagctccaatgtttccttatcatcttcccaacggcatataacaaagagacagatcagcgtttatgatcagatggtccctgttatttctgatgaaggaccaaactttttcgcagatccttccagtgatactaatactagcaatgaccaaaacaaagcttcgatgatagaacttaaacataatactcgccaatctagtaatgaaaatctgataagaaatttgcagaatcaggactttggttcgtattaccaaggagagcttcatcctcgtttttaa

SEQ ID NO: 8485 - protein, 241 aa, Saccharomyces cerevisiae
MTASTSVAVGCAVGIPVGVGIIIAVCFWFNLQKRYKREEQDDRELERAIYDESGFVSFDNFGPLRDSKDEAALASSELKNPDHTSGSSEGSAHPEEKDGKSRDQEKPLGKKNSKYYVPAYRRKINLLQVRNNNYGNNARQKSVVDLPSINNSSNVSLSSSQRHITKRQISVYDQMVPVISDEGPNFFADPSSDTNTSNDQNKASMIELKHNTRQSSNENLIRNLQNQDFGSYYQGELHPRF

SEQ ID NO: 8486 - DNA, 1083 bp, Candida glabrata CBS 138
  CDS (1)..(1083)
atgacaggtacagtgtcgacagctgttggctgtgctgtggggatacccgttggcgtgggtgttatagtcgcgtgtcttttctggatcagaatgcaaaggcgactcaaggaggaggatataatagaccaggagttgaacagagctgtctacgacgagagtgggtttgtcagcttcaataatattgatacattaaaggccgaacctaacggacatcctagctctgaggatactaatgaagtaatgcatagcagtgacattgatgacaatggagatgatgacgatgaggaccacaatgcaagaaggaacaacacatatgcagcacaggataagaataacggaaaatacgtgcccgcatatagaagacagataaataaacacaatagcatattacaacagcagcgcaagagtcgaaatttagtgaacaccatgggacacagtatagaatctttatcaatggatgatcacagccaagcaaatgggaaatcaagacaagtgagcgtatatgaccaaatggttccagttttggatgatgctaatagagactctagctctccattccctactaatgacaaagatacaagtgataaaaaatctaacttatttcaatctcatgatgtcagtgctaatacatctacttctttctttgaaacaagaagtaacgataacctcattaaaaatttaaatagccacgattttggctcatattatcctagaaggccgtcgacatcaaacctcaaccattcacagggatcattgcatactagaaactcttctatgctatcccttggtaagatagaaaatgcagagaatgttttcgcaacgcccaaaagtgaaaatatactaaaacatcctcatcctttggaacatgagagttcatcgatatcgaacgaaactaacaacgtaacagacaacacaatcgacggtgaaagtgcgtccaaatcttccaaaacataccaactaaagaacaattatgatattcagaacaccagtgaaatcgcagaggaggatcaatatgaaaatgagttcacgaactactcagaaaacaaaagagcctatattgatggtctgagacctaagatgtaa

SEQ ID NO: 8487 - protein, 360 aa, Candida glabrata CBS 138
MTGTVSTAVGCAVGIPVGVGVIVACLFWIRMQRRLKEEDIIDQELNRAVYDESGFVSFNNIDTLKAEPNGHPSSEDTNEVMHSSDIDDNGDDDDEDHNARRNNTYAAQDKNNGKYVPAYRRQINKHNSILQQQRKSRNLVNTMGHSIESLSMDDHSQANGKSRQVSVYDQMVPVLDDANRDSSSPFPTNDKDTSDKKSNLFQSHDVSANTSTSFFETRSNDNLIKNLNSHDFGSYYPRRPSTSNLNHSQGSLHTRNSSMLSLGKIENAENVFATPKSENILKHPHPLEHESSSISNETNNVTDNTIDGESASKSSKTYQLKNNYDIQNTSEIAEEDQYENEFTNYSENKRAYIDGLRPKM

SEQ ID NO: 8488 - DNA, 1047 bp, Kluyveromyces lactis NRRL Y-1140
  CDS (1)..(1047)
atgagtgataatactgttggcgtggccgttggttgtgctgtaggaatacccatcggagtggggattatagttgcgtttgggttttggtatcgaatgcagaggagattcaaggaagaagagctggaacacgacgggcattcaaattttgatgaagagatgagtttcaacgatatgggtgtgatgaagatgcagcaggctggtgagcatgttcaggagaatgagcacgaagttcatgggaatcacgtttcgtccgatgaaacggcatcgtccagtgaggagaagagggaaagggaagtggatcatactagtactcagctaaagaataactcgtctaccgggtccatcagtaggggtaaatcggggaaaaggaatatatatacgcctgcatatcgtaaacggttgcaggaaacggtttcctcaatacagaaacccatggattttgattcgagcaataacacgaaaagtacttctacttcgatcacgtctgcagatactccaaagagacagagtagtcagatcaacatgttcgataagatgataccgatgctgcccgatgctgcagttggtggaaatggatcaggatccatttttgacgagggatctgtgcccaggagaaattcatcgaatgaaactctactaaaaacgatcggaacactcgatttgggtgcatatccaaggcgaggttcgtcagtacaaatttccggtatgaataataataatgccatcaacaatcataatattaataacgctgataactctatcatttcgtcgagacattcgttaacatcgctgcatacacacatgtcttctccaagtacgaattcaaaacctataatagagaatgtattcgacacgccgaaaggttctaaagtgttgaccttaccagcggaaaacgattcatctgaacaatataggctacagaataattacgatatcagagatgatcatcacattgctgaagaagatcagtacgaaaatgagttcacgaactactcggagaataaaagggaatttatcgattctttgagaccaaaaagacaaacataa

SEQ ID NO: 8489 - protein, 348 aa, Kluyveromyces lactis NRRL Y-1140
MSDNTVGVAVGCAVGIPIGVGIIVAFGFWYRMQRRFKEEELEHDGHSNFDEEMSFNDMGVMKMQQAGEHVQENEHEVHGNHVSSDETASSSEEKREREVDHTSTQLKNNSSTGSISRGKSGKRNIYTPAYRKRLQETVSSIQKPMDFDSSNNTKSTSTSITSADTPKRQSSQINMFDKMIPMLPDAAVGGNGSGSIFDEGSVPRRNSSNETLLKTIGTLDLGAYPRRGSSVQISGMNNNNAINNHNINNADNSIISSRHSLTSLHTHMSSPSTNSKPIIENVFDTPKGSKVLTLPAENDSSEQYRLQNNYDIRDDHHIAEEDQYENEFTNYSENKREFIDSLRPKRQT

SEQ ID NO: 8490 - DNA, 23 bp, Artificial sequence
  primer
atgactgccagcacatcagttgc

SEQ ID NO: 8491 - DNA, 25 bp, Artificial sequence
  primer
ttaaaaacgaggatgaagctctcct

SEQ ID NO: 8492 - DNA, 327 bp, Saccharomyces cerevisiae
  CDS (1)..(327)
atgagctcaaatgaagaggtatttactcagataaacgcaactgcgaatgtggttgataataagaagcgtttacttttcgtgcaagatagctcagcacttgttctagggcttgttgcaggatttttgcaaatcgagtcagtccatgggtttatttggttcctgattctgtacaacttgattaatgtcatttacattgtttggatctgtcaacttcaaccaggaaagttctaccaaagcccacttcatgacatttttttcgaatcgttttttagagagataactggttttgtcatggcatggacatttggatacgccctaatcggatga

SEQ ID NO: 8493 - protein, 108 aa, Saccharomyces cerevisiae
MSSNEEVFTQINATANVVDNKKRLLFVQDSSALVLGLVAGFLQIESVHGFIWFLILYNLINVIYIVWICQLQPGKFYQSPLHDIFFESFFREITGFVMAWTFGYALIG

SEQ ID NO: 8494 - DNA, 357 bp, Magnaporthe grisea 70-15
  CDS (1)..(357)
atgccttcggagcgcgactatcagatcgcaccaattgtgcaggagtcggtgatgcacaacaccaagatcgtctccaacgtccaaaccctgaccgcatccttgttcggagtcgccgctggaatcctcgggctcgaatcgtattccgggttcctattctacgtgatcttcagcttcctcacgactgcaatattctacgtcttccgcgtcgcccccacttcattatccgccggcaagggcttcctcgattccagtcgatactttaaaggcccctttgagctttggacaggcggtttgtttggcgggctagcgggtttcattttgacgtggacgctattttatggccttgttagggcttga

SEQ ID NO: 8495 - protein, 118 aa, Magnaporthe grisea 70-15
MPSERDYQIAPIVQESVMHNTKIVSNVQTLTASLFGVAAGILGLESYSGFLFYVIFSFLTTAIFYVFRVAPTSLSAGKGFLDSSRYFKGPFELWTGGLFGGLAGFILTWTLFYGLVRA

SEQ ID NO: 8496 - DNA, 357 bp, Gibberella zeae PH-1
  CDS (1)..(357)
atgccttccgaacgcgaactccagatcaacccaatcgttcctgagtctatgattcacaacaccaaagctctttccaatctccacagtctcactgcttccctcttcggagtcactgctggagtcctcggcctcgagtcctactacggcttcctcgtctacatcgtcttctctttcatcactactctgctcttctacgtcctcaaggtcgcccctgaatcacttcccaagggccatgctcctcttgatccttcgcgcttctaccgaggactctttgatttctgggtcggtggcatctccaatggcatctcgggtttcgtcttgacatggacattattttatggtttagttagggcatag

SEQ ID NO: 8497 - protein, 118 aa, Gibberella zeae PH-1
MPSERELQINPIVPESMIHNTKALSNLHSLTASLFGVTAGVLGLESYYGFLVYIVFSFITTLLFYVLKVAPESLPKGHAPLDPSRFYRGLFDFWVGGISNGISGFVLTWTLFYGLVRA

SEQ ID NO: 8498 - DNA, 324 bp, Candida glabrata CBS 138
  CDS (1)..(324)
atgagtacagatgaatcatacagcagtttgaactctggttcaaatatcatgattaataagaagtcactattatatgtacaagacagtacatcgttggtatttgggcttgcagccggtatcctgcaattggaatcctgggacggttttcttgcatttttgggttgttatactacagtttgtctaatctttatactctggacatgccaactcaaaccacaaaagttctttcaaagtccaattcaggatatattcatagagtcactttttagggagcttacaggttttgtaatggcttggactttctcgtatgcattggttggatga

SEQ ID NO: 8499 - protein, 107 aa, Candida glabrata CBS 138
MSTDESYSSLNSGSNIMINKKSLLYVQDSTSLVFGLAAGILQLESWDGFLAFLGCYTTVCLIFILWTCQLKPQKFFQSPIQDIFIESLFRELTGFVMAWTFSYALVG

SEQ ID NO: 8500 - DNA, 318 bp, Kluyveromyces lactis NRRL Y-1140
  CDS (1)..(318)
atgagttatcgcttcaccgacctaaagtcttccaaaagtggaagtttcaacaacaacaaactactacggatacaggattctacaatgctgacagcaggacttagtgctgggatattgcaacttcaatcttttgcaggttttggaatgttttttgctgtttatatcctggtgaacctcatatttatagcgtggttttgcaaattcaagcctagtctatattttactaatccagtgcataaaatatgggttaaaaatctattccgcgagctagctgggtttgtcatgacttggacgttagcgttcactttggtcaggtaa

SEQ ID NO: 8501 - protein, 105 aa, Kluyveromyces lactis NRRL Y-1140
MSYRFTDLKSSKSGSFNNNKLLRIQDSTMLTAGLSAGILQLQSFAGFGMFFAVYILVNLIFIAWFCKFKPSLYFTNPVHKIWVKNLFRELAGFVMTWTLAFTLVR

SEQ ID NO: 8502 - DNA, 315 bp, Debaryomyces hansenii CBS767
  CDS (1)..(315)
atgagtgaaacagagacaatatattacatttcaagcatagaagcaaataagaaaaagctccaacatgtacatgatattatggcattggcgctaggagttggtgctggtgttttgaccttggaatcggtatacgggtttctcttctatataataggctttacaatcacaaacttggctttttaccggatctgttgcgaaggaaaggcctttgagttcttcagaaagcctctacatgaaatattcgttgacggtatagctagcaatgttgccggattccttatgatgtggtgtctcgtgtttgctctagttaaatga

SEQ ID NO: 8503 - protein, 104 aa, Debaryomyces hansenii CBS767
MSETETIYYISSIEANKKKLQHVHDIMALALGVGAGVLTLESVYGFLFYIIGFTITNLAFYRICCEGKAFEFFRKPLHEIFVDGIASNVAGFLMMWCLVFALVK

SEQ ID NO: 8504 - DNA, 354 bp, Yarrowia lipolytica CLIB122
  CDS (1)..(354)
atgaacgctccaccacagcaggccgatacctccaccgatgactgggccgccaaccctctggccggccagagcattgctgagaacaccaagtcaatccagtacgtccgaagcgtgagctcactagctattggcgttggtgccggaatcctccatctcgagtcgtactatggcttcctcttctacgccattgcatccacaattgtcagcattctcctctacacagtgtcctcgacaggcaaccctggtcgatatttcgtctatcccgtgaaacagctgtttgtcgacgacatcttcgccggtctgtcgtcattcctcctgatgtggaccctcttttatgagctcgttgatgcttag

SEQ ID NO: 8505 - protein, 117 aa, Yarrowia lipolytica CLIB122
MNAPPQQADTSTDDWAANPLAGQSIAENTKSIQYVRSVSSLAIGVGAGILHLESYYGFLFYAIASTIVSILLYTVSSTGNPGRYFVYPVKQLFVDDIFAGLSSFLLMWTLFYELVDA

SEQ ID NO: 8506 - DNA, 327 bp, Candida albicans SC5314
  CDS (1)..(327): transl_table=12
atgaccgttgccacacagaagttttactatcaacccagcatcgaggccaacaaacagaaattacaacatgtacatgatgttgcatcattagcattgggagttggttcaggaatattgacattagaatctatgaatggatttatattttatttgataggaataacagtcactaatttattattttacataatatgtggcgaaggcaggccatcaaaatatttcaagaatcctttgcaagaggtgtttataagtggggtttttagtaatatacctggcttcattatgatgtggtgtttagtttatgctttggtaaagtcaagttcatga

SEQ ID NO: 8507 - protein, 108 aa, Candida albicans SC5314
MTVATQKFYYQPSIEANKQKLQHVHDVASLALGVGSGILTLESMNGFIFYLIGITVTNLLFYIICGEGRPSKYFKNPLQEVFISGVFSNIPGFIMMWCLVYALVKSSS

SEQ ID NO: 8508 - DNA, 345 bp, Phaeosphaeria nodorum
  CDS (1)..(345)
atggctgcacctgcacttgttgaagagcgcgagctggctatcaaccccatagttggcaccagcgtacaacacaacaaccaggtcatatccaacattcgtaatctcaccgcatcgctgttcggagtcgctgcaggcacactcggcctcgagtcacatccaggcttcattttctacctcctaggcacgcttgtcgtctctgtattactgttcgccctaaaaacagatggaaagccaggcgcatacttttacaggccgctgagcgatctgtggttaggcgatgtgtttggagggcttagtggctttgtgcttacatggacactgttctacggattggtacgggcataa

SEQ ID NO: 8509 - protein, 114 aa, Phaeosphaeria nodorum
MAAPALVEERELAINPIVGTSVQHNNQVISNIRNLTASLFGVAAGTLGLESHPGFIFYLLGTLVVSVLLFALKTDGKPGAYFYRPLSDLWLGDVFGGLSGFVLTWTLFYGLVRA

SEQ ID NO: 8510 - DNA, 26 bp, Artificial sequence
  primer
atgagctcaaatgaagaggtatttac

SEQ ID NO: 8511 - DNA, 24 bp, Artificial sequence
  primer
tcatccgattagggcgtatccaaa

SEQ ID NO: 8512 - protein, 97 aa, Artificial sequence
  consensus sequence
  Variant (2)..(16): Xaa in position 2 to 16 is any amino acid
  Variant (18)..(19): Xaa in position 18 to 19 is any amino acid
  Variant (22)..(22): Xaa in position 22 is any amino acid
  Variant (24)..(24): Xaa in position 24 is any amino acid
  Variant (28)..(29): Xaa in position 28 to 29 is any amino acid
  Variant (32)..(75): Xaa in position 32 to 75 is any amino acid
  Variant (76)..(84): Xaa in position 76 to 84 is any or no amino acid
  Variant (87)..(89): Xaa in position 87 to 89 is any amino acid
  Variant (91)..(95): Xaa in position 91 to 95 is any amino acid
NXXXXXXXXXXXXXXXGXXAGXLXLESXXGFXXXXXXXXXXXXXXXXXXXXXXXXXXXXXXXXXXXXXXXXXXXXXXXXXXXXXGFXXXWXXXXXLV

SEQ ID NO: 8513 - protein, 32 aa, Artificial sequence
  protein pattern
  Variant (2)..(17): Xaa in position 2 to 17 is any amino acid
  Variant (18)..(19): Xaa in position 18 to 19 is any or no amino acid
  Variant (22)..(22): Xaa in position 22 is Ile, Leu or Val
  Variant (23)..(23): Xaa in position 23 is Leu or Met
  Variant (24)..(24): Xaa in position 24 is any amino acid
  Variant (26)..(26): Xaa in position 26 is Cys or Thr
  Variant (27)..(27): Xaa in position 27 is Phe or Leu
  Variant (28)..(28): Xaa in position 28 is any amino acid
  Variant (29)..(29): Xaa in position 29 is Phe or Tyr
  Variant (30)..(30): Xaa in position 30 is Ala, Gly or Thr
  Variant (32)..(32): Xaa in position 32 is Ile or Val
FXXXXXXXXXXXXXXXXXXGFXXXWXXXXXLX

SEQ ID NO: 8514 - DNA, 3147 bp, Saccharomyces cerevisiae
  CDS (1)..(3147)
atgcctataacgtcaagccccgatctgttctatctcaatgattgtgatgtcgtctattggtatgacctcactcgcttagtgtgtcattatgttaatttaacagagcgcgacctattggcaaatgaacgggaaaagtttctaacttccttggatttattaacagctcaaataacctatgtttatatgcttttcaggaatctccgtttagttgaagatagtttcaaaaaaaccctcaaaaaactaatttacaccttgtctaggttttcaataaatgcaaatatttggtttcattccacattgtttgaagaaagagaagccatagcctcccagaaggatccagaaagaagatcccctcttctacagtcaatcctaggaaccttccaaaaatttcattttctactgcgtttactacatttcctctcaaatcctaacgaacttacaatactgcctcaattgactcctcgatttttcaaggattctttcaatacaatttcatggaataacccgtttttgcgtaagcgtctcaaccagcatatgtcccatgacctaccgagacagatgattaaagccgttgctggtgcttcaggaattgttgcggaaaatattgatgaaattccagcttccaaacagggcacttcatgctcgtcagaaacgtctcaccattcaccatcagccccgtttcaaagaaggagaagaggtaccattttctctaatgtgtcaggaagttccgatgagtctgacaccatatggtccaaaaggaaaaaaccatacccgctaaatgaagaaactctaagccttgtaagggccaggaagaagcagcttgatggtaaactaaaacaaatgatcaaaagtgctaatgaatatctcagtaacacggctaatttttcaaaaatgttgaattttgaaatgaatttcaaaacctacgaagaagtaagcggaacaattcctataattgatattctggaaaacctagatttaactatttttctaaacttgagagagttgggagatgagaatagagtttttgacgaagatgtcgctattgatgatgaagatgaagagtttttgaaacattctttatcatccctatcgtatatcttatccgactattttaatatgaagcaatattttcatgatgtagtagtgaaatttataattgtcgcccagcatttgacattagaggatcctttcgttttctcgccaatgcaaaacgacttgcctaccggttattatgaaccaatgaaaccttcatccttgaatttagataatgccaaggataagaagaatgggagccaaaatactgatatccaagaggaggaagatgaatatgagccagacccggatagtcttattctcttccacaacctcatcaatcaagattctgatttcaatgatttaaagttttttaatctcgcccacgtttttaaaaaatcctgtgatgactattttgatgtgcttaaactagccattgagttcgtgaatcaattaattctagaaagagagaatttgttaaattatgctgctagaatgatgaaaaacaatatcacggaattgctattgcgcggggaagaaggctatgggtcctatgacggcggtgaaactgccgaaaaaagtgacacgaatgctgtttatgcagattcagatactaaagacaatgacgaatggcgtgacagccaagtcaaattaccgaggtatttgcagcgcgagtatgacagtgaactgatttggggctctaacaataggattaaaggtggttctaaacacgcactgatctcttacttgacagataatgaaaagaaggatctatttttcgatattacttttttaatcactttcagaagcatctttactacaacggagtttttaagctacttgatttcgcaatataatttggatccaccagaggatttgtgctttgaagaatacaatgaatgggtgacgaaaaagcttataccggttaaatgtagggtggttgagattatgacaacctttttcaagcaatattggttcctgggctatgatgagcccgatcttgcgaccctaaatctggattattttgcgcaagtagcaatcaaggaaaatataacaggatctgtggaattactaaaggaggtcaatcagaagtttaaacatggtaatatacaagaagcgactgcaccaatgaaaacgttagatcaacagatctgccaggaccattactcgggcactttatactctaccacggaatccattttggccgtcgatccagttttatttgccactcaattaacgatactagagcatgaaatttattgtgagataaccatttttgattgtttacaaaaaatttggaagaacaagtatacaaaatcgtatggggcttcaccgggtttgaacgagtttatcagttttgccaataaactgacaaatttcatatcctactctgttgtaaaggaggctgataaaagtaagcgcgccaagctactctctcattttatttttatcgcagaatattgtaggaaattcaataacttttcttccatgactgcaatcatttcagcattatattcttcaccaatttatcgtttagagaaaacctggcaggcagttattcctcaaacgagagatctattgcagtcactgaacaagttgatggatcccaagaaaaatttcataaattacagaaacgagctgaaatctttacatagcgctccctgcgtaccgtttttcggcgtttatttatctgatctaacctttactgattccggaaatccggattatcttgtcttggaacatggtttaaagggtgtccatgatgagaagaaatatataaacttcaacaaaaggagcagacttgttgatatcttacaagagatcatatatttcaagaaaacacattatgatttcactaaagatcggacggtaattgaatgtatatcaaattcattggaaaacatcccccatattgagaaacaataccaattatcattaattattgaaccaaaaccaagaaagaaagtcgttccgaattccaattcgaataataaatcacaagaaaaatccagggatgaccaaaccgatgaaggaaaaacatccactaagaaagacagatttccaaaatttcaattacataagacaaagaaaaaagctcccaaggtttctaagtaa

SEQ ID NO: 8515 - protein, 1048 aa, Saccharomyces cerevisiae
MPITSSPDLFYLNDCDVVYWYDLTRLVCHYVNLTERDLLANEREKFLTSLDLLTAQITYVYMLFRNLRLVEDSFKKTLKKLIYTLSRFSINANIWFHSTLFEEREAIASQKDPERRSPLLQSILGTFQKFHFLLRLLHFLSNPNELTILPQLTPRFFKDSFNTISWNNPFLRKRLNQHMSHDLPRQMIKAVAGASGIVAENIDEIPASKQGTSCSSETSHHSPSAPFQRRRRGTIFSNVSGSSDESDTIWSKRKKPYPLNEETLSLVRARKKQLDGKLKQMIKSANEYLSNTANFSKMLNFEMNFKTYEEVSGTIPIIDILENLDLTIFLNLRELGDENRVFDEDVAIDDEDEEFLKHSLSSLSYILSDYFNMKQYFHDVVVKFIIVAQHLTLEDPFVFSPMQNDLPTGYYEPMKPSSLNLDNAKDKKNGSQNTDIQEEEDEYEPDPDSLILFHNLINQDSDFNDLKFFNLAHVFKKSCDDYFDVLKLAIEFVNQLILERENLLNYAARMMKNNITELLLRGEEGYGSYDGGETAEKSDTNAVYADSDTKDNDEWRDSQVKLPRYLQREYDSELIWGSNNRIKGGSKHALISYLTDNEKKDLFFDITFLITFRSIFTTTEFLSYLISQYNLDPPEDLCFEEYNEWVTKKLIPVKCRVVEIMTTFFKQYWFLGYDEPDLATLNLDYFAQVAIKENITGSVELLKEVNQKFKHGNIQEATAPMKTLDQQICQDHYSGTLYSTTESILAVDPVLFATQLTILEHEIYCEITIFDCLQKIWKNKYTKSYGASPGLNEFISFANKLTNFISYSVVKEADKSKRAKLLSHFIFIAEYCRKFNNFSSMTAIISALYSSPIYRLEKTWQAVIPQTRDLLQSLNKLMDPKKNFINYRNELKSLHSAPCVPFFGVYLSDLTFTDSGNPDYLVLEHGLKGVHDEKKYINFNKRSRLVDILQEIIYFKKTHYDFTKDRTVIECISNSLENIPHIEKQYQLSLIIEPKPRKKVVPNSNSNNKSQEKSRDDQTDEGKTSTKKDRFPKFQLHKTKKKAPKVSK

SEQ ID NO: 8516 - DNA, 3927 bp, Candida glabrata CBS 138
  CDS (1)..(3927)
atgaacacacccaacacacccaaacccgaagtagggtttaaacccatagatatagtacgagccataagtgactattatatccacgacgaaatcaaagaccacaacaagctcacttttttcaaaggagatataatatacattgtcaccaaattagactccggatggtgggacggtgtcctggttgaggataacctagtctacacttccagaggatccaagactggctctgtggtcaggggatggttaccttcaagttatgtgaggtcgctgattctcaccacagatacagcaaacaaaccgggttcaatatactctggtactgaagttgtgcctgaaattatcacaccagacatatcagtcttgaataacacggaaaaactacgaaactctattacatcaatgattaatgaagcacctaaggcggcaaaattgaaaccagaccctgaatgctatgatgatgcaacttcatattatatcccagcagaccgcaacctgttctacctaaacgacagtgatattgtgacttggaatcaattatttgtggtgttgaatcattatcttgacaagacgaaagaatgctttaccaagagctatgatgaagtaagtcatataagcgaaaagaggaaaagctataggccggagttcaggtataattatacccttctgggggcatatgttacgtatctaatacaagcctgtgaaatactaaaagaatcgaccccccctgagactattgacccggtaaagaaacacaaggtgataaagttgttaagtgaagatctcatacattgtctaggtgtcatttctgagtcggcacatgtttggtataaccattcatattatacaagttattcacgttccagtcatcagcaaggaaattatagtaccaatgatacagatatagataaaacactcattatttcaagatgttacgatgttgccctcgagagctttgataagattcatgatcaatttaatattctgtttgatatgctaaatgagttctctgtgaggcataaatcattcatcattcctcagcttttcccgagattcatgagattgtcatttaacggaggatcgtggtccaacccattccttttgcctccaaataaacttgccagtcaaaatccgatatctagctactatccacctgctatcgagaatgtactggggcgcacttctggttatcacagaaataaaaggagaaattctgtactgtcgtctcctttcagtggaactaactctctaggtagttcacgcaacagctcgtcaggaaatttatctgctgctgggcagcaaagatctagcgctggatcattctcgacaacatcaaagcacacagataaaccctctcgtaaaagcactggtctatttgctcaatatcttcatgcaaacaagaattatcctgttgttaatccttccaatattaatgcttgcaaagataagttcaagaattatgataataagattggaaagtttcctttgagtagagacacgctggaactcttggaaaagaggaagggtcagatacatgtaagtttcagcgagtttaatgaattggataaaaacgaagaagaagatattcccgtaaaaccaagtagtattgagactatgacatccacagccccatcgagatcgaaggtcatacaaagcttagaggccaatttccggacttacaaagagataaatacaaccgttctgattattaatatattggaaaatttggatctaacgatgtttacaaaaatgagacatatagtagtgaatggtggtatttatggttgggagtttgagaaatatcaggacttgatgagacatactcttgtctctgttgcttattctgttgaggaattttacaaaataaaacaaacctttcatgacattgcaatgagactaattatgtgctctcaacacacaactctagaagatccatatgtattttcgacaatgaaatcaaattaccctgtgggtgccttggatccaatttcaattgatactttgacaatatgctcgaaagcagatataagcgcctatggctcttatttgttaaagaaagaggacattatcagaaaaagtctatacgaaagacttttgagggaagatgccgaatttaattatgacacttactattcagtatgtgcagattttagagatgctagacaaaagtatgttgaaatggcagacgcagcttgtgccgttgtttcaaaactagttgaggaaagggacaaaatccttaattatgccgcaaggacgatgcaaagtgagcttgttgcaaaattactagaagatgaggaaataaatgaatatattgaagaggaggatagctattataaaaatgagtccaatgtagtcgtatgtcccgatgataaaattgagtttgtgccatggtaccttcagccaaactataccgccgaagttatttttgattcaaaaggaagaatgaaaggagctaataagagagatttgtttgaatatttgtttcaatcctcatctctcgatatgccttttgcgataactatgttgataacttttaggacaatatttacttctactgaatttattgttaatataattgagagatttgaagaagcaccaccagaaaatctgagttatgaagagtataacgactggattgaaaaaaaatacttaccaaacaaagaacgggtaatttatctattatggaaactgttcacatttttttggaatgaacggtatatggattttcctgtagcactattggagaactgtattaaaactgcacagcgtgaaaatatcgcctatgctaatgaactttacacatctttgaatgaaatcaaagctaacaatcagacttctgaatatagctactggtcattgttagagcctagtaccgaaatccttgaatataataatgatttgaagcggataggattctcaaaccttgtgcatgatgcaaagtttacagctaatgtctatgagtcaatattagatataccagctgaaaacgttgctcagcaactagctttgattgaagaaaatctttacgaaaaaattacaatatttgattgtcttgaccgcgtgtggggatgtaagcaatgtgatttcggaggttctaagaatattagtgagtttatttcatttgcgaatagcatcactaaatatgtgtcttataaaattttacaatatgatacagcagccaaaagaggacaggccatcggttatttcattaaggtcgctcgtattagctatgaaattaataatttctctagtatgactgctatcatctcaggtatttatgcatcgccagtaaatcgtttacatgaaagctggaagttggtatctcgagaattacagaacaccttgcgtgagcttgatgacttgatgatatctacgaaaaattttttgaagtacagattgacgcttaagaatgttggtaacagaccatgtattccattttttggagtatatctttcagacttattattcacacacaatgggaatccagattatgttgataaaagcaggggaacagtaaattttacaaaaagatttcggatttttgatattattcaggaaatttttcactataagaaggtgaaatatgaatacaaagcagacttagatataatacaccatatcatgaatgtagctgaaaatgtgccggatgttgagaatcagtatcacttgtcactccagttggagcctagatcaaaaagtacttctacatcttcatctggcgacacagccactatcgttgatgtcaagaaggaggaagagagtcaacagacaccaaagaaaggaataagaaagcattttcatatgaaatctaaaaatccagaaaataaggttcttgtcaataaaggtaaagaaaaatcaaggaaaaagagttcaggattcagattctttggctctagaaaatctcgtagtatttcaaccgatgcatcttaa

SEQ ID NO: 8517 - protein, 1308 aa, Candida glabrata CBS 138
MNTPNTPKPEVGFKPIDIVRAISDYYIHDEIKDHNKLTFFKGDIIYIVTKLDSGWWDGVLVEDNLVYTSRGSKTGSVVRGWLPSSYVRSLILTTDTANKPGSIYSGTEVVPEIITPDISVLNNTEKLRNSITSMINEAPKAAKLKPDPECYDDATSYYIPADRNLFYLNDSDIVTWNQLFVVLNHYLDKTKECFTKSYDEVSHISEKRKSYRPEFRYNYTLLGAYVTYLIQACEILKESTPPETIDPVKKHKVIKLLSEDLIHCLGVISESAHVWYNHSYYTSYSRSSHQQGNYSTNDTDIDKTLIISRCYDVALESFDKIHDQFNILFDMLNEFSVRHKSFIIPQLFPRFMRLSFNGGSWSNPFLLPPNKLASQNPISSYYPPAIENVLGRTSGYHRNKRRNSVLSSPFSGTNSLGSSRNSSSGNLSAAGQQRSSAGSFSTTSKHTDKPSRKSTGLFAQYLHANKNYPVVNPSNINACKDKFKNYDNKIGKFPLSRDTLELLEKRKGQIHVSFSEFNELDKNEEEDIPVKPSSIETMTSTAPSRSKVIQSLEANFRTYKEINTTVLIINILENLDLTMFTKMRHIVVNGGIYGWEFEKYQDLMRHTLVSVAYSVEEFYKIKQTFHDIAMRLIMCSQHTTLEDPYVFSTMKSNYPVGALDPISIDTLTICSKADISAYGSYLLKKEDIIRKSLYERLLREDAEFNYDTYYSVCADFRDARQKYVEMADAACAVVSKLVEERDKILNYAARTMQSELVAKLLEDEEINEYIEEEDSYYKNESNVVVCPDDKIEFVPWYLQPNYTAEVIFDSKGRMKGANKRDLFEYLFQSSSLDMPFAITMLITFRTIFTSTEFIVNIIERFEEAPPENLSYEEYNDWIEKKYLPNKERVIYLLWKLFTFFWNERYMDFPVALLENCIKTAQRENIAYANELYTSLNEIKANNQTSEYSYWSLLEPSTEILEYNNDLKRIGFSNLVHDAKFTANVYESILDIPAENVAQQLALIEENLYEKITIFDCLDRVWGCKQCDFGGSKNISEFISFANSITKYVSYKILQYDTAAKRGQAIGYFIKVARISYEINNFSSMTAIISGIYASPVNRLHESWKLVSRELQNTLRELDDLMISTKNFLKYRLTLKNVGNRPCIPFFGVYLSDLLFTHNGNPDYVDKSRGTVNFTKRFRIFDIIQEIFHYKKVKYEYKADLDIIHHIMNVAENVPDVENQYHLSLQLEPRSKSTSTSSSGDTATIVDVKKEEESQQTPKKGIRKHFHMKSKNPENKVLVNKGKEKSRKKSSGFRFFGSRKSRSISTDAS

SEQ ID NO: 8518 - DNA, 4695 bp, Candida glabrata CBS 138
  CDS (1)..(4695)
atgtccagtgagtcattggcgcaggatgggcacgagctgaccactgtgtatcctatggatgtggttgtggtgcagtttgagttcaatgctggcaacaagaaggagaagtacctgagcatgcagcctggcgacacggtgtatgtgcttgcgaaggaccagtctgggtggtgggacggtcttattatagatgagaagagtgacaaggctgtccgtgggtggttcccgcagaactacacgaaaccgttgcgggatcaccacagactctttgggaagcgatcaagctcgcgcagctcgcgtagaagcagtttcaacagcacgtccaggccgagcgtggcgatgaacgtgatcggtggcaacgcgggtactggagatgggggaagtataggtgcttatctcaacgtggtaaactcgagaaacagtatgagcagacgtggttcgtcgcacttggcacagtcctctacttcccctatgttgatgacttctactagtgggtctctggagaggacaaattccatgcctcataatgcgctatcgcctagaatgaaaggccaggataatgcgcgctcatcttcggtgatttcacacaagccaaatttgagcacgtcctcctccagatcgatgtcaagtgtggaagtcagaaaccagcgagaggcatctaagagttcagagacaaccgcagacaaacatgaggagattaaagttttatccctagaagaaatagagatggtcattaatagtttacactcagatattacccctacatgggttccgatacctttagtgacaactagtggagtagaaggcaagactaatgataagttggtctactataataaagatttagatttatactgttctgagctgccattgatctctaacttgaattttgaatcagaacttgaggctaatcgtgataccaaatttccaacacatgatcacttagtgagtttacaaccaaaatatctaaagacaataacagccccaagtcctagaacgacacctagttctgatataccagcagatatagatgatgctgcctctacaaataaatctgaaaaggatactaacgatcatgggaatacagataatactgaggcaaaaaaatatgaaaaggttgagaagaacgagaagaatgaagaaacagacgggcataaaaaacaacacagttcacatgtgaagcagcctgtcatgtcaagaagtgattggttttatcagttatccaaggatattacgacttggtcagaattgcatgatttaacggcatattatgccaaactggcacacagaatgtttctgtcggacaacaaatataacttcatgaaattttttgatttgacttctaattatattacatttatggtattagcatgcaggcttattcaaaatcaagaaaaattaagaaatcttcccaaggatataaagaaagtattcaagcatatgatcacttctttgggtaaaataaatatcaactcgagattatttttcgatgcatccctccgcaagaaatatcaattcactggtgtggaatctttggcaaataacactcagaatcaaaatatcgataataatgatgatgctgctgctgcagggaaagcccgtgaggatatatttgagaatagcccaaatgcaggagacagcccacttgctggtaagagaaatgtaagtacgagcacgacagatacattaattccgtaccacaaaaatagcttaactacagaagaagatagcggaaataacagtgatctgatttcaccttcttatattgatgcaaatcagttttatgctcatagtttatccaactatcaaaggaactcagtcacggcaagtaccccacgaacatcaattcaaagtactggtataaactcttcggcagccacaccaacagcaaaggaaaatataccaaaatcattaacaaaaactatttatgacataattgacaccgagttcaatagactgttcaagcatattcaataccttcatcatatcctacaaatgtcggtaattaatggtgatgatgccttaccacagctattaccaagattcttgaagtcatcttttaatggaggatcgtggaataatcctttttctagctttatttctagtgactcgactattaatcaaaagaatagctcacattcaagtactaggaatagcaacaatgatattttgtcgagatcgcataattcttcattatcggcaatccaaggaaagttaggtgattcgtttgcttcagctgctggcagctcaggttttgtaaatgataacccattaatgcatagtagttcagccggtaatttacctcctttggcatcagcaccctccttcgttaatagttcaaagggaaatcccgctagacactttttgagaaatagaccatccaagagacggtcaagatatccgttaaataatgagacattggcgacaatgaatagaatctcttctcagatatatgatagactaaacagcctaaacggtgagcacttgaatatcatgaatcagccaaagacgaggatgagaaaccttgaaattaattctagtatttatgaacaagtgaatcaaaataatttaatgctggaaattcttgagaatttagatttaaccattttcataaatctgaaaagattaataaaggctccaccctcaactttagatccagaaagccaagagtttttgattcacgctatgtcttcaatatcttcagtattgatagagttttttgatattaagcaggcatttcatgatattgttatgcgtttaattatgacctcccagcaaactacattagatgatccatattcttttgcatcaatgagatcaaatttgattgttggatactatgaacccatgaaacgaactaatactattggaatgaaaagcttcaatcaaagaaagactgataaacatgctgcagaattgtataaatcattagttagtcaagatgttgagtttaatgacctgaacttcttgaataactctgatgatttcatagatgcgtgtgaaaaatatgttgagattgcaaacctatcttgtatcgttgtcgagcaactaacagaagagcgtgagaatttattgaattatgctgcgagaatgatgaagaatagattgactaccgaacttttaaagggtgaacaagaacgctggtttgatatttattctgagaataactctgacgatgaggatgaattaccccgtgaaaacgaggcaggtgaagaaaatgaagcacaaaaagaagtatcaggacaagtaactgaattaccatggtttctgttgccggaatacgaagatgatttgatctacgataccaaaggtaaaattcgtggtggaacaaaggttgcacttatcgaacacctaacgtgtcatagtattatcgatgcaagtttcaatgttacattgctaatgaccttcagaagttttatgactacaagggaattcttttatgcattgatttatagatacaacctatacccgcctgaaggtttgagttttgatgagtataatatctggatagaaagaaagctgaatcctgtgaaatgtagagttgtgaatattatgaaaacctttttgactcagtactggacgcccaaatataatgaatcaggcgtaggtgttattgttagctttgccaagatggccatatcagagaaaatacctggttccgacatactactatcaaaaattaatgaaaacatttttgggaatgatgctcaaacaccattggaaggtgagaatcctttgaattcccttcaatctgttggcctgccaaccaagaataatgttgaacaaactgctgttaaattgcatagctcaatgaaatcctctgacttattggatattgatccgtatttatatgcagcacaactgactctaattgaacatgacttgtatctgagaataactatgtttgaatgtttagacagagcttggggaaataagtactgtgatatgggcggctcacctaacattacaagatttattgcgaatgccaatagtttgaccaattatgtttctttcacaattgtcaaacatgctgatgttcagaaaagagctaaattaattcaatatttcattacagttgctcagcattgtaaagagttgaacaatttttcatcaatgaccgctatcgtttcagccttatattcttcgcctatttataggttgaagcaaacatggaatttagtaccaaccgaaacaaaagaagtgttagataacttaaacagtttgatggactcgaagagaaattttatcaaatatagggaattactgagatcggttaaggatgtcgcttgtgttccattttttggtgtctatctatcagatttaacattcacattcgcaggtaatagtgattatcttgatggaaaaacagatataattaatttcggaaagcggtcgaaaattgcaaatattattgagggcattttgactttcaagaaattccattacaagctaaagaggctagatgatgtgcaaactggaattgaagagggattagaaggcgttcctcatatagagaagcaataccaactatctctgcagattgaacctcgtccggaaaccacaaaaactggtaataccagcggacaccactcccatgatagacttaacaaaagtagtaatccagaatacgcagaggaaaaaccacaacctttcataaactttaggcgaaagaaacaaacctctaaattctttggataa

SEQ ID NO: 8519 - protein, 1564 aa, Candida glabrata CBS 138
MSSESLAQDGHELTTVYPMDVVVVQFEFNAGNKKEKYLSMQPGDTVYVLAKDQSGWWDGLIIDEKSDKAVRGWFPQNYTKPLRDHHRLFGKRSSSRSSRRSSFNSTSRPSVAMNVIGGNAGTGDGGSIGAYLNVVNSRNSMSRRGSSHLAQSSTSPMLMTSTSGSLERTNSMPHNALSPRMKGQDNARSSSVISHKPNLSTSSSRSMSSVEVRNQREASKSSETTADKHEEIKVLSLEEIEMVINSLHSDITPTWVPIPLVTTSGVEGKTNDKLVYYNKDLDLYCSELPLISNLNFESELEANRDTKFPTHDHLVSLQPKYLKTITAPSPRTTPSSDIPADIDDAASTNKSEKDTNDHGNTDNTEAKKYEKVEKNEKNEETDGHKKQHSSHVKQPVMSRSDWFYQLSKDITTWSELHDLTAYYAKLAHRMFLSDNKYNFMKFFDLTSNYITFMVLACRLIQNQEKLRNLPKDIKKVFKHMITSLGKININSRLFFDASLRKKYQFTGVESLANNTQNQNIDNNDDAAAAGKAREDIFENSPNAGDSPLAGKRNVSTSTTDTLIPYHKNSLTTEEDSGNNSDLISPSYIDANQFYAHSLSNYQRNSVTASTPRTSIQSTGINSSAATPTAKENIPKSLTKTIYDIIDTEFNRLFKHIQYLHHILQMSVINGDDALPQLLPRFLKSSFNGGSWNNPFSSFISSDSTINQKNSSHSSTRNSNNDILSRSHNSSLSAIQGKLGDSFASAAGSSGFVNDNPLMHSSSAGNLPPLASAPSFVNSSKGNPARHFLRNRPSKRRSRYPLNNETLATMNRISSQIYDRLNSLNGEHLNIMNQPKTRMRNLEINSSIYEQVNQNNLMLEILENLDLTIFINLKRLIKAPPSTLDPESQEFLIHAMSSISSVLIEFFDIKQAFHDIVMRLIMTSQQTTLDDPYSFASMRSNLIVGYYEPMKRTNTIGMKSFNQRKTDKHAAELYKSLVSQDVEFNDLNFLNNSDDFIDACEKYVEIANLSCIVVEQLTEERENLLNYAARMMKNRLTTELLKGEQERWFDIYSENNSDDEDELPRENEAGEENEAQKEVSGQVTELPWFLLPEYEDDLIYDTKGKIRGGTKVALIEHLTCHSIIDASFNVTLLMTFRSFMTTREFFYALIYRYNLYPPEGLSFDEYNIWIERKLNPVKCRVVNIMKTFLTQYWTPKYNESGVGVIVSFAKMAISEKIPGSDILLSKINENIFGNDAQTPLEGENPLNSLQSVGLPTKNNVEQTAVKLHSSMKSSDLLDIDPYLYAAQLTLIEHDLYLRITMFECLDRAWGNKYCDMGGSPNITRFIANANSLTNYVSFTIVKHADVQKRAKLIQYFITVAQHCKELNNFSSMTAIVSALYSSPIYRLKQTWNLVPTETKEVLDNLNSLMDSKRNFIKYRELLRSVKDVACVPFFGVYLSDLTFTFAGNSDYLDGKTDIINFGKRSKIANIIEGILTFKKFHYKLKRLDDVQTGIEEGLEGVPHIEKQYQLSLQIEPRPETTKTGNTSGHHSHDRLNKSSNPEYAEEKPQPFINFRRKKQTSKFFG

SEQ ID NO: 8520 - DNA, 4614 bp, Kluyveromyces lactis NRRL Y-1140
  CDS (1)..(4614)
atggaaaggccacaggacgagggaatgaatcctccaaaagctggattgtctacaattataaaacctttggacatagtgatagcgcagtatgactttaatccgctaaggaaatctcaattacggttttttgccggtgatattatctacgttatatcgaagagtgactcaggttggtgggacggtattttatattataataagagcttggttttgaggggctggttccccagaagttatactaaatcaataaaggataccagttcaagtcggaagatatttcctctgaattaccatggcagcaatgcttttaataataggcctagtagccatgggtcacggaggaacagtttgaggataggcagcccatctgggaatatgaatattcgttctacgtctgggtcaagaaggggatctttggtgagtaccgggaactttagaaggaaaagtcttggtacgactactttccacgataatcatgataatgcaataaatagtgggcaaacgctactgtcgacgtctccttcaaattctgcaagtagtgtcaataattctagcccgtcatcgcatttgaaacaggattaccaattcgatatgaatcgcagatccttctctcactcaaggagcaaaccaaatgcaacctccaaatcaagaagtgcatcaactagcagttctcgaaactcttactgtcgttcatctgaatctttatccaaagcgcggtctcattcagaatcccgtaactcagatcattcatacagtaaacattctgtatcgtcaatacggtccccacatactcttcatgagtcagaaatcaacattctttctactaaagaagttgaaatgctcttaaataacatgtcaagacaagaggttgtgccggtatggaccccggttttgactacaagcaataatttattatacttcaataaagaaatgaacatttattgtacatctttacctatatcaaggacacctgaactaagcttaaaatctgttttcccgcctaatgaaaacctggtcgacttacaagcaagaagcctagaatcagactttttgcctaatactcaagtgatggatctggaatctgtcatttcttctcagcaccgtaacttacatgatgcgagtcccattaatccaatggttgtcatcagtggaaactcttctcaaaagcaaccaaatacaccatctggtccaaaaccagacctaagtcaaccctgtccatctccaggtcgatcacccagtatgcattcaaatcctacgcaatccaatgaaaaaaatgaagaagcaggtccgaaaaactcacagccacttgctcctaaaccattaccgcaatcgaatagtagaatgttttattcattaagttctgacatgaaaacgtggacggagttaaaaaactccactatctattatttgaaagcttcacataaccatttcttcaaacaaaaccaaccatcattttatcagaacttttcgaaagcgtcaacttacatcttttaccatcagttggcctgtaacttagcgagaaaagaacttatcaaaaggaatgttgtaaaggatattaggaaaattttgagaaagttgattaaggtcgtcttcagaatcaacgtaaatgcttcagtatatttcaattctagtagcaaaatcgttatgaactcctccgacatcaagaaattcaatggagacatgctgacttcgaaccgcgatactttgaataatggcacaagaacttctgaagcctttgtcttacctaacaatattgagtttcctgatttaagaaatgttagtactagtaccacaacttcttttaatcctaacgcaagcttagatagctcacatcaaggaactatgacgtcagaaactattcagatcagcccagattccccaagagcgtcaattccaactaatacaactcaaacatcgaatatgctcatcgacgaggagacaggtattgttttgaattctctctttaatgtgatacacactgacttcacaaatattttcaaacttgtcaacaaccttcacaacattatcattgattctgtttcaccggatgatgcattagttcagatatacccaagatttataagaaactcctttgagggtatagtgtggaccaaatcagatccttcatttgcttccaaatctgaagattcgagtgatatttccaacaaatcggaccaggggaatgcgagctcctcattttttccagagtctctttcgagtcttatgttttcaggaaggcagtacagtagttcaagttctagaactgtcaactccaatttagaaaagcaaaactcttcgggatcaataggaaaaatacacaacaaattacgtgcacggtcaaaaggttctaaacctgccaggtaccccttaaatcatacgactttaaatcttcttagggacaagctatccctgatcagcaatatctacaagacggacaattcagcgattttaagttcagttgacggcggaaaattagtcgaactcagtatgggaacatataatggtttgaaagaatccgctgcttttctcaatataattgataagttggacctacaatttttctttaacttgaaacgttgccattctaatgaaaacctcgaaaaagaatttcacgagttcagtgaatcatccatgactaacgcagttcctattctcctagaatattatgatctaaagcaggcgttgcatgacattacaattcgttatgtcatggacactcaaaatctttcactcagagatccatttgtcttctgctcaatgcgaggagagctttctcagttctcaaaaggtagtcatgcagaattgtttcaattagtacaagaggaaaagaagagtaatagtttgtatgaacatcttgtatctcaggatgtagaaatcaacggcatgtcatttttggatacccaagaagtacttcatgaagcagctacgagatattacaacattgcgactttaatatccgtgattatcgagcagttgattgtagaaagagaaaatgtgataaattatgcagcaagaatgatgaacaatgactttatggatgttctactcaaagatgaacaatacgaatatgatgaaaatctttcttcttctgtaaccatctcacagaccatgagtgatgaccaagaaacgcaacaaagttccaaggcgtcgatgtttttgtcttcgaccttggactcgaaatcaccaacgtttttgcagcattctttcgtagatgaactaccttggtttctcgattcggagcatgaaactgagcttatttattcccctaacggtcatatcaaaggtggaactagactggctcttattgaacatctcactaatcacaaatcgatcgatgcgttctttaatattgtcattctaacaacttttagaagtatgtttagcacagctgaatttttgaggtacttattcaagcgttttgatctttcccctcctgaaggtttaagttatgaagagtataatgtatgggtcgatagaaaacagaaaccaatccgaattcgggttatcaatattataaaagcatggctcactgattattggaatgattgctattatgaagactcacaggatagcttggatgagctgaatactgtagtaaacatggcaattttggatgaaatttctggtgcagctgaattgaggcctctcgttgaacgaaaaatcgctgtaaatgaattaaagctaaaacgcaaggattatgagccgaaacctagtcctactcctccaccagctttgaaaaatggattatcaaagacatcagctacttttaggctgagaaagcataaactgacagattttgatcctattacgtttgcacaacaattgactttggaagaacatattttatactctgctatcgaccaatttgaatgtttggaccgtatttggggtaaaaaagtatgcgatttcggtggttcagctaatatttcaaactttatcacgtcatcgaatcatcttacagatttcgtttcctacaccatagtcaaagagactgacctcaaaaaaagagcccaaattctacaatttttcatccaggtttctgaacaatgttataacctcaaaaatttctcatcaatgacagcaattgtttctgcattatactcatctcctatcttcaggttgaaaaagactttcgaccgtttacctaagcatattttgaattctttggataagctcaatactttgatggattcgaccagaaactttttcagataccgtgaccttttgaagactgtgcatgatgttccatgtgttccattctttggtgtttatttatcagatcttacttttacagcaagcggtaaccctgataaccttaacaataaccctaatcttttcaacttttcaaagagactgaagattgtaatgatattaaacgaaatcatgtccttccaaaaaatcacttataaactcaaacattctgaagaggttaagttgtttttagaggcagaaatggaaaatatactatccatcgaaaagcaatatgaattgagtttaaaaatcgaaccccgggtagatgtatcatcctcttttaacagtgcggaatacaacacccctaccgatttatccaaagctggtagtaaaaaattgcgatttggaagactaagaaagtga

SEQ ID NO: 8521 - protein, 1537 aa, Kluyveromyces lactis NRRL Y-1140
MERPQDEGMNPPKAGLSTIIKPLDIVIAQYDFNPLRKSQLRFFAGDIIYVISKSDSGWWDGILYYNKSLVLRGWFPRSYTKSIKDTSSSRKIFPLNYHGSNAFNNRPSSHGSRRNSLRIGSPSGNMNIRSTSGSRRGSLVSTGNFRRKSLGTTTFHDNHDNAINSGQTLLSTSPSNSASSVNNSSPSSHLKQDYQFDMNRRSFSHSRSKPNATSKSRSASTSSSRNSYCRSSESLSKARSHSESRNSDHSYSKHSVSSIRSPHTLHESEINILSTKEVEMLLNNMSRQEVVPVWTPVLTTSNNLLYFNKEMNIYCTSLPISRTPELSLKSVFPPNENLVDLQARSLESDFLPNTQVMDLESVISSQHRNLHDASPINPMVVISGNSSQKQPNTPSGPKPDLSQPCPSPGRSPSMHSNPTQSNEKNEEAGPKNSQPLAPKPLPQSNSRMFYSLSSDMKTWTELKNSTIYYLKASHNHFFKQNQPSFYQNFSKASTYIFYHQLACNLARKELIKRNVVKDIRKILRKLIKVVFRINVNASVYFNSSSKIVMNSSDIKKFNGDMLTSNRDTLNNGTRTSEAFVLPNNIEFPDLRNVSTSTTTSFNPNASLDSSHQGTMTSETIQISPDSPRASIPTNTTQTSNMLIDEETGIVLNSLFNVIHTDFTNIFKLVNNLHNIIIDSVSPDDALVQIYPRFIRNSFEGIVWTKSDPSFASKSEDSSDISNKSDQGNASSSFFPESLSSLMFSGRQYSSSSSRTVNSNLEKQNSSGSIGKIHNKLRARSKGSKPARYPLNHTTLNLLRDKLSLISNIYKTDNSAILSSVDGGKLVELSMGTYNGLKESAAFLNIIDKLDLQFFFNLKRCHSNENLEKEFHEFSESSMTNAVPILLEYYDLKQALHDITIRYVMDTQNLSLRDPFVFCSMRGELSQFSKGSHAELFQLVQEEKKSNSLYEHLVSQDVEINGMSFLDTQEVLHEAATRYYNIATLISVIIEQLIVERENVINYAARMMNNDFMDVLLKDEQYEYDENLSSSVTISQTMSDDQETQQSSKASMFLSSTLDSKSPTFLQHSFVDELPWFLDSEHETELIYSPNGHIKGGTRLALIEHLTNHKSIDAFFNIVILTTFRSMFSTAEFLRYLFKRFDLSPPEGLSYEEYNVWVDRKQKPIRIRVINIIKAWLTDYWNDCYYEDSQDSLDELNTVVNMAILDEISGAAELRPLVERKIAVNELKLKRKDYEPKPSPTPPPALKNGLSKTSATFRLRKHKLTDFDPITFAQQLTLEEHILYSAIDQFECLDRIWGKKVCDFGGSANISNFITSSNHLTDFVSYTIVKETDLKKRAQILQFFIQVSEQCYNLKNFSSMTAIVSALYSSPIFRLKKTFDRLPKHILNSLDKLNTLMDSTRNFFRYRDLLKTVHDVPCVPFFGVYLSDLTFTASGNPDNLNNNPNLFNFSKRLKIVMILNEIMSFQKITYKLKHSEEVKLFLEAEMENILSIEKQYELSLKIEPRVDVSSSFNSAEYNTPTDLSKAGSKKLRFGRLRK

SEQ ID NO: 8522 - DNA, 3933 bp, Debaryomyces hansenii CBS767
  CDS (1)..(3933)
atgtcgaagtatttggaggaaatagcgccagacgccattgctccgcatgatacgaaggaggagcttgacgaacctctcaagcatcttgatactgtaatagctctatacgacttccccgggacacaaccatcacatttaccattaaacttgggagacaccatttatgttttgacaaaatccgacagtggatggtgggacggggttattatatattctaacaatgaatatgggagaggatggttcccgcataactatgtccgattaattaattatgttcaaccggtgttgaacaagttgaaaagtaacaaggagatagattctcttacagcagccaacacggcggcgaacgttttaataccatcgtttacgaacttattacaaaagaatttaggcgaatctgagaggaactctcctgctaatagtactagaaaaaattcggtggtgagttttgccagttcggagaccagtattccatcagatcaaaaagctcagtctattttagggctgggagcttcaaatcacatcccttcagtctcagacaccttaaactcggttgaacttaaccacgaagttgtttttactgatgttgaagaggcggaacatatattagaaagttacagagacgaacatagaagaaacgtcatgtggcttccacgatacaccactggtggtgatgtggtatattattgccacgaattagacctttattgccaaactataccattgacaactttcaggtccgatattgatacatgttcggatgcggccattccaccgagagatgcaatatacgatgctactattttgaagcgggattcagaattttccccaataaatgaaatgtctgacgcgattttgacgaagacagatagtaattcgagttcatccaaagacttcgatccattgaaaagagaatccaatgcatcgtctctaaattctcaaagtacttcggccagtgcataccaccatttctcccaaccattgttctgtatggacgacttattctattatcaacccagtgatttagggtcttggagtgaattgaggggaaagttccagtattttttaaatctatcctacaaggcattaaaggattacgataagcaattattcagcactcatttctcgagattgaacaaaatcatatcgtttgttgtaagcgctacaagattagtccaggaggactttgttggaacgaaatacgaaaaatcaataagaagaaaattgaaaagaatattgagctcttattcacaaatatattcaaatggacttttgcatttgagtgtaatgtattatgacaagaacgtaccagaatcaagattgtttagcttcaatctttccaaatttaaagctagggcagcaagcacggctcaagacagccccacatcatctatttcgaccataaaacaagacccggaagaccattatttcgattctaacaaatcgtctaagaaattatctaggagtgatagtagttttatttcatatttgcaacaaattgaatttgagattgataacttgaagtatgatatgaacgcattgataaaggtatttcgaaagttaagtattggcaaaagaattaagaagagcgattatgatggctctgatccttctggagatgaaggagaggatcgttatgacattttaccccaagtatatcctagatttatcgctgacgaatttaatggtggaaattggtgcaatccgttttttgagagtaagaatacagttttaaatgctagtggagatgaattaaagaacagataccatctgaaaataattatagatcgtgatgcatttgaaactatcagaagctatacggaagagatggttaagttgagtgaggaaacatttgaatatatcgatcccaaaatacaacatttatattacaatttgattttgaaaaatgaaagaaacacccagattctcaggcttatatacaaatatttatattttgcaagtctgatggtggatatgatcgaatcatttgattttactgtcttctgtttgattcatagatatgcttcgtccgaggacgatgccgacaaagttatgagtgaatttaaagcttcacaactagaatctgagtcagaaattaccagtaatttaacctttgactatccggtagttcttgagttcttccaattgaaacaacagtttcatgatataatttcaaggattgtaatggcaacacaatcgttgacccttgaagacccggatgtttttaaaggaattaaacaagaggatccattgtattatgatcgtgatattctaaaagatccaaacgaaaaggcagcgatgttgttatctaatatattaatggaacaaaataataatgttaaagggaagtcaatttcgctaaattgtgattctttgatgtatacatatttaactgatggctttagattatttgaatcacttttgcctattattcagctgttaattgaagagagagaatctatattaaactatgccacaagagttatgcacaatgacttgaatgttcaattattattaatggaaagaaataataccgttctatcagaaaagtcagacgaaggccacgcgtattatgcaggtaaaaaacaatcagatgctccttggtacttagaaggggatgatgaatatgatcttttgttagatattaaaggaaatattaaaggtggtacaaagcaggcgttaatagcgcatttaacacatcatgattactttgatagtaatttcaatagtgcgtttttattgacttttgcgacaataatgccaataggtgaatttgtagacttgcttataaatagattcaacttggaagctccagagggattaagctacgaggaatataatacttggatatctaaaaagcaaagtccaattagactaagagtgatgaatgttattaaattattgatagaaagatattgggccaattcatactacgacgagactgtgcttagtaaattgctatcattcgctcagggtcctcagattaaacttttttctgttagtaaggttttgcagagtcatttacaaagtttattgaatcatgagaaggtatgtttcgaacaagagccaagtattcctacttctaaacctccaccgccgttaattaaaggttacccgatgaaaaagacaaaattattagatatcgactatattgaacttgcaagacaattaactataaaagaatttaaattatattctaagataacgaaatttgaatgcttaactaaagtttggggaaacaaatcaggactccacgaagacattctgagcatcacaaactttattagaacatctaatcaattaacctatttcgtggcgtacatgatattgagaaaacaagaggtgaagaagagagttcacctaataacctatttcgtacaagttgcagaaaaatgtaaacagtacaacaatttctcttcaatgactgccattatttcagcattatattcttcccctatccatagattgagtagaacttggaagcatgttcctattgaagccttgactaatttaaggaatatgaataagttgatgaattcttcacggaatttcaatgagtatagagatgtgttaaaatttgtcggatcagagccttgtgttccatttttcggtgtctatttaagtgatttaacattcgtttaccatggtaatcctgactatttaatgaatagatccagaatgattaactttgccaagcgtgcgaaaacttgtgaaattgtaactggcattgatagattcaaaagcactgcttataatttacaagaagttgccgaggttcaggaatatcttctttcttggtttgacaaatgcccaactatagaggaacaatatcaattgtccttaaatttggaacctaggataaatgtccatggtaacaatgctgcaagaaatcagaaatattcatcgggaacgttttcattcgggaaacactag

SEQ ID NO: 8523 - protein, 1310 aa, Debaryomyces hansenii CBS767
MSKYLEEIAPDAIAPHDTKEELDEPLKHLDTVIALYDFPGTQPSHLPLNLGDTIYVLTKSDSGWWDGVIIYSNNEYGRGWFPHNYVRLINYVQPVLNKLKSNKEIDSLTAANTAANVLIPSFTNLLQKNLGESERNSPANSTRKNSVVSFASSETSIPSDQKAQSILGLGASNHIPSVSDTLNSVELNHEVVFTDVEEAEHILESYRDEHRRNVMWLPRYTTGGDVVYYCHELDLYCQTIPLTTFRSDIDTCSDAAIPPRDAIYDATILKRDSEFSPINEMSDAILTKTDSNSSSSKDFDPLKRESNASSLNSQSTSASAYHHFSQPLFCMDDLFYYQPSDLGSWSELRGKFQYFLNLSYKALKDYDKQLFSTHFSRLNKIISFVVSATRLVQEDFVGTKYEKSIRRKLKRILSSYSQIYSNGLLHLSVMYYDKNVPESRLFSFNLSKFKARAASTAQDSPTSSISTIKQDPEDHYFDSNKSSKKLSRSDSSFISYLQQIEFEIDNLKYDMNALIKVFRKLSIGKRIKKSDYDGSDPSGDEGEDRYDILPQVYPRFIADEFNGGNWCNPFFESKNTVLNASGDELKNRYHLKIIIDRDAFETIRSYTEEMVKLSEETFEYIDPKIQHLYYNLILKNERNTQILRLIYKYLYFASLMVDMIESFDFTVFCLIHRYASSEDDADKVMSEFKASQLESESEITSNLTFDYPVVLEFFQLKQQFHDIISRIVMATQSLTLEDPDVFKGIKQEDPLYYDRDILKDPNEKAAMLLSNILMEQNNNVKGKSISLNCDSLMYTYLTDGFRLFESLLPIIQLLIEERESILNYATRVMHNDLNVQLLLMERNNTVLSEKSDEGHAYYAGKKQSDAPWYLEGDDEYDLLLDIKGNIKGGTKQALIAHLTHHDYFDSNFNSAFLLTFATIMPIGEFVDLLINRFNLEAPEGLSYEEYNTWISKKQSPIRLRVMNVIKLLIERYWANSYYDETVLSKLLSFAQGPQIKLFSVSKVLQSHLQSLLNHEKVCFEQEPSIPTSKPPPPLIKGYPMKKTKLLDIDYIELARQLTIKEFKLYSKITKFECLTKVWGNKSGLHEDILSITNFIRTSNQLTYFVAYMILRKQEVKKRVHLITYFVQVAEKCKQYNNFSSMTAIISALYSSPIHRLSRTWKHVPIEALTNLRNMNKLMNSSRNFNEYRDVLKFVGSEPCVPFFGVYLSDLTFVYHGNPDYLMNRSRMINFAKRAKTCEIVTGIDRFKSTAYNLQEVAEVQEYLLSWFDKCPTIEEQYQLSLNLEPRINVHGNNAARNQKYSSGTFSFGKH

SEQ ID NO: 8524 - DNA, 6043 bp, Candida albicans
  CDS (1513)..(5514): transl_table=12
gatcaacgacaattccatatgcttgattttcaatctcaccaataagaaatatattttacctattatggcatctttaagggaaaacctggaccgtgatactcaaactcaatgtgcaaacaattctcaatccctacgtccattttcacactgtgggattcattcctttttgatatagtacttcccttgctagtattagcactggcatcatcattactggatggcgtagcaggcttttgtaaagtatcttcattggctttcttagcacccaattttgaatcggctgtagagctactgctcaatccggttaccggttaccggtttgggaactgctgtggtgtaatgatagacccacaattccttttccctaattatctccgaagacgactttctcaacactgttactttaatgtagtatcttagtctgacattcttgccacgataactttcatactgtttctcgacattcttaaattcaaaaggatacgattcaggatgcgacaattgtgctggagcggctagttccgtggctaatgttaaaattccgacgacagtattccgtcagtattagtttcgatggaccctaacaattgcactctaacaccaagatgttccaatttccttccttccttagtacgtaacgtaaccacacctttcactgattcaccatccttgtaaatagggagcttttcaactcttcttgcggagttttcacttcaacgtgcttccgggtatcctcattatctaacctaatttcaatatctaatggcgccttaaaaaatatcgacatagtagcactttaaagaagaaacaaacacacacacacacacttgtattgatgtatatgaatataaataatccaatatatctctcgtcaaagttttgtttcagattctccaaattcgtcaaaagtgatgaacacactatgttgtttcgtttgtcttgattttgttgttattattctttctctcactcgtttgtccgtgagaaatagacactacctcaaaccattttgtccttgttcagatcttttctcgcttatccgtttttctctcacgcttttctcttccttcccccccctacaattgatagttgcaagtttgaatcacagtaacaaacaaaaaacaaaaagagaaagagaaaaaaaaaagtaagacagtccaaaatacagcattaaaaactccttaaagtaactatctgttggttggttagtagtcaccttttcgttcatgtcaaacaattgatacattcacttaaagtacaacatttttatttatattaagttaaatttacactgtcagcaatttatttgattacattttaaataccactccagtacaaaacctacagccaaatcaattggccaatatcacaccaacacataccaactccctaatatcatcatatatcctttttttttggagcttgtgttgatacgcattgtacaaatataaggatagcttaggatacagttatataaatatataaacacatatttggtctcctttgccagtcatgtcatcagcaaattacatatcagatgaggtgccaccagatatggtttccccgcatgatcatagaccttcaaaagatgaacctttgaaacatttagataccgttattgcactatacgatttccctggaacccagtcgtctcatttaccactaaacttgggcgacactattcatgtcttgtcaaagtcagcaaccggatggtgggatggggtagtaatgggtaatagcggggagcttcaacgaggctggtttcctcataactatgtacgatcggtgaactatgtgcaaccggtgttgaaaaaactaaaagataataaagatctcgattcgataacagcggctaatacagctgctaatgtggtgatgccatcattgactaacttgattcaaaaaagtttacaagaatcagaacgcaatagtcctgcaaactcaacaagaaaaaactcggtggtgagttttgctagctctgagacaagcatgcccagcgactcaaaatatacacaacaacagacaaacacaaatcaaaactcacctgaatatcaactgatctcattaccatctactcgagatcacagcacggtggagatgcaaccaccttcgcagcagtcttcgatttcacacactttaactggatttggaattggtgacgacgaaatcattcctatggaagtcgaggaagcagagaaattggtggaagagtacagactcaagtataacaaaacagttacctggattccacgaacatcaaccaagggagatataatcttttactgtgaacaacttgatgtgtattgtgaatctctacctttgattttgtttgatggagaggcgtcgctgccaaatttggaatacccggggagcgatgtaatcatggatcccaccccaatttcagttcaaggttctcaatcgatggaaaatgtcttggatactcgagaaggatcagctgcaggctcgtttgattctactaagcgtgattctaatgtgtcgatgagcactcaaagctccgggtcatcgtatcatcgtttcagtcgaccttttttttctgtggacaatctattctacaagcattcgtcggacataggtacgtggaatgaactaaaggaacaatgcaattatattttggatttgatgttgaaggccattaaagatcaaaataggcagtttttcagcacccatttttctcgcttgaataaacttgtggtggctttgtgtgccgcagtcagattgaatcaagaagactatattgatactaagtatgagaacactacaagaagaaagttaaaacgtgtgtgtgcctcatttgcccaaatttacataaacggtattttacatctaagtgtgttgcattactctcttgaagggtttaatgaaggtcgtttgtttggctacgacatgggaaaattgaacagatccagctccagcagtgcattccaatcgccagcatcatcactatcaacaatacgacagggttcagatgatagcactcgttttgctcaaaaattgagccaggacaggaatagtgaaggaaatggtgatatgaattacattaaccagttggtttacgaaattgataatttgcgtgagaatgtcaattccattgtgaaaatatttcttaagcttagcgctaataaaaaaattaagaattcggactatgattcgtcggatgcatcagatgatgaaggtgaagatcggtttgatattttgccccaagtatatcctcgttttttggttgacgaatttaatggtggcaactggtgtaacccatttttctccacgaagaataccgttttgaatgtcagtggagacgacttgaagaatcgctaccatacaaaaattataattgatcattccgcttacgattcactttcccagtatgtcgacaagatagttgatgcatgtgaaaacattttggaagctcttgatcccaaagttcaaaatactttttattataatgagatgctaagaaatgaaaggaatacgcaaattttgcggttaacttataagtcgctttaccactgcagtgccatggttgacttgatagaatcgtttgacttcactgtattctgtagtgtcaaaagacatactggtaatgcaattgatacggaggatgaaagttatgaaaatccaagtgtttggggggatcactatgattctaatttatcgtttgactacccagtcgttttagagtttttccgtttgaaacaggaattgcatgatttggttgcaaagatcatcatggcaacccaatcgttgactttggaagatcctgaagtctttaaaggtttgaaagaagaagatcctttattctataatcgtgaaatatcgaaaatacctaaggaaaaggcagcgctattgttatcctctattttgaaagaacaacttagctttaaagatggaggagctatatcactaaacccagacacattgttgtcagggtatttagtagagatagcgaagactaccaaaaccgtactcttgataacgcaacaattaattgaagaacgagaaacaataatcaattacgctacacgagtgatgcaggacaacttcgatgtgcagttattacttgttgaaagaaacaatacgtcgtcgtccgaaaaggcggatgataactcatactatgttggcggtcataaaaagtcaactgatgtcccgtggtatttggaaggtgatgacgagtatgaattattgttggatgtgaagggaaacatcaaaggtggctcaaaggaagccttggtgtcgcacttgacgcatcacctttcgcttgacagtaatttcaatgcggtatttttattgatgttttcttcaatgatgctgcttggggaattgatatctttactaattgctaggttcaatattgaacctccagaagggttgagctacgaggaatataacctatgggtctcgaaaaaaaggaaccctattcgcttgagggtgataaatattatgaaacttttacttgaaaaaaattggtccatgtcgtattacaatgaacctgtacttcgcaggtggttgacgtttgctcactccgaccaagttcagacttattcattgggaaatttgcttgttaattatttagaaaggctacttcgtggtgagagaatttatgtcgaaagagatcctgtcattccaaataccaagcctcctgccccattgaccaaaggctcgtctttgctgaaaaagccaagggtaatggacattgattatgttgagttggcacgtcagttgacattacgtgagttcaaattatattgcaagatcacaaaatttgcatgtctagcgaaagtttggggtaagaagtcagggctcagtgagagcattgatagtatcactcagtttataaaggcttccaatcaattgactaactttgttggatacatgattttgagaaaggcagatccgaaaaaaagagtccaaatcattcgttactttattcaagtagccgataaatgtcgacaatacaacaacttttcgtcgatgacagcaatcatttccgctttgtattcttcaccaatccatcgtttaaagaaaacgtgggagtacatgaatgctgatgcattgtccaatttaaagaatatgaataaattgatgaattcatcgcgaaacttcaacgagtatcgagatgttttgaaatttattggatcggagccatgtgtgccattttttggtgtgtacttatctgatttgacatttgtttaccatggtaaccctgactatttgtataacagaacaaggcaagtgaattttgctaagcgtgctaaaacctcagagattgtttcgggaatagaccgtttcaaaactacagggtataatttccaagaggtccctgaaattcagaagtttctcgatgcatggtttgaaaagtgtccaacgatcgatgaacaataccagatatcgttgaacttggaaccaagagaacaaccagctggtgccagtaacagtaatagtactacaaacgccaccactaatatcaagagtttcaaaccgttttcattaaagtagtatttgctaagcatagtgtttgtacagtagagcgaatcaataaaaacgtaaaatttattcactcttatccttccttttctgttgaagaactacagacttctaatacacaatgtgaataacaaaaatgagtaatcctaaattaataaaggtaataatagaaacataatactataatataataacgaactaaagtacaaaaaaaaagtgggcaactaaaaatacaattgggagacaatacaagatccatcacatctaactagaagcagatgagtattttgtgacggctctggtaccttcggaaacggcatgtttggccaattcacctggcaaaattaatctaacagcagtttggatttctctagcggaaattgtggattttttattgtaagcagctaatttggaggcttcggtggcaattctttcgaaaatatcgttaacaaacgaattcataattgacatggccttttgggagataccagtgtctggatgtgtttgtttcaaaactttatatatatagagggaataattt

SEQ ID NO: 8525 - protein, 1333 aa, Candida albicans
MSSANYISDEVPPDMVSPHDHRPSKDEPLKHLDTVIALYDFPGTQSSHLPLNLGDTIHVLSKSATGWWDGVVMGNSGELQRGWFPHNYVRSVNYVQPVLKKLKDNKDLDSITAANTAANVVMPSLTNLIQKSLQESERNSPANSTRKNSVVSFASSETSMPSDSKYTQQQTNTNQNSPEYQLISLPSTRDHSTVEMQPPSQQSSISHTLTGFGIGDDEIIPMEVEEAEKLVEEYRLKYNKTVTWIPRTSTKGDIIFYCEQLDVYCESLPLILFDGEASLPNLEYPGSDVIMDPTPISVQGSQSMENVLDTREGSAAGSFDSTKRDSNVSMSTQSSGSSYHRFSRPFFSVDNLFYKHSSDIGTWNELKEQCNYILDLMLKAIKDQNRQFFSTHFSRLNKLVVALCAAVRLNQEDYIDTKYENTTRRKLKRVCASFAQIYINGILHLSVLHYSLEGFNEGRLFGYDMGKLNRSSSSSAFQSPASSLSTIRQGSDDSTRFAQKLSQDRNSEGNGDMNYINQLVYEIDNLRENVNSIVKIFLKLSANKKIKNSDYDSSDASDDEGEDRFDILPQVYPRFLVDEFNGGNWCNPFFSTKNTVLNVSGDDLKNRYHTKIIIDHSAYDSLSQYVDKIVDACENILEALDPKVQNTFYYNEMLRNERNTQILRLTYKSLYHCSAMVDLIESFDFTVFCSVKRHTGNAIDTEDESYENPSVWGDHYDSNLSFDYPVVLEFFRLKQELHDLVAKIIMATQSLTLEDPEVFKGLKEEDPLFYNREISKIPKEKAALLLSSILKEQLSFKDGGAISLNPDTLLSGYLVEIAKTTKTVLLITQQLIEERETIINYATRVMQDNFDVQLLLVERNNTSSSEKADDNSYYVGGHKKSTDVPWYLEGDDEYELLLDVKGNIKGGSKEALVSHLTHHLSLDSNFNAVFLLMFSSMMLLGELISLLIARFNIEPPEGLSYEEYNLWVSKKRNPIRLRVINIMKLLLEKNWSMSYYNEPVLRRWLTFAHSDQVQTYSLGNLLVNYLERLLRGERIYVERDPVIPNTKPPAPLTKGSSLLKKPRVMDIDYVELARQLTLREFKLYCKITKFACLAKVWGKKSGLSESIDSITQFIKASNQLTNFVGYMILRKADPKKRVQIIRYFIQVADKCRQYNNFSSMTAIISALYSSPIHRLKKTWEYMNADALSNLKNMNKLMNSSRNFNEYRDVLKFIGSEPCVPFFGVYLSDLTFVYHGNPDYLYNRTRQVNFAKRAKTSEIVSGIDRFKTTGYNFQEVPEIQKFLDAWFEKCPTIDEQYQISLNLEPREQPAGASNSNSTTNATTNIKSFKPFSLK

SEQ ID NO: 8526 - DNA, 5398 bp, Saccharomyces cerevisiae
  CDS (313)..(5082)
gtcgacgtcagtcacctccaggttattatgtaattcgctaaaacgacttttaaacatcgcgggagacggatctttgacagagacctggaggaaaaaataaaatagaaaaataagctcaaaagttacagagaaaactgcatcaccaacacggcggagacagttatagtgacttgatcaccgtgaagcaattcctttagttagatagactgtttctttttcggaaagaaattgaataaaaagagccacatttttcttcgaataaatactaaaaaataaaacgaaaaagcaaggtggatattggatagttgtatcatgtccgatactaacacgtctattcccaatacaagttctgcaagggaggcaggcaatgcttcacaaactccatcgatcagctcttcatctaacacttccactaccactaacacagaatcatcctcagcttctctttcttcttccccctcgacaagtgagttgaccagcattcgtccaattggaatagtagtcgctgcttatgactttaattatcccattaaaaaagacagttcttcgcaacttttgtctgtacaacaaggggaaaccatttatatacttaacaaaaactcatctgggtggtgggatggattagttattgacgacagtaatgggaaagttaacagaggctggtttcctcaaaacttcggtagacctttaagagacagtcatctcagaaagcacagtcatccgatgaaaaaatatagttccagtaagagctcaaggcgcagcagcttaaatagcttgggcaatagtgcatatttacatgtgcctagaaatccgagcaagagcaggagggggagttctactttatcagcgtctttatcaaatgcccacaatgcagaaacaagttccggccacaataacaccgtatcgatgaataattctcccttttcagcgccaaacgatgcttcccacataacccctcaatcttcgaactttaattccaatgctagtctatcccaggatatgacaaagagtgcagatggctcatctgagatgaatacaaacgcaattatgaataacaatgaaacaaatttacaaacttctggtgagaaagcaggtcccccactagtagcagaagaaacaattaagatattaccgttggaagagatagaaatgattattaatggtatacgttcgaacattgcttcgacttggtcccccataccactgataacgaaaacatccgattacaagttggtatactataacaaagaccttgatatatactgttcagaattacccttgatttctaactcaattatggaatccgatgacatttgtgacagcgaaccaaaattcccgcccaatgatcatcttgttaacctatatactagagatctgaggaaaaatgcgaatattgaggacagttctacgagatcgaagcaatcggaaagtgaacaaaatagatcaagccttctaatggaaaaacaggattcaaaagaaactgatggaaataataacagtattaatgatgatgataataataacgaaaataacaaaaacgaattcaatgaggctggtccttcatcattaaattctttatctgctccagatttaacgcagaatattcaatcaagggtagttgccccaagtcgctcttctatactggccaagagtgacatcttttatcactattcaagagatataaaattgtggacagaattacaagacctaacagtttattatactaaaacggctcacaagatgttccttaaagagaatcgtctcaatttcacgaaatactttgatttgatatcagattcaatagtcttcacacagttaggctgcaggctaatgcaacatgaaattaaagccaaaagttgcagcaaggagattaagaagattttcaaaggtctaatctcttcattgtcaaggataagtatcaattctcatttatatttcgattcagcttttcacagaaaaaaaatggatactatgaatgacaaggataacgataatcaggaaaataattgttctaggacggaaggggatgatggtaaaattgaagtagatagtgtacatgatctagtttcagttccattgtccggtaaacgtaatgtaagtaccagtacaacggatacattgactccaatgagatcatcattcagtacagtcaatgagaacgatatggaaaatttctcagtcttaggtccaagaaatagtgttaattctgtcgtaacaccaaggacttcaatacaaaattctactttggaagatttttcaccgtccaacaaaaattttaagtcagctaaatcgatttacgaaatggttgatgtggaattctcgaaatttttaaggcatgttcagttactttattttgtgttacagagctcagtcttctcagatgataatactttaccacagttgctcccaagattttttaaaggttcatttagcggtggttcttggacaaatccattttcgacttttattacggatgaatttggtaatgcgacaaagaacaaagctgtcacatctaatgaagtgaccgcttcgtcgtccaaaaattcctcaatatcaaggattccaccaaagatggcagatgctattgcctctgcgtcaggatatagcgctaattcagaaacaaattcccaaattgatttaaaagcaagcagtgccgcgtctggttcagtttttacacctttcaaccgtccttctcataacagaaccttttcaagagcaagagtttcaaaaaggaagaaaaaatatccattaactgtagacactttgaatacaatgaagaagaaatcctcgcaaatttttgaaaaattaaataatgctacaggtgaacacttaaaaattataagtaaacccaaaagcagaattaggaatttggaaataaattcaagcacatacgaacaaataaatcagaatgttttactattggagatactggagaatttagatctgtcaattttcatcaatttgaaaaacctgattaagacacccagtattttgttggatttggaaagcgaggaatttttagttcacgccatgtcttcggtctcctcagtactaacagagttttttgatataaagcaggcttttcatgacatcgtcatcagattaataatgacaacgcaacaaacgaccttagacgacccgtatttgttttcctcaatgaggtccaatttccctgtcggacatcatgaacctttcaagaatatctctaatacacctttggtcaagggccccttccataaaaaaaatgaacaattggcactctccttatttcacgtattggtgagtcaagatgtggagttcaataaccttgaatttttaaacaactccgacgattttaaagatgcttgtgaaaagtatgtcgagatttctaatcttgcgtgtattattgttgatcaattgattgaagaaagagaaaatttgctgaactacgcagcaagaatgatgaagaataatttgactgcagaactattgaaaggtgagcaagaaaaatggtttgatatttattccgaggactatagtgatgacgattcagaaaatgatgaagctatcatcgatgacgaattaggatctgaggactatattgaacgcaaagctgcgaacatagagaaaaaccttccatggtttttaacttcagattatgaaactagtcttgtctatgactcaagaggaaaaattcgtggcgggacaaaagaggcactgattgaacatttaaccagtcatgaacttgttgatgcggctttcaatgttacaatgttaataactttcagaagtatattaaccacaagagagtttttttatgccctgatttacaggtacaacttgtatcctcctgaagggctgagttacgatgattacaatatttggatagaaaaaaagtcaaacccgattaaatgccgtgtggtcaacattatgagaacatttttgacgcagtattggacaagaaattattatgaacctggcataccactgattctaaattttgccaagatggttgtatcggagaaaataccgggggcagaggatcttttgcaaaagataaatgaaaaactgataaatgagaatgagaaagaaccagtggatcctaagcaacaagattcggtatcggcagtcgtacagacaactaaacgtgacaataaatcaccgatacacatgtcttcgtcttctttaccatcttctgcttcttcagcgttttttagattgaagaaattgaagctcttggatattgacccatacacatatgccacacaattgactgtacttgaacatgacttatacctcaggatcactatgtttgaatgcttggatagggcatggggtaccaagtattgtaatatgggtggttctccgaacattacgaaatttatagctaatgctaatacgctaactaattttgtttctcataccattgtaaaacaggcagatgtcaagacacgttcaaaattaacgcaatattttgttaccgttgcccagcattgtaaagagttgaataatttttcttcaatgactgccatagtgtccgctttgtattcctccccaatctaccgactgaaaaagacatgggatttagtttccactgagtcgaaggaccttctgaagaacctaaacaaccttatggattccaagagaaattttgtgaagtatagagagctgttgcgatccgtgacggacgttgcatgtgttcccttttttggtgtatacctatctgatttaacatttacgtttgtcggaaacccagattttcttcacaattcaaccaacataataaacttcagcaagaggactaaaatcgcaaatatagtggaggaaattataagctttaaaagattccattacaagctgaaacgattggatgatattcagaccgttatagaagcgtctttggaaaatgtcccccacattgaaaagcagtatcaattatcactgcaagtggaaccgagatcaggaaacaccaaaggcagtacgcatgcttcttctgctagcggtacaaaaactgcaaaattcctaagtgaatttacagatgataaaaatggcaattttttgaagctaggtaagaaaaaacctccttctaggttatttcgataaaagtttatacaatttgctaatcaagaagaaccttagctttatgtttgattgctacactctattatttaagatggctgcttttacttaatattcttcgtgataatactgtactggtggagtgtttttcgttttcgaggatttgagagtacgcttcatttgcagttcttcttgataaagttcgttttatatatatatatctattttatatctttatatattttattacacccagttaagttatcgatccaagattttaaatgcccgattagaggaaacttattacctgaaaaaatatcaattagtgattctatgaaaa

SEQ ID NO: 8527 - protein, 1589 aa, Saccharomyces cerevisiae
MSDTNTSIPNTSSAREAGNASQTPSISSSSNTSTTTNTESSSASLSSSPSTSELTSIRPIGIVVAAYDFNYPIKKDSSSQLLSVQQGETIYILNKNSSGWWDGLVIDDSNGKVNRGWFPQNFGRPLRDSHLRKHSHPMKKYSSSKSSRRSSLNSLGNSAYLHVPRNPSKSRRGSSTLSASLSNAHNAETSSGHNNTVSMNNSPFSAPNDASHITPQSSNFNSNASLSQDMTKSADGSSEMNTNAIMNNNETNLQTSGEKAGPPLVAEETIKILPLEEIEMIINGIRSNIASTWSPIPLITKTSDYKLVYYNKDLDIYCSELPLISNSIMESDDICDSEPKFPPNDHLVNLYTRDLRKNANIEDSSTRSKQSESEQNRSSLLMEKQDSKETDGNNNSINDDDNNNENNKNEFNEAGPSSLNSLSAPDLTQNIQSRVVAPSRSSILAKSDIFYHYSRDIKLWTELQDLTVYYTKTAHKMFLKENRLNFTKYFDLISDSIVFTQLGCRLMQHEIKAKSCSKEIKKIFKGLISSLSRISINSHLYFDSAFHRKKMDTMNDKDNDNQENNCSRTEGDDGKIEVDSVHDLVSVPLSGKRNVSTSTTDTLTPMRSSFSTVNENDMENFSVLGPRNSVNSVVTPRTSIQNSTLEDFSPSNKNFKSAKSIYEMVDVEFSKFLRHVQLLYFVLQSSVFSDDNTLPQLLPRFFKGSFSGGSWTNPFSTFITDEFGNATKNKAVTSNEVTASSSKNSSISRIPPKMADAIASASGYSANSETNSQIDLKASSAASGSVFTPFNRPSHNRTFSRARVSKRKKKYPLTVDTLNTMKKKSSQIFEKLNNATGEHLKIISKPKSRIRNLEINSSTYEQINQNVLLLEILENLDLSIFINLKNLIKTPSILLDLESEEFLVHAMSSVSSVLTEFFDIKQAFHDIVIRLIMTTQQTTLDDPYLFSSMRSNFPVGHHEPFKNISNTPLVKGPFHKKNEQLALSLFHVLVSQDVEFNNLEFLNNSDDFKDACEKYVEISNLACIIVDQLIEERENLLNYAARMMKNNLTAELLKGEQEKWFDIYSEDYSDDDSENDEAIIDDELGSEDYIERKAANIEKNLPWFLTSDYETSLVYDSRGKIRGGTKEALIEHLTSHELVDAAFNVTMLITFRSILTTREFFYALIYRYNLYPPEGLSYDDYNIWIEKKSNPIKCRVVNIMRTFLTQYWTRNYYEPGIPLILNFAKMVVSEKIPGAEDLLQKINEKLINENEKEPVDPKQQDSVSAVVQTTKRDNKSPIHMSSSSLPSSASSAFFRLKKLKLLDIDPYTYATQLTVLEHDLYLRITMFECLDRAWGTKYCNMGGSPNITKFIANANTLTNFVSHTIVKQADVKTRSKLTQYFVTVAQHCKELNNFSSMTAIVSALYSSPIYRLKKTWDLVSTESKDLLKNLNNLMDSKRNFVKYRELLRSVTDVACVPFFGVYLSDLTFTFVGNPDFLHNSTNIINFSKRTKIANIVEEIISFKRFHYKLKRLDDIQTVIEASLENVPHIEKQYQLSLQVEPRSGNTKGSTHASSASGTKTAKFLSEFTDDKNGNFLKLGKKKPPSRLFR

SEQ ID NO: 8528 - DNA, 23 bp, Artificial sequence
  primer
atgcctataacgtcaagccccga

SEQ ID NO: 8529 - DNA, 25 bp, Artificial sequence
  primer
ttacttagaaaccttgggagctttt

SEQ ID NO: 8530 - protein, 1604 aa, Artificial sequence
  consensus sequence
  Variant (2)..(14): Xaa in position 2 to 14 is any amino acid
  Variant (15)..(19): Xaa in position 15 to 19 is any or no amino acid
  Variant (21)..(24): Xaa in position 21 to 24 is any amino acid
  Variant (26)..(32): Xaa in position 26 to 32 is any amino acid
  Variant (34)..(36): Xaa in position 34 to 36 is any amino acid
  Variant (42)..(51): Xaa in position 42 to 51 is any amino acid
  Variant (52)..(52): Xaa in position 52 is any or no amino acid
  Variant (55)..(63): Xaa in position 55 to 63 is any amino acid
  Variant (64)..(429): Xaa in position 64 to 429 is any or no amino acid
  Variant (432)..(435): Xaa in position 432 to 435 is any amino acid
  Variant (437)..(439): Xaa in position 437 to 439 is any amino acid
  Variant (441)..(442): Xaa in position 441 to 442 is any amino acid
  Variant (444)..(465): Xaa in position 444 to 465 is any amino acid
  Variant (467)..(476): Xaa in position 467 to 476 is any amino acid
  Variant (478)..(484): Xaa in position 478 to 484 is any amino acid
  Variant (486)..(510): Xaa in position 486 to 510 is any amino acid
  Variant (511)..(516): Xaa in position 511 to 516 is any or no amino acid
  Variant (518)..(534): Xaa in position 518 to 534 is any amino acid
  Variant (535)..(583): Xaa in position 535 to 583 is any or no amino acid
  Variant (585)..(768): Xaa in position 585 to 768 is any amino acid
  Variant (769)..(874): Xaa in position 769 to 874 is any or no amino acid
  Variant (876)..(888): Xaa in position 876 to 888 is any amino acid
  Variant (890)..(891): Xaa in position 890 to 891 is any amino acid
  Variant (893)..(895): Xaa in position 893 to 895 is any amino acid
  Variant (897)..(928): Xaa in position 897 to 928 is any amino acid
  Variant (929)..(939): Xaa in position 929 to 939 is any or no amino acid
  Variant (941)..(944): Xaa in position 941 to 944 is any amino acid
  Variant (947)..(948): Xaa in position 947 to 948 is any amino acid
  Variant (951)..(956): Xaa in position 951 to 956 is any amino acid
  Variant (958)..(959): Xaa in position 958 to 959 is any amino acid
  Variant (961)..(962): Xaa in position 961 to 962 is any amino acid
  Variant (965)..(965): Xaa in position 965 is any amino acid
  Variant (968)..(969): Xaa in position 968 to 969 is any amino acid
  Variant (971)..(995): Xaa in position 971 to 995 is any amino acid
  Variant (996)..(1022): Xaa in position 996 to 1022 is any or no amino acid
  Variant (1024)..(1066): Xaa in position 1024 to 1066 is any amino acid
  Variant (1067)..(1068): Xaa in position 1067 to 1068 is any or no amino acid
  Variant (1070)..(1071): Xaa in position 1070 to 1071 is any amino acid
  Variant (1075)..(1077): Xaa in position 1075 to 1077 is any amino acid
  Variant (1081)..(1081): Xaa in position 1081 is any amino acid
  Variant (1083)..(1083): Xaa in position 1083 is any amino acid
  Variant (1085)..(1091): Xaa in position 1085 to 1091 is any amino acid
  Variant (1094)..(1095): Xaa in position 1094 to 1095 is any amino acid
  Variant (1097)..(1121): Xaa in position 1097 to 1121 is any amino acid
  Variant (1122)..(1150): Xaa in position 1122 to 1150 is any or no amino acid
  Variant (1153)..(1153): Xaa in position 1153 is any amino acid
  Variant (1155)..(1161): Xaa in position 1155 to 1161 is any amino acid
  Variant (1163)..(1167): Xaa in position 1163 to 1167 is any amino acid
  Variant (1169)..(1169): Xaa in position 1169 is any amino acid
  Variant (1171)..(1171): Xaa in position 1171 is any amino acid
  Variant (1174)..(1174): Xaa in position 1174 is any amino acid
  Variant (1176)..(1176): Xaa in position 1176 is any amino acid
  Variant (1179)..(1181): Xaa in position 1179 to 1181 is any amino acid
  Variant (1184)..(1188): Xaa in position 1184 to 1188 is any amino acid
  Variant (1190)..(1191): Xaa in position 1190 to 1191 is any amino acid
  Variant (1193)..(1196): Xaa in position 1193 to 1196 is any amino acid
  Variant (1198)..(1198): Xaa in position 1198 is any amino acid
  Variant (1201)..(1207): Xaa in position 1201 to 1207 is any amino acid
  Variant (1210)..(1212): Xaa in position 1210 to 1212 is any amino acid
  Variant (1215)..(1215): Xaa in position 1215 is any amino acid
  Variant (1217)..(1220): Xaa in position 1217 to 1220 is any amino acid
  Variant (1224)..(1224): Xaa in position 1224 is any amino acid
  Variant (1227)..(1228): Xaa in position 1227 to 1228 is any amino acid
  Variant (1232)..(1232): Xaa in position 1232 is any amino acid
  Variant (1234)..(1236): Xaa in position 1234 to 1236 is any amino acid
  Variant (1238)..(1239): Xaa in position 1238 to 1239 is any amino acid
  Variant (1241)..(1243): Xaa in position 1241 to 1243 is any amino acid
  Variant (1246)..(1256): Xaa in position 1246 to 1256 is any amino acid
  Variant (1258)..(1260): Xaa in position 1258 to 1260 is any amino acid
  Variant (1262)..(1286): Xaa in position 1262 to 1286 is any amino acid
  Variant (1287)..(1289): Xaa in position 1287 to 1289 is any or no amino acid
  Variant (1291)..(1332): Xaa in position 1291 to 1332 is any amino acid
  Variant (1333)..(1354): Xaa in position 1333 to 1354 is any or no amino acid
  Variant (1356)..(1356): Xaa in position 1356 is any amino acid
  Variant (1358)..(1361): Xaa in position 1358 to 1361 is any amino acid
  Variant (1363)..(1363): Xaa in position 1363 is any amino acid
  Variant (1367)..(1368): Xaa in position 1367 to 1368 is any amino acid
  Variant (1370)..(1371): Xaa in position 1370 to 1371 is any amino acid
  Variant (1374)..(1375): Xaa in position 1374 to 1375 is any amino acid
  Variant (1378)..(1378): Xaa in position 1378 is any amino acid
  Variant (1380)..(1380): Xaa in position 1380 is any amino acid
  Variant (1383)..(1385): Xaa in position 1383 to 1385 is any amino acid
  Variant (1388)..(1388): Xaa in position 1388 is any amino acid
  Variant (1390)..(1398): Xaa in position 1390 to 1398 is any amino acid
  Variant (1399)..(1399): Xaa in position 1399 is any or no amino acid
  Variant (1401)..(1402): Xaa in position 1401 to 1402 is any amino acid
  Variant (1405)..(1407): Xaa in position 1405 to 1407 is any amino acid
  Variant (1409)..(1409): Xaa in position 1409 is any amino acid
  Variant (1412)..(1413): Xaa in position 1412 to 1413 is any amino acid
  Variant (1415)..(1417): Xaa in position 1415 to 1417 is any amino acid
  Variant (1419)..(1425): Xaa in position 1419 to 1425 is any amino acid
  Variant (1428)..(1433): Xaa in position 1428 to 1433 is any amino acid
  Variant (1435)..(1436): Xaa in position 1435 to 1436 is any amino acid
  Variant (1439)..(1440): Xaa in position 1439 to 1440 is any amino acid
  Variant (1442)..(1444): Xaa in position 1442 to 1444 is any amino acid
  Variant (1454)..(1454): Xaa in position 1454 is any amino acid
  Variant (1463)..(1463): Xaa in position 1463 is any amino acid
  Variant (1466)..(1467): Xaa in position 1466 to 1467 is any amino acid
  Variant (1470)..(1479): Xaa in position 1470 to 1479 is any amino acid
  Variant (1481)..(1483): Xaa in position 1481 to 1483 is any amino acid
  Variant (1485)..(1485): Xaa in position 1485 is any amino acid
  Variant (1488)..(1488): Xaa in position 1488 is any amino acid
  Variant (1490)..(1491): Xaa in position 1490 to 1491 is any amino acid
  Variant (1494)..(1495): Xaa in position 1494 to 1495 is any amino acid
  Variant (1498)..(1499): Xaa in position 1498 to 1499 is any amino acid
  Variant (1501)..(1507): Xaa in position 1501 to 1507 is any amino acid
  Variant (1522)..(1524): Xaa in position 1522 to 1524 is any amino acid
  Variant (1529)..(1529): Xaa in position 1529 is any amino acid
  Variant (1531)..(1537): Xaa in position 1531 to 1537 is any amino acid
  Variant (1538)..(1546): Xaa in position 1538 to 1546 is any or no amino acid
  Variant (1549)..(1549): Xaa in position 1549 is any amino acid
  Variant (1552)..(1556): Xaa in position 1552 to 1556 is any amino acid
  Variant (1558)..(1560): Xaa in position 1558 to 1560 is any amino acid
  Variant (1562)..(1563): Xaa in position 1562 to 1563 is any amino acid
  Variant (1566)..(1568): Xaa in position 1566 to 1568 is any amino acid
  Variant (1570)..(1585): Xaa in position 1570 to 1585 is any amino acid
  Variant (1587)..(1588): Xaa in position 1587 to 1588 is any amino acid
  Variant (1590)..(1590): Xaa in position 1590 is any amino acid
  Variant (1593)..(1593): Xaa in position 1593 is any amino acid
  Variant (1596)..(1596): Xaa in position 1596 is any amino acid
  Variant (1600)..(1601): Xaa in position 1600 to 1601 is any amino acid
VXXXXXXXXXXXXXXXXXXLXXXXGXXXXXXXKXXXGWWDGXXXXXXXXXXXRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFYXXXXDXXXWXXLXXXXXXXXXXXXXXXXXXXXXXFXXXXXXXXXXIXXXXXXXRXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXEXXDXXXFXXXXXXXXXXXXXXXXXXXXXXXXXXXXXXXXXXXXXXXXXXXEXXXXKQXXHDXXXXXXMXXQXXTLXDPXXFXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXLXXEREXXXNYAXRXMXXXXXXXLLXXEXXXXXXXXXXXXXXXXXXXXXXXXXXXXXXXXXXXXXXXXXXXXXXXXXXXXXXPWXLXXXXXXXLXXXXXGXIXGGXKXALXXXLTXXXXXDXXFXXXXLXTFXXXXXXXEFXXXLIXRXXXXPPEXLSXXEYNXWXXXKXXPXXXRVXXXXXXXXXXXWXXXYXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXDXDXXXXAXQLTXXEXXLYXXITXFXCLXXXWGXKXXXXXXXXXXIXXFIXXXNXLTXXVXXXIXXXXXXXKRXXXXXXFXXVAXXCXXXNNFSSMTAIXSALYSSPIXRLXXTWXXXXXXXXXXLXXXNXLMXSXXNFXXYRXXLXXXXXXXCVPFFGVYLSDLTFXXXGNPDXLXXXXXXXXXXXXXXXXNFXKRXXXXXIXXXIXXFKXXXYXXXXXXXXXXXXXXXXEXXPXIEXQYXLSLXXEPR

SEQ ID NO: 8531 - protein, 59 aa, Artificial sequence
  protein pattern
  Variant (2)..(2): Xaa in position 2 is any amino acid
  Variant (5)..(5): Xaa in position 5 is Asp or Asn
  Variant (6)..(6): Xaa in position 6 is Pro or Ser
  Variant (7)..(7): Xaa in position 7 is any amino acid
  Variant (8)..(8): Xaa in position 8 is Lys or Arg
  Variant (11)..(12): Xaa in position 11 to 12 is any amino acid
  Variant (15)..(15): Xaa in position 15 is Asp, Glu or Asn
  Variant (16)..(16): Xaa in position 16 is any amino acid
  Variant (18)..(18): Xaa in position 18 is Lys or Arg
  Variant (19)..(19): Xaa in position 19 is any amino acid
  Variant (20)..(20): Xaa in position 20 is Ile, Leu or Val
  Variant (21)..(21): Xaa in position 21 is any amino acid
  Variant (22)..(22): Xaa in position 22 is Asp or Ser
  Variant (23)..(23): Xaa in position 23 is any amino acid
  Variant (24)..(24): Xaa in position 24 is Ala or Pro
  Variant (39)..(39): Xaa in position 39 is Thr or Val
  Variant (40)..(41): Xaa in position 40 to 41 is any amino acid
  Variant (44)..(44): Xaa in position 44 is Pro or Ser
  Variant (46)..(46): Xaa in position 46 is any amino acid
  Variant (48)..(54): Xaa in position 48 to 54 is any amino acid
  Variant (55)..(55): Xaa in position 55 is Gly or Asn
  Variant (56)..(56): Xaa in position 56 is Phe or Val
  Variant (57)..(57): Xaa in position 57 is any amino acid
  Variant (58)..(58): Xaa in position 58 is Asp or Lys
  Variant (59)..(59): Xaa in position 59 is Glu or Arg
NXLMXXXXNFXXYRXXLXXXXXXXCVPFFGVYLSDLTFXXXGNXDXLXXXXXXXXXXXX

SEQ ID NO: 8532 - protein, 60 aa, Artificial sequence
  protein pattern
  Variant (2)..(2): Xaa in position 2 is any amino acid
  Variant (3)..(3): Xaa in position 3 is Phe or Tyr
  Variant (4)..(4): Xaa in position 4 is Ile or Val
  Variant (5)..(5): Xaa in position 5 is Ala, Gly or Ser
  Variant (6)..(6): Xaa in position 6 is Phe, His or Tyr
  Variant (7)..(7): Xaa in position 7 is any amino acid
  Variant (8)..(8): Xaa in position 8 is Ile or Val
  Variant (9)..(9): Xaa in position 9 is Leu or Val
  Variant (10)..(10): Xaa in position 10 is Lys or Arg
  Variant (11)..(11): Xaa in position 11 is any amino acid
  Variant (12)..(12): Xaa in position 12 is Ala, Gln or Thr
  Variant (13)..(13): Xaa in position 13 is Asp or Glu
  Variant (14)..(16): Xaa in position 14 to 16 is any amino acid
  Variant (18)..(18): Xaa in position 18 is Ala, Ser or Val
  Variant (19)..(19): Xaa in position 19 is any amino acid
  Variant (20)..(20): Xaa in position 20 is Ile or Leu
  Variant (21)..(22): Xaa in position 21 to 22 is any amino acid
  Variant (23)..(23): Xaa in position 23 is Phe, His or Tyr
  Variant (25)..(25): Xaa in position 25 is Ile or Val
  Variant (26)..(26): Xaa in position 26 is any amino acid
  Variant (27)..(27): Xaa in position 27 is Ile or Val
  Variant (28)..(28): Xaa in position 28 is Ala or Ser
  Variant (29)..(29): Xaa in position 29 is Asp, Glu or Gln
  Variant (30)..(30): Xaa in position 30 is any amino acid
  Variant (32)..(34): Xaa in position 32 to 34 is any amino acid
  Variant (35)..(35): Xaa in position 35 is any or no amino acid
  Variant (37)..(37): Xaa in position 37 is any or no amino acid
  Variant (45)..(45): Xaa in position 45 is Ile or Val
  Variant (54)..(54): Xaa in position 54 is Phe, His or Tyr
  Variant (57)..(58): Xaa in position 57 to 58 is any amino acid
  Variant (60)..(60): Xaa in position 60 is Phe or Trp
TXXXXXXXXXXXXXXXRXXXXXXFXXXXXXCXXXXNXFSSMTAIXSALYSSPIXRLXXTX

SEQ ID NO: 8533 - protein, 50 aa, Artificial sequence
  protein pattern
  Variant (3)..(3): Xaa in position 3 is Phe, Ile, Leu or Val
  Variant (4)..(5): Xaa in position 4 to 5 is any amino acid
  Variant (6)..(6): Xaa in position 6 is Ile or Leu
  Variant (7)..(7): Xaa in position 7 is Phe or Ile
  Variant (8)..(8): Xaa in position 8 is any amino acid
  Variant (9)..(9): Xaa in position 9 is Gln or Arg
  Variant (10)..(10): Xaa in position 10 is Phe or Tyr
  Variant (11)..(11): Xaa in position 11 is Asp, Glu or Asn
  Variant (12)..(13): Xaa in position 12 to 13 is any amino acid
  Variant (14)..(14): Xaa in position 14 is Ala or Pro
  Variant (17)..(17): Xaa in position 17 is Asp, Gly or Asn
  Variant (19)..(19): Xaa in position 19 is Cys or Ser
  Variant (20)..(20): Xaa in position 20 is Phe or Tyr
  Variant (21)..(22): Xaa in position 21 to 22 is Asp or Glu
  Variant (25)..(25): Xaa in position 25 is any amino acid
  Variant (27)..(27): Xaa in position 27 is Ile or Val
  Variant (28)..(28): Xaa in position 28 is Asp, Glu, Ser or Thr
  Variant (29)..(29): Xaa in position 29 is Lys or Arg
  Variant (31)..(32): Xaa in position 31 to 32 is any amino acid
  Variant (34)..(34): Xaa in position 34 is any amino acid
  Variant (35)..(35): Xaa in position 35 is Lys or Arg
  Variant (36)..(36): Xaa in position 36 is any amino acid
  Variant (39)..(39): Xaa in position 39 is Ile, Met or Val
  Variant (40)..(40): Xaa in position 40 is any amino acid
  Variant (41)..(41): Xaa in position 41 is Ile, Leu or Val
  Variant (42)..(42): Xaa in position 42 is Ile, Leu or Met
  Variant (43)..(45): Xaa in position 43 to 45 is any amino acid
  Variant (46)..(46): Xaa in position 46 is Phe, Ile or Leu
  Variant (47)..(48): Xaa in position 47 to 48 is any amino acid
  Variant (49)..(49): Xaa in position 49 is Phe or Tyr
EFXXXXXXXXXXXXPEXLXXXXYNXWXXXKXXPXXXRVXXXXXXXXXXXW

SEQ ID NO: 8534 - protein, 29 aa, Artificial sequence
  protein pattern
  Variant (2)..(3): Xaa in position 2 to 3 is any amino acid
  Variant (5)..(5): Xaa in position 5 is any amino acid
  Variant (6)..(6): Xaa in position 6 is any or no amino acid
  Variant (8)..(8): Xaa in position 8 is Asn, Ser or Thr
  Variant (9)..(9): Xaa in position 9 is Ile, Leu or Val
  Variant (10)..(10): Xaa in position 10 is Ile or Leu
  Variant (14)..(14): Xaa in position 14 is Ala or Thr
  Variant (16)..(16): Xaa in position 16 is Met or Val
  Variant (18)..(18): Xaa in position 18 is any amino acid
  Variant (19)..(19): Xaa in position 19 is Asp or Asn
  Variant (20)..(20): Xaa in position 20 is Asp, Asn or Arg
  Variant (21)..(21): Xaa in position 21 is Phe, Ile or Leu
  Variant (22)..(24): Xaa in position 22 to 24 is any amino acid
  Variant (27)..(28): Xaa in position 27 to 28 is any amino acid
LXXEXXEXXXNYAXRXMXXXXXXXLLXXE

SEQ ID NO: 8535 - protein, 21 aa, Artificial sequence
  protein pattern
  Variant (2)..(2): Xaa in position 2 is Pro or Val
  Variant (4)..(4): Xaa in position 4 is Ile, Leu or Val
  Variant (5)..(5): Xaa in position 5 is any amino acid
  Variant (9)..(9): Xaa in position 9 is Phe, Ile or Leu
  Variant (10)..(10): Xaa in position 10 is any amino acid
  Variant (11)..(11): Xaa in position 11 is Asp, Gly, Asn or Ser
  Variant (12)..(12): Xaa in position 12 is Glu or Ser
  Variant (14)..(14): Xaa in position 14 is Glu, Asn or Ser
  Variant (15)..(15): Xaa in position 15 is Gly or Thr
  Variant (16)..(16): Xaa in position 16 is Gly or Ile
  Variant (17)..(17): Xaa in position 17 is Asn, Ser or Val
  Variant (19)..(19): Xaa in position 19 is Cys, Asn or Thr
  Variant (20)..(20): Xaa in position 20 is any amino acid
  Variant (21)..(21): Xaa in position 21 is Pro or Ser
LXQXXPRFXXXXFXXXXWXXX

SEQ ID NO: 8536 - protein, 26 aa, Artificial sequence
  protein pattern
  Variant (2)..(5): Xaa in position 2 to 5 is any amino acid
  Variant (6)..(12): Xaa in position 6 to 12 is any or no amino acid
  Variant (14)..(14): Xaa in position 14 is Asp or Glu
  Variant (15)..(15): Xaa in position 15 is Glu or Lys
  Variant (18)..(18): Xaa in position 18 is Glu or Gln
  Variant (19)..(19): Xaa in position 19 is Ile or Leu
  Variant (22)..(22): Xaa in position 22 is any amino acid
  Variant (23)..(23): Xaa in position 23 is Ile, Leu or Val
  Variant (26)..(26): Xaa in position 26 is Lys or Arg
EXXXXXXXXXXXIXXQYXXSLXXEPX

SEQ ID NO: 8537 - protein, 35 aa, Artificial sequence
  protein pattern
  Variant (2)..(4): Xaa in position 2 to 4 is any amino acid
  Variant (5)..(9): Xaa in position 5 to 9 is any or no amino acid
  Variant (11)..(11): Xaa in position 11 is Glu or Lys
  Variant (12)..(12): Xaa in position 12 is any amino acid
  Variant (13)..(13): Xaa in position 13 is Ile, Leu or Val
  Variant (14)..(15): Xaa in position 14 to 15 is any amino acid
  Variant (16)..(16): Xaa in position 16 is Ala, Cys, Asn or Thr
  Variant (17)..(17): Xaa in position 17 is any amino acid
  Variant (18)..(18): Xaa in position 18 is Ala, Leu or Pro
  Variant (19)..(19): Xaa in position 19 is Ile, Leu or Met
  Variant (20)..(20): Xaa in position 20 is Ile, Leu or Val
  Variant (21)..(21): Xaa in position 21 is Asp, Glu or Asn
  Variant (22)..(22): Xaa in position 22 is Ile, Leu or Met
  Variant (23)..(23): Xaa in position 23 is Ile or Leu
  Variant (25)..(25): Xaa in position 25 is Asn or Ser
  Variant (26)..(26): Xaa in position 26 is Phe or Leu
  Variant (28)..(28): Xaa in position 28 is Phe or Leu
  Variant (29)..(29): Xaa in position 29 is Ser or Thr
  Variant (30)..(30): Xaa in position 30 is Ile, Met or Val
  Variant (32)..(33): Xaa in position 32 to 33 is any amino acid
  Variant (34)..(34): Xaa in position 34 is Ile, Leu, Met or Val
  Variant (35)..(35): Xaa in position 35 is His, Lys or Arg
LXXXXXXXXYXXXXXXXXXXXXXEXXDXXXFXXXX

SEQ ID NO: 8538 - protein, 18 aa, Artificial sequence
  protein pattern
  Variant (2)..(2): Xaa in position 2 is Ile, Leu or Val
  Variant (3)..(3): Xaa in position 3 is Glu, Asn, Gln, Ser or Thr
  Variant (4)..(4): Xaa in position 4 is Glu or Gly
  Variant (6)..(7): Xaa in position 6 to 7 is any amino acid
  Variant (9)..(9): Xaa in position 9 is any or no amino acid
  Variant (11)..(12): Xaa in position 11 to 12 is any amino acid
  Variant (13)..(13): Xaa in position 13 is any or no amino acid
  Variant (15)..(15): Xaa in position 15 is any amino acid
  Variant (16)..(16): Xaa in position 16 is Phe or Leu
  Variant (17)..(17): Xaa in position 17 is any amino acid
  Variant (18)..(18): Xaa in position 18 is Glu, His, Lys or Arg
IXXXIXXFXKXXXYXXXX

SEQ ID NO: 8539 - DNA, 840 bp, Saccharomyces cerevisiae
  CDS (1)..(840)
atgtcatcaagacccgctaataaccaaggccccccaaacctccctgccagagataagtcgctcgtgcaaaggttcatggcagtagccaagagcttgcagtttgcatggtttaccggtcattccgtcgtattgatcagctccattctttacctgctcaagatgtcagaattttattacagatcggcatatctcggtgtcatcgaatctttcggtatcatcatttaccagcaatttttcacccgcaatgaaccattgcagactcaagatgccgctgccactaaggcttccataaaatcacgcgttgctggactcctaaagagtgaagacgtgctttatttggttttggccaacttctggttgttcactccaagattttcattcagcttaatcccatttttcgcgtttgctgtattccatgttttaatctacgttgaaaaagttctcttaccaaaagtcttccacctttccagtaaagattcaagtaagatcctcagcttcatcgacaagtttgttgttcagtacaatgacttgtgcatgcactgggtcggtactgctgagctgcttattttcattttggtccttttcagagccattctgtgcttccaaaggtcttggatcatacttgttgtgtacgccatctttattaagttaagatacgaaaactccaagtacatgaaagccgcctttgctcaatggagagttagaatggacgggatcataagccacccatctatcccaccattcgtcaaaagagcttataatgcaattaaaatgagcttgatccgcttgtctgagtaccgcttaagcggtgccccacaagtgaccaagaagcagaattga

SEQ ID NO: 8540 - protein, 279 aa, Saccharomyces cerevisiae
MSSRPANNQGPPNLPARDKSLVQRFMAVAKSLQFAWFTGHSVVLISSILYLLKMSEFYYRSAYLGVIESFGIIIYQQFFTRNEPLQTQDAAATKASIKSRVAGLLKSEDVLYLVLANFWLFTPRFSFSLIPFFAFAVFHVLIYVEKVLLPKVFHLSSKDSSKILSFIDKFVVQYNDLCMHWVGTAELLIFILVLFRAILCFQRSWIILVVYAIFIKLRYENSKYMKAAFAQWRVRMDGIISHPSIPPFVKRAYNAIKMSLIRLSEYRLSGAPQVTKKQN

SEQ ID NO: 8541 - DNA, 840 bp, Schizosaccharomyces pombe 972h-
  CDS (1)..(840)
atggagccaaaacaacgagttgtcaagcctttaaaagaaagggttttacctgttgtcaagaacacccagtttgtttggttttcggggcaagtaatagtgctaatctcttccgtcttgtatgctcttcaagcaatcccttttcgttccgctcctccatttttgtttaaaagcgctgcctttggtgccatcgttgcatatgcaattgtcctttacaaaacttatagtccaaacttgacttcccgtgcttcttggaataagcatttctttgcccgtcttatgctcgatgacaatgttcagtattttattttagctctttcaatgttgattgatcgtcccatcctattttctctcgctccatatgccatttacgccactttccacatctccacttacttgcgtagtgtgcttttgcctgccatttaccctaatatttctgacgcgaaaactgcgtcttatgcttctcgtgtttctaatttgctaaatcagtacactcgaagccaatttcaacctgctatgcaacttgttgcttctctcgaaacatttttattgttccgtttgttctttggggttttcttacgtaaaaactcaatttccaggttggtgggctatattttctttcttcgcatgagatacactaatagtcactttactcgtgcatccattaaagccgttagccttcgaatggatcgtttggttgcagataacagagttcctcctgttatcaaaaatgcttggcatacattcaaaacttatgtgtccaagttcggtgcttcacctgtaggtactgctcaaagccgtcccactgcatcaagctctaccactgctccctcatctacttaa

SEQ ID NO: 8542 - protein, 279 aa, Schizosaccharomyces pombe 972h-
MEPKQRVVKPLKERVLPVVKNTQFVWFSGQVIVLISSVLYALQAIPFRSAPPFLFKSAAFGAIVAYAIVLYKTYSPNLTSRASWNKHFFARLMLDDNVQYFILALSMLIDRPILFSLAPYAIYATFHISTYLRSVLLPAIYPNISDAKTASYASRVSNLLNQYTRSQFQPAMQLVASLETFLLFRLFFGVFLRKNSISRLVGYIFFLRMRYTNSHFTRASIKAVSLRMDRLVADNRVPPVIKNAWHTFKTYVSKFGASPVGTAQSRPTASSSTTAPSST

SEQ ID NO: 8543 - DNA, 843 bp, Magnaporthe grisea 70-15
  CDS (1)..(843)
atggctccccctcctccagcaagcttgcctctgcctcagcggctggcagccctggctcagactctgcaatttgcctggtttgttggccactttgtcttgatcgccgcgaccgtcaagtactcgctatcatggatcgccatgaaaggataccgttctaacatatcctaccgtttcatcttcctgtcggctgcggtaacttacggcattgttgtctacaagactttgcgcgcacgtgccaagcaacgagctccccagatcagccctctggcgctcgctgcagatgagaacgttcagtacttggtgctggcgcttatctggcttttctccccgagatatatcctggcaaccctgccttacgggatctactccttcttccatgtggccacctacatgcgtgcgaacctcatcccggtcgtcttccctcccaagcctgccgctgccgactcggttgatgggaagcccgtggcgcacccgatcgccgacatgatcggccgtttcgtcaaggaatactatgatgcctcgatgtccgtcgtggcgtccctggagatcctcctctggggttctgtgttcctctcggctctcctcttccagcggaggtcgtggatcctcctgccgctgtacacggcgttcttgcgcgcacgctactcccagagcattcatgtgcagaactcgttcgccaagctcgaggcgaacgtcgagaacctgctcggaaaccagggaacaccccctgctgcgcgccaggcctggcaggcaatcaagaacggcggaaggcagttctacctcgctaccgacatcaaccgttacattggtggcgcagctgctccccccaagaagacttcgtaa

SEQ ID NO: 8544 - protein, 280 aa, Magnaporthe grisea 70-15
MAPPPPASLPLPQRLAALAQTLQFAWFVGHFVLIAATVKYSLSWIAMKGYRSNISYRFIFLSAAVTYGIVVYKTLRARAKQRAPQISPLALAADENVQYLVLALIWLFSPRYILATLPYGIYSFFHVATYMRANLIPVVFPPKPAAADSVDGKPVAHPIADMIGRFVKEYYDASMSVVASLEILLWGSVFLSALLFQRRSWILLPLYTAFLRARYSQSIHVQNSFAKLEANVENLLGNQGTPPAARQAWQAIKNGGRQFYLATDINRYIGGAAAPPKKTS

SEQ ID NO: 8545 - DNA, 855 bp, Gibberella zeae PH-1
  CDS (1)..(855)
atggctcctccgccaaaccccaatcttcctctccaggagaggcttatggcccttgcccaaacccttcagttcggttggtttgtcggacacctcacccttatcctcgctacgattcgatatggcttttcctggctgagaatgaactactacaccggcatggccaaattctcttaccgcacagcctttatcgccgccgctgtcacctatggcattgtcgtctacaagactatgcgcgctcgcgctaagagcggacagcgtgctgctcccactcccttggctatgcttgccgatgagaacatccaataccttgcaatagccatgtctcttgtttggctgttctgccctcagtatcccctcgccttgatcccttacaccatttactcggtcttccacgttgccacctacactcgcgccaacctcatccccgctgtcgtcgctcccaggcctgcgcccgaggctgatggtgctactcctagccgccgaaccagcgtcgaccaccctattgctaacaagattggcgctttcgtgaaggagtactacgatgcctcaatggccattgttgcttctcttgagattgctctatggggccgtattttcctttcggccattctcttccagcgtcgatcttggatcctgattgtcctgtacaccgcattcctccgcgctcgttacactcagagcacccacgttcagcactcgttctctcagctgagcgcccgagttgactctttcgtcagtgcccagggaactcctcctgctgctcgctccatctggcagtctgtcaaggagggcgcaagacaattccacgatgctactgctctgggtaacgctggtcccgctaagaagtcctcataa

SEQ ID NO: 8546 - protein, 284 aa, Gibberella zeae PH-1
MAPPPNPNLPLQERLMALAQTLQFGWFVGHLTLILATIRYGFSWLRMNYYTGMAKFSYRTAFIAAAVTYGIVVYKTMRARAKSGQRAAPTPLAMLADENIQYLAIAMSLVWLFCPQYPLALIPYTIYSVFHVATYTRANLIPAVVAPRPAPEADGATPSRRTSVDHPIANKIGAFVKEYYDASMAIVASLEIALWGRIFLSAILFQRRSWILIVLYTAFLRARYTQSTHVQHSFSQLSARVDSFVSAQGTPPAARSIWQSVKEGARQFHDATALGNAGPAKKSS

SEQ ID NO: 8547 - DNA, 855 bp, Candida glabrata CBS 138
  CDS (1)..(855)
atgcctcctaaagttccagctacgactgtcaaggacaggtttttgaaagttgccaagagtttacaatttgcgtggtttgcaggccacttcctagttgtggtcagctctttgctgtatttgttcaggttctgtgagaccttgtaccgctgtgcgtacgttggtgtgttggcgtcatttggtattatcacgtaccagcagggtctgcaccagcagttgtcgctgtcgctgttgaccaatgagaatgtgttgtactttgcgttggcgctggtgtggttcttcacccccaggttcagtctgtcgctagtgccatacttcatgttctctgtgttccatgtgctagtgtacttgaagaccacgctgttgccccaagtgttcaaccagaccgtggagtccaagagcaaagttgttatgtttatcgacaagtttgtgttggactacaacgagaggtgcatgtactgggtctcgaccaccgagctgctgatgctgttcctgctgttcgtgagagcagtgttgttcttctcccgctcctggatcgtgctcgtggtgttcacgctgttcatcaaggtcaagtacgagacttctaagtacatgcaggccgccttcgcgcagtggagagtgagaatggacggtgtcatctcgcacccaagcgtcccaccccagatcaagtccctgtacaaccagttgaagttccagctggtgcaattgtccaaggtcaccatcaccagagcagcaccaggcacccatggatctactagtgcttctactggttctactggcaccagtaccagcaccagcactagcacctccggtgctagtgccagtgccactgccacccactccgcaaagatggactaa

SEQ ID NO: 8548 - protein, 284 aa, Candida glabrata CBS 138
MPPKVPATTVKDRFLKVAKSLQFAWFAGHFLVVVSSLLYLFRFCETLYRCAYVGVLASFGIITYQQGLHQQLSLSLLTNENVLYFALALVWFFTPRFSLSLVPYFMFSVFHVLVYLKTTLLPQVFNQTVESKSKVVMFIDKFVLDYNERCMYWVSTTELLMLFLLFVRAVLFFSRSWIVLVVFTLFIKVKYETSKYMQAAFAQWRVRMDGVISHPSVPPQIKSLYNQLKFQLVQLSKVTITRAAPGTHGSTSASTGSTGTSTSTSTSTSGASASATATHSAKMD

SEQ ID NO: 8549 - DNA, 792 bp, Kluyveromyces lactis NRRL Y-1140
  CDS (1)..(792)
atgagttcatccgttggttctactactattactagtagattcttggcattaaccaagaccactaaatttgcatggttcatcggacattttgccgttgtactatgctctatattttattggctttctctcaggtctacatctttgactgaaatatggtacagaatcatctttcttggagctatggagtcattcggtgttttagtgtaccaaacctatggcaaggcactgaaaaaaggcgacgttcgaaatggttctgggccagtaaatttccgtcaagtgatccgcgatgaaaatgtgctctactttttactctctgctacttggttaatcttgagccctagaatcgcaattgcaacgataccgttttttatcatttcgttgttccacgctctgacatacatcgttactgatatcgcatcgaatgtgctacaagtggaagatgtcaagaaacatccatatctaagatttattgacactttggtatccgacaaccatgaaacttcgttgaatgcaatctgtaattctgaattgctatgtttactatacaatttcatcagattgttaacgtttagatcacgttcttttattgcattcgttgctgtattcttattcgtgagattcaaatgctacaattcagctcacatgaaaagatcaattgctaaatgggaagtacgccttgatggagtcattgctcaccctgctgttccgcatccagtcaagacccaatacacgaatgcaaaattactactaagacgcgcgttcataacacctacagagaagaagggtaactag

SEQ ID NO: 8550 - protein, 263 aa, Kluyveromyces lactis NRRL Y-1140
MSSSVGSTTITSRFLALTKTTKFAWFIGHFAVVLCSIFYWLSLRSTSLTEIWYRIIFLGAMESFGVLVYQTYGKALKKGDVRNGSGPVNFRQVIRDENVLYFLLSATWLILSPRIAIATIPFFIISLFHALTYIVTDIASNVLQVEDVKKHPYLRFIDTLVSDNHETSLNAICNSELLCLLYNFIRLLTFRSRSFIAFVAVFLFVRFKCYNSAHMKRSIAKWEVRLDGVIAHPAVPHPVKTQYTNAKLLLRRAFITPTEKKGN

SEQ ID NO: 8551 - DNA, 858 bp, Debaryomyces hansenii CBS767
  CDS (1)..(858)
atgtcagaaaaacaaaataaagtacaagccaaatcttttggtcaaacaattgcaacgttagcactgtcgaagcaattctattggtttgtgggacatgttttggagattattttctttatcttgaacatggtcagctcatttttcagccggtcggccaaatattacaactgtgcattagttgcggtattatttacatatgggatcgttattaagcaaattcacttcaaaaatagtggtatttttggaattggtaaggtggcccgtgatcgggagttgagggccaggttggtgagagatgacaatgttcaatactttttacttgcgttagttttccttttgagcagtggaacgattggtggagttgccggaggattgtattctttcacgatcttttctattttccatgtgttgacgtacttccagactaatttgctcggatctatgcctcttaacaagttgcaacaacagaactggaatgcgaaaatcaaccacttcacttcgacatacaatcaacaagcattattaatggctgctaatgctgagttcttgttactcagtgggttcctttttactattccacttatgtttgttcagatctttaggattccacttttcgttgtggtgaatacttcggtattcgctgcggtcgttgtattcttgaaattgagatacatttcgaacagatacacgcaagagattgtaagccaatgggatatgaagatcaatcaggttcttttaagtggtaaattgccttcttcattaagcgagtactacaacataaggttgaagggattgattcaaaagttgactgatccaattcaattgccagccgttgcctcagtcaagaaatccaattag

SEQ ID NO: 8552 - protein, 285 aa, Debaryomyces hansenii CBS767
MSEKQNKVQAKSFGQTIATLALSKQFYWFVGHVLEIIFFILNMVSSFFSRSAKYYNCALVAVLFTYGIVIKQIHFKNSGIFGIGKVARDRELRARLVRDDNVQYFLLALVFLLSSGTIGGVAGGLYSFTIFSIFHVLTYFQTNLLGSMPLNKLQQQNWNAKINHFTSTYNQQALLMAANAEFLLLSGFLFTIPLMFVQIFRIPLFVVVNTSVFAAVVVFLKLRYISNRYTQEIVSQWDMKINQVLLSGKLPSSLSEYYNIRLKGLIQKLTDPIQLPAVASVKKSN

SEQ ID NO: 8553 - DNA, 834 bp, Debaryomyces hansenii CBS767
  CDS (1)..(834)
atgtctaatcaagctaaatctgctccgaatgctgctacaagcaagccagctactagtgcctcaactactgcaggggccccaaagagcaaaggggtcaataccagtcaattggttgaaactatccaaactttacaatttgcgtggtttgttggccatgttttgactttatggggaattttcctcttcaccttgacttttatcaaaagtggaagccgtttccataggttttggtaccagttggcgttatttggtattatcgagagttttggtatattgttgtaccaattaatcaccaagaaggctcttaaggttaaccaaatcttaaaagacgacaacactcagtacttcttattaggaagtgttttgcttttaatcagaccatacgtgcttattccattattaccattcgcattgttttccttgttccatgtattagcatacaccaagggatacctcttgcctattttcggtatggctgacaggggaatctccaagcaaattgaaaatttcatcagcaaaaacaataccaagtctatccaagttgccagtttattagaaatctacagtttcttgtggttgaccgtcagagttatcttattcagaaaaagatcgctcattccatgggccttctacgccgttttcctcaaaatgagatacgaaaagtccattttcaccagaaactacttcaagtctttggaactccaattggatgaagctgtcaacaaaattaacaacccagctgtcaaggatgtatggatcaaagccaagggcgtcatcagaaatgccggtggaatctacctcgttaacgactacaccaaggaaaaactgacctaa

SEQ ID NO: 8554 - protein, 277 aa, Debaryomyces hansenii CBS767
MSNQAKSAPNAATSKPATSASTTAGAPKSKGVNTSQLVETIQTLQFAWFVGHVLTLWGIFLFTLTFIKSGSRFHRFWYQLALFGIIESFGILLYQLITKKALKVNQILKDDNTQYFLLGSVLLLIRPYVLIPLLPFALFSLFHVLAYTKGYLLPIFGMADRGISKQIENFISKNNTKSIQVASLLEIYSFLWLTVRVILFRKRSLIPWAFYAVFLKMRYEKSIFTRNYFKSLELQLDEAVNKINNPAVKDVWIKAKGVIRNAGGIYLVNDYTKEKLT

SEQ ID NO: 8555 - DNA, 729 bp, Yarrowia lipolytica CLIB122
  CDS (1)..(729)
atgctacgcatagtttcgtttactcccactaactcaggccaccttctcgtcctcgtcggatgctttttctacgtccttgccaccctccccttctttcgagttggcaagttctccatcttctggtaccgagaaattttcctctctgtcatcgccacctttggaatcatcatcttcgagacctacaagggcaagcctctgaacccccaggctctcgcccgagacgacaacgtcacctaccttctggttgccttcctgtggctcgtcagcaagcccacctacggcaccttcctgccctttgccattttctctctcttccatgttctgacctacgtgcgaggcttcattctgcctgccctcggctaccccggcaacgctggcctctctctccagattgacaactttgtcaagacctacaacgacaagttcatgttcaccgctgccaacttggagttcatgatgttcttgggtctgattatcaaggccatcaccttccagcgaggctcttggatcaagctcatcatcttctttgtcttcctgcgtctgcgatacgcccagtctctgttcacccgatccgttgtcggttcctgggaggtccgagtcgatggcctgctgtctcaccctgccgttcctcctcaggtcaagcagacctgggtcactgtcaagcaccagctgcgaaagaccctcggaggtgccggtgcccctgtcacccaggagcagcgagctcagtaa

SEQ ID NO: 8556 - protein, 242 aa, Yarrowia lipolytica CLIB122
MLRIVSFTPTNSGHLLVLVGCFFYVLATLPFFRVGKFSIFWYREIFLSVIATFGIIIFETYKGKPLNPQALARDDNVTYLLVAFLWLVSKPTYGTFLPFAIFSLFHVLTYVRGFILPALGYPGNAGLSLQIDNFVKTYNDKFMFTAANLEFMMFLGLIIKAITFQRGSWIKLIIFFVFLRLRYAQSLFTRSVVGSWEVRVDGLLSHPAVPPQVKQTWVTVKHQLRKTLGGAGAPVTQEQRAQ

SEQ ID NO: 8557 - DNA, 843 bp, Aspergillus nidulans FGSC A4
  CDS (1)..(843)
atggctccccctcctccgtcaaatttacccttggccgaaaggcttaaggctctggcccagacactgcagtttgcttggttcatcgggcatgtgacattgctaggctctgtcttccgatacctactctcctatgccaccttcaactactactcgggtgcggcacaggtatcttaccgcctagcgttcatctccgccgccgttacctacggaattgttgtgtataagggacatgtcgcacgtggacgtctccaagggagccttcccagcatcttgctgaagcttgcgggcgatgagaacgttcagtatctgggaatggccttggtgtggctctattctcgccaggtgccgcttgctctgctaccattcagcgtctactccgtcttccatgttgcaacttacactcgcgcccacctaattcctactctccaacctccgagcacccccgctggatctcctggccgtgcgaacgcgaagcagtcgccattggcagagaccatcgggcgatttgtcaagcagtactatgacgctagcatggatctcgtagctggactggaaattgccctcctgttccgcttgctattggccatccttaccttctccaagggcagcttcatcctcctattcatttatctgaccttcttccgcgcccgctacagccagagctctttcgttcagcaggctgtccgtcactttacagcaagagtcgatgcttctatgtcccaccagagcactcctccggcggtgcgtcagggctgggagggctttaaggatgccgcccgtcaggcataccaggctaccgacgttagccgctttactgccggagcaggaaagaagccccaatga

SEQ ID NO: 8558 - protein, 280 aa, Aspergillus nidulans FGSC A4
MAPPPPSNLPLAERLKALAQTLQFAWFIGHVTLLGSVFRYLLSYATFNYYSGAAQVSYRLAFISAAVTYGIVVYKGHVARGRLQGSLPSILLKLAGDENVQYLGMALVWLYSRQVPLALLPFSVYSVFHVATYTRAHLIPTLQPPSTPAGSPGRANAKQSPLAETIGRFVKQYYDASMDLVAGLEIALLFRLLLAILTFSKGSFILLFIYLTFFRARYSQSSFVQQAVRHFTARVDASMSHQSTPPAVRQGWEGFKDAARQAYQATDVSRFTAGAGKKPQ

SEQ ID NO: 8559 - DNA, 1005 bp, Candida albicans SC5314
  CDS (1)..(1005): transl_table=12
atggcaatttttattagcagaaaaagtaacggaaaggccaaaaaaaaagaatacaatttactatcaattaaaagcaatcaaatcctctttgctttcagacagtgtcacttgttccatcacccttgctttccctattactcattatatacatcaatgccaccaacacaacctacacctacaaactctgctaatctcagataccgaactcctttacaacaacttgtgacattggctaaaacacaacagttttattggttccttggccatgttttcgcagtgttatttttcattcttagtacccttacagggttttggaatcgtcattcttctttgaaatactaccggttttcattattatcaattatattgacgtatttgattgttattagacaaatccatttcaaatctacttttaaactttcaagcatcaatatcagattgttgcgtgatgaaaatgtacaatatttattgttggctgttatattttatgtctcgagttttattattggccaaacagggtctagtttatattcatttgccattttcgctgtgtttcatgtgctgacttatttccaaaaccatttattatctgtttttattggtgacattgccacacaaagcagaatcagttccatgatttcaaattttaccagcaaattcaaccaaccagcattgattgctgcatccaatgcagaaattgtattgttggttgtttcagggttccaattaatccctagtgcattgttgttattgtttagacgtaacatagttgaagtctctgtacaagtattggtgtttgtggccattgtggtgtttaacaaattgagatttgattctaatcaatatacaaaagtggtggttgaacaaatggatttgaaagtgaatcaaacgcttgcacaaatcaacagtccacaattgtcacaattgtaccagaatgctcgagcaggtgcattaaagtacctctcgttgatcaaattgcccaaagaaagtggtaaaaaaaagtaa

SEQ ID NO: 8560 - protein, 334 aa, Candida albicans SC5314
MAIFISRKSNGKAKKKEYNLLSIKSNQILFAFRQCHLFHHPCFPYYSLYTSMPPTQPTPTNSANLRYRTPLQQLVTLAKTQQFYWFLGHVFAVLFFILSTLTGFWNRHSSLKYYRFSLLSIILTYLIVIRQIHFKSTFKLSSINIRLLRDENVQYLLLAVIFYVSSFIIGQTGSSLYSFAIFAVFHVSTYFQNHLLSVFIGDIATQSRISSMISNFTSKFNQPALIAASNAEIVLLVVSGFQLIPSALLLLFRRNIVEVSVQVLVFVAIVVFNKLRFDSNQYTKVVVEQMDLKVNQTLAQINSPQLSQLYQNARAGALKYLSLIKLPKESGKKK

SEQ ID NO: 8561 - DNA, 813 bp, Candida albicans SC5314
  CDS (1)..(813): transl_table=12
atggccgaagaaaagaaagctggtggtggtggttctgctgctgctgctgcaccagcaattaaatttgatcaagataaattacttaaaaccgtccaaacattacaatttggttggtttgttggtaatgtattaacattattaggattttttttatttacattatcatattttggaattttacctgatgttggatttgtatggtatttaatttcattattaggagcattgatttcatttggaattttacttgttcaatttattcaaaaaaatggatttaaagtaccacttttaattaaagatgataatttccattattttttattagcgttttttttaattgctatgagagcttatgtatggattacattagtaccatttgttatatttacaagtttccatgttttaaattatgttaatactcatttattaccaattgttggattagatggtaataatccaatttcaaaacatattactgcttttgttaataaaaataatcttgcttcaattcaaattgctagtggaattgaattactcacggttgtttggttattccttagaatgatcacatttagaaaaagatctttaactccatttttagtatttcttgttttcttaaagaaaagacatgaagtttctccattcacaagaaaatattttgatttctttgctgctcaaggtgattctattgtttctactataaataaccctgtgattaatgatgtttggggccatgttaaaacagcattcagaaccattgatctgtttaaattggttcatgatcgaaccaaagatgaagataaggccaaatga

SEQ ID NO: 8562 - protein, 270 aa, Candida albicans SC5314
MAEEKKAGGGGSAAAAAPAIKFDQDKLLKTVQTLQFGWFVGNVLTLLGFFLFTLSYFGILPDVGFVWYLISLLGALISFGILLVQFIQKNGFKVPLLIKDDNFHYFLLAFFLIAMRAYVWITLVPFVIFTSFHVLNYVNTHLLPIVGLDGNNPISKHITAFVNKNNLASIQIASGIELLTVVWLFLRMITFRKRSLTPFLVFLVFLKKRHEVSPFTRKYFDFFAAQGDSIVSTINNPVINDVWGHVKTAFRTIDSFKLVHDRTKDEDKAK

SEQ ID NO: 8563 - DNA, 897 bp, Ustilago maydis 521
  CDS (1)..(897)
atgccacgaccatcggcgtcgacgccccacctgatctgggcggcgggtcacttcctgtgcttctttgccggtctgcgctatctggcgggtacggtgatgtttgcaacctcttcgggcggtctttcgcgctggtatacggcaacgtactttggcgccatcatctcgtactgtgtcgttgtctataaatcctttggcgtacctcagctcaacaaggcgtacgtgcagcgcgctctgatggacgagaacgtacaatatctgtttctggcgatctactggttcatgtcgaaaccgatctttatcagcttggtgccgtttgtcacgttttcgctcttccacgtgctgacgtttttgcgaaccacgctgattccgatcgtgtttccgtctggatcacctgcaccgggagccaaccaggcggccgccggaggcgcacctgctgtccaagccactgcgccgccagccaagatcgccaagttcatccaatcgtgggtcaaggcgaactacgatccagcgatgcgcttcgtcgcttatgccgaagtggccatctttgcgcgtgtgctgttgggggcgttgctgttgcgcaactcgttgttggctccgctgttctacgcacattttttgcgtctcaggttctacatgagctcgttcacgagagccgcgttccagcatgttaagagcatactggacgggtacacgcagcatcagagttgcccgcccgtggtgagaaaggcatacttgaccttgaccgatctgatcagccggtatgctagctcggtgctgtctgtgcagagtgcaggcgctgctcagcccggcgcgggtgcagcgggtgcagctggcggagctggcggagctgcgccaccgccgaatcccgccgctgcagccgcaccaccaaggaggtag

SEQ ID NO: 8564 - protein, 298 aa, Ustilago maydis 521
MPRPSASTPHLIWAAGHFLCFFAGLRYLAGTVMFATSSGGLSRWYTATYFGAIISYCVVVYKSFGVPQLNKAYVQRALMDENVQYLFLAIYWFMSKPIFISLVPFVTFSLFHVLTFLRTTLIPIVFPSGSPAPGANQAAAGGAPAVQATAPPAKIAKFIQSWVKANYDPAMRFVAYAEVAIFARVLLGALLLRNSLLAPLFYAHFLRLRFYMSSFTRAAFQHVKSILDGYTQHQSCPPVVRKAYLTLTDLISRYASSVLSVQSAGAAQPGAGAAGAAGGAGGAAPPPNPAAAAAPPRR

SEQ ID NO: 8565 - DNA, 840 bp, Phaeosphaeria nodorum
  CDS (1)..(840)
atggcccctccaccgccagccaacctcccgctgggacagcgcctcgccgctctcgcgcaaacactgcagtttgcgtggtttgccggacacgtgacactcctgctcgctactctgcgttacagcctgagctacatcaccttcaactactattcgagatgggctagcttctcctaccgcgtcgccttcctctccgcgtgcgtcacatatggtattgtcgtctacaaggcataccgcgcacgcatgaggaccggcaagcagggcggaatcctgactctcgcaaccgacgagaatgtgcagtacctggtcatggcacttatctggctcttctcccgccagatcccgcttgccgtcacgccctttgcggtctactccgtcttccacgtcgctacttacgtgcgctccaacctgctgcctaccatccagccacctcccgcctccgccgccgctggctccaagcccccagcgtcgggcgcctctgaggccattggcaagttcgttaaggagtactacgatggcagcatgacgcttgtcgccctgctcgagatcgcgctctggttccgcgtcgtcggctccgcgctgctcttccagaagggcagctggatcctgctcggcgtctacaccgtcttcttccgcgcccgcgtcgcgcagagcagcttcgtccaggaggcgattcactcgctgactgcacgcattgatgcgcagctggctaaccagagcacaccccccgcggcccgcaatgcgtggggcacgttcaagggtatcatccgccaggcgggtgatgcgactgacattcgcaagtatgttggtggccagcagggcgcgcccaagaaggcgcagtaa

SEQ ID NO: 8566 - protein, 279 aa, Phaeosphaeria nodorum
MAPPPPANLPLGQRLAALAQTLQFAWFAGHVTLLLATLRYSLSYITFNYYSRWASFSYRVAFLSACVTYGIVVYKAYRARMRTGKQGGILTLATDENVQYLVMALIWLFSRQIPLAVTPFAVYSVFHVATYVRSNLLPTIQPPPASAAAGSKPPASGASEAIGKFVKEYYDGSMTLVALLEIALWFRVVGSALLFQKGSWILLGVYTVFFRARVAQSSFVQEAIHSLTARIDAQLANQSTPPAARNAWGTFKGIIRQAGDATDIRKYVGGQQGAPKKAQ

SEQ ID NO: 8567 - DNA, 24 bp, Artificial sequence
  primer
atgtcatcaagacccgctaataac

SEQ ID NO: 8568 - DNA, 25 bp, Artificial sequence
  primer
tcaattctgcttcttggtcacttgt

SEQ ID NO: 8569 - protein, 257 aa, Artificial sequence
  consensus sequence
  Variant (2)..(2): Xaa in position 2 is any amino acid
  Variant (5)..(5): Xaa in position 5 is any amino acid
  Variant (8)..(25): Xaa in position 8 to 25 is any amino acid
  Variant (26)..(34): Xaa in position 26 to 34 is any or no amino acid
  Variant (36)..(47): Xaa in position 36 to 47 is any amino acid
  Variant (49)..(65): Xaa in position 49 to 65 is any amino acid
  Variant (66)..(82): Xaa in position 66 to 82 is any or no amino acid
  Variant (84)..(84): Xaa in position 84 is any amino acid
  Variant (86)..(87): Xaa in position 86 to 87 is any amino acid
  Variant (89)..(91): Xaa in position 89 to 91 is any amino acid
  Variant (93)..(106): Xaa in position 93 to 106 is any amino acid
  Variant (107)..(110): Xaa in position 107 to 110 is any or no amino acid
  Variant (112)..(117): Xaa in position 112 to 117 is any amino acid
  Variant (121)..(122): Xaa in position 121 to 122 is any amino acid
  Variant (124)..(127): Xaa in position 124 to 127 is any amino acid
  Variant (129)..(142): Xaa in position 129 to 142 is any amino acid
  Variant (143)..(165): Xaa in position 143 to 165 is any or no amino acid
  Variant (167)..(184): Xaa in position 167 to 184 is any amino acid
  Variant (186)..(201): Xaa in position 186 to 201 is any amino acid
  Variant (202)..(214): Xaa in position 202 to 214 is any or no amino acid
  Variant (216)..(224): Xaa in position 216 to 224 is any amino acid
  Variant (226)..(228): Xaa in position 226 to 228 is any amino acid
  Variant (230)..(232): Xaa in position 230 to 232 is any amino acid
  Variant (234)..(256): Xaa in position 234 to 256 is any amino acid
FXWFXGHXXXXXXXXXXXXXXXXXXXXXXXXXXXYXXXXXXXXXXXXIXXXXXXXXXXXXXXXXXXXXXXXXXXXXXXXXXXDXNXXYXXXAXXXXXXXXXXXXXXXXXXPXXXXXXFHVXXYXXXXLXXXXXXXXXXXXXXXXXXXXXXXXXXXXXXXXXXXXXIXXXXXXXXXXXXXXXXXXEXXXXXXXXXXXXXXXXXXXXXXXXXXXXXSXXXXXXXXXFXXXRXXXSXXXXXXXXXXXXXXXXXXXXXXXP

SEQ ID NO: 8570 - protein, 24 aa, Artificial sequence
  protein pattern
  Variant (2)..(9): Xaa in position 2 to 9 is any amino acid
  Variant (10)..(11): Xaa in position 10 to 11 is any or no amino acid
  Variant (14)..(14): Xaa in position 14 is Ile or Val
  Variant (15)..(16): Xaa in position 15 to 16 is any amino acid
  Variant (17)..(17): Xaa in position 17 is Phe or Tyr
  Variant (18)..(21): Xaa in position 18 to 21 is any amino acid
  Variant (23)..(23): Xaa in position 23 is Ile or Leu
  Variant (24)..(24): Xaa in position 24 is Gly, Pro or Ser
LXXXXXXXXXXFHXXXXXXXXLXX

SEQ ID NO: 8571 - DNA, 381 bp, Saccharomyces cerevisiae
  CDS (1)..(381)
atgctttctaggcttattcaacacataacctcaattttcgttttctcattcttttttctttttttttttttctcactaaagcgttgtcctagagatgtaaaaagagaaggaaatgaaatttttactggaaatgttactactattacacaggtttatttagaaagtacaaacgtgtcagcgtatttagggtgtcaatgcaacaatattgaaactatcatttgtcttcagaatagcggcaataccaccatctccgcataccacgtccatatcagtgaaatcggcagtgtcgctttgcaaacagagggcgctctcctcgtctttagtccaattttttgttttcttgtcaaatttgtatatcgtcagcgaattgctctcgtttga

SEQ ID NO: 8572 - protein, 126 aa, Saccharomyces cerevisiae
MLSRLIQHITSIFVFSFFFLFFFFSLKRCPRDVKREGNEIFTGNVTTITQVYLESTNVSAYLGCQCNNIETIICLQNSGNTTISAYHVHISEIGSVALQTEGALLVFSPIFCFLVKFVYRQRIALV

SEQ ID NO: 8573 - DNA, 25 bp, Artificial sequence
  primer
atgctttctaggcttattcaacaca

SEQ ID NO: 8574 - DNA, 23 bp, Artificial sequence
  primer
tcaaacgagagcaattcgctgac

SEQ ID NO: 8575 - DNA, 540 bp, Saccharomyces cerevisiae
  CDS (1)..(540)
atgcctggtcttaagcttgttgaagctttagaatacaggtgtgaccgattggagcggcttataggcgccggatacagcgcgaattccgatgtttcagtgcaattagatgaactatacaatcagttacatcgtctatatttccagggtctaaagtattctcaagatctcctgcaactctttaatactttcatggctgaagacatcgagaacgtgggagctcctgatgatatttgtatttttgctagttgctttgacgatatttatacattatatagtgcatttgacgaactaaacagccaatatatggagttttgccaaatcagtaaaagttcattggatcagatttccttcaaagacgcaaatattgaaacgaaacagttgaagaagttacccgagttggtggataactgcaacataatgattttgaggtcaattgcaattctaaaccgtttcatcgactggaatattgaagttaacggattcttccagttccagaaaaagaggctgttgaatttacaaaaggtaatttatagtacgtga

SEQ ID NO: 8576 - protein, 179 aa, Saccharomyces cerevisiae
MPGLKLVEALEYRCDRLERLIGAGYSANSDVSVQLDELYNQLHRLYFQGLKYSQDLLQLFNTFMAEDIENVGAPDDICIFASCFDDIYTLYSAFDELNSQYMEFCQISKSSLDQISFKDANIETKQLKKLPELVDNCNIMILRSIAILNRFIDWNIEVNGFFQFQKKRLLNLQKVIYST

SEQ ID NO: 8577 - DNA, 24 bp, Artificial sequence
  primer
atgcctggtcttaagcttgttgaa

SEQ ID NO: 8578 - DNA, 27 bp, Artificial sequence
  primer
tcacgtactataaattaccttttgtaa

SEQ ID NO: 8579 - DNA, 1596 bp, Saccharomyces cerevisiae
  CDS (1)..(1596)
atgtcaaaagttgacgtaaaaattggagcagactcgatctcctcttctgatgaaatcctagttccttcgagactcgctgatgttacgctagcattcatggaggagaatgacgcagcagttccagaaatcacgcctgaacaagaaaaaaaattaaagagaaagctttttctcacaatattcacctttgtctctgccattaaccttttactttacatggacaaagccactttatcctatgattcgattctaggcttctttgaagatacaggtcttacccaaaatacttacaatactgtaaatacgctgttttacgttggttttgcaatcggccaatttcctggacaatacttggctcaaaagttaccacttgggaaattcttgggtgggttgttggccacatggactatacttattttcctaagttgtaccgcatacaacttttccggtgtcgttgcgttgagatttttcttggggctaacagagagtgttgttatcccgatattaattaccactatgggtatgttcttcgatgcttcagaaagagctgctgctcagccatttttctttgcagcatgtatggggtctccaattccaactgggtttattgcttatggtgttcttcatataacaaatcccagcatttcgttatggaaaatattcactatcatcattggtggtttgacttttatcatgacggttgttgtaattctgtggtttcctaataatcctgctgatgtgaaattcttttcaatacaagaaagggtatggattatcaggagagttcaggcatccacaggctcttccattgaacaaaaagtcttcaaaaagagtcaattcagagaggcaatgaaagattatataacctggttatttggattgttttttcttcttcaacagttagccaacaatctgccctatcaacagaacctgctatttgaaggaatgggtggagttgatgctctaggttcgacattggtatcagttgccggtgctggtttcgccgtcgtttgtgccttcatcgctacgttgatgttagcaaaatggaaaaatatttcagctttaacagccatcttttggactttaccagcattggtgggatccatcgctgcagctgctttaccatgggacaataagattggtatcttagcaaatatctgtatggcaggacaaatatttggtattccttttattatagctcttagctgggcaagttcaagtgcatctgggtacaccaaaaaactcacaagaagttcggtgtccttatttgcgatgggaattgctaatatcatatcaccacaaatatggagagagaaggactctcctcgctttttacctgcctggattgttcaaatcgttttatcattctctcttgcaccagccattttgttactgatccatttcatactaaaaagaaggaataatcaaagactaaaaaattatgacgaaaatttacaaaattatttggacagaattcaactcattgaaagcgaaaatccttcttccattgaagaagggaaagtggtaacccacgagaacaatttggcagtctttgatttgactgatttagaaaacgaaacttttatatatcctttgtaa

SEQ ID NO: 8580 - protein, 531 aa, Saccharomyces cerevisiae
MSKVDVKIGADSISSSDEILVPSRLADVTLAFMEENDAAVPEITPEQEKKLKRKLFLTIFTFVSAINLLLYMDKATLSYDSILGFFEDTGLTQNTYNTVNTLFYVGFAIGQFPGQYLAQKLPLGKFLGGLLATWTILIFLSCTAYNFSGVVALRFFLGLTESVVIPILITTMGMFFDASERAAAQPFFFAACMGSPIPTGFIAYGVLHITNPSISLWKIFTIIIGGLTFIMTVVVILWFPNNPADVKFFSIQERVWIIRRVQASTGSSIEQKVFKKSQFREAMKDYITWLFGLFFLLQQLANNLPYQQNLLFEGMGGVDALGSTLVSVAGAGFAVVCAFIATLMLAKWKNISALTAIFWTLPALVGSIAAAALPWDNKIGILANICMAGQIFGIPFIIALSWASSSASGYTKKLTRSSVSLFAMGIANIISPQIWREKDSPRFLPAWIVQIVLSFSLAPAILLLIHFILKRRNNQRLKNYDENLQNYLDRIQLIESENPSSIEEGKVVTHENNLAVFDLTDLENETFIYPL

SEQ ID NO: 8581 - DNA, 1527 bp, Schizosaccharomyces pombe 972h-
  CDS (1)..(1527)
atgtcaagcatcagtatagacgaaaagctgaaagatcccgagagtgtccaaaataaggaaattctcgatgtcgacgttggcgatctctcgccaaaaggcgtggatgctgctttcaattacgcccttgatgtcgactacgatgagatcgatccagaaacggagcgtagattggtacgcaaaatcgattgcacaatcttccccgtcatgtgtctagtatactgcatccaatttttggacaaaacttcaaattcctatgccgttatcatgggtctcaaagaagacttgaagatggaaggtcaaatgtatagttggtcaggtactgctttctacttgggttaccttgtcttcgaattccctgcatctcttcttcttcagcgctttcctttatccaagaccttgtgtgttttcttagtcatttggggtttcttgctttgcatgacctcagttgccaactatcctggctttatcgctcttcgtgtgcttctcggtatgatggaatctgccgccagtcctggtttcattcttctcactgctcaatggtacaagcgcagtgaacaacaacttcgtacttccgtatgggtcgcttttaatggtttgggtcagatccttggtagctgcatggcttatggtttggccaagaggaccagtcttcccatgagaggttggaagcttattttcattatttgcggtgtcctcgccattttcttgggatttgtcattcttgccgtcgttcccgacaatcctttcaaagcctggtttctcactgaagaagatcgtaagttggttgtcaagcgtcttcgtgccaacaagcaaggtgttggtaataatcactttaaattgtatcagtttaaggaaaccatgcttgatattcgtacttggattatgtttgtctcatccgttcttttgaatattcccaatggtggtatcggtacattttcctctcttttaattaaaggtaccatgggttatgatacccttcaaaccttgcttatgggtcttcctgccggcgcttgtgaatttggtggattgatcgcctttgggtttttgagtttgttcattcataaacgtatggttttggctaccatcaccacatgtattgccttgattggatcctgtttgctttctttcgctggtcctcctcgtgcacagcttgcaggttactatttattgatggtttctccaggtgccatgattgtcatgttcgccatcatttcttccaacgcctctggttatacaaagaaagtcactgttggtgttatctatcttatcggatactgtgtgggaaatttaatcggccctcaaactttcaaagctgctgacgctcctgaatatatgcctgctaagaacaccatggtcggttgttatgcagcaactttagtcacatttcctgctctttactatgttaattggagagaaaacaagcgtagggatcaattggctgcggagggaaagattgagcatcgtcccaatgctgaatttgaagatcttacagattttgagaatcttgatttcagatacactttatga

SEQ ID NO: 8582 - protein, 508 aa, Schizosaccharomyces pombe 972h-
MSSISIDEKLKDPESVQNKEILDVDVGDLSPKGVDAAFNYALDVDYDEIDPETERRLVRKIDCTIFPVMCLVYCIQFLDKTSNSYAVIMGLKEDLKMEGQMYSWSGTAFYLGYLVFEFPASLLLQRFPLSKTLCVFLVIWGFLLCMTSVANYPGFIALRVLLGMMESAASPGFILLTAQWYKRSEQQLRTSVWVAFNGLGQILGSCMAYGLAKRTSLPMRGWKLIFIICGVLAIFLGFVILAVVPDNPFKAWFLTEEDRKLVVKRLRANKQGVGNNHFKLYQFKETMLDIRTWIMFVSSVLLNIPNGGIGTFSSLLIKGTMGYDTLQTLLMGLPAGACEFGGLIAFGFLSLFIHKRMVLATITTCIALIGSCLLSFAGPPRAQLAGYYLLMVSPGAMIVMFAIISSNASGYTKKVTVGVIYLIGYCVGNLIGPQTFKAADAPEYMPAKNTMVGCYAATLVTFPALYYVNWRENKRRDQLAAEGKIEHRPNAEFEDLTDFENLDFRYTL

SEQ ID NO: 8583 - DNA, 1713 bp, Schizosaccharomyces pombe 972h-
  CDS (1)..(1713)
atgaccgagtctatcatctcatctcgtactgcatcgatttcctcgaaagagggttacgaaataagacagggctccaccgactcgagttctcttgatttggagaaaaaggaaaatgccgttgatactacaattgctaaaccctttgactctgatgaggatatcgccgacgtggaaaaagctggtgggaaaaaaataaacaattctttgatcgatgaaacttttgcttttatgcaagatgccaagaagttggatcccttgacccctaaacaagagagtaaacttaagtggaaactgtacatttatttgttgctaatgttgggttttttggatatgatgcttttcattggtaaggcgacacttagctattcaactattctgggtctttttgatgatgtacacatcacctccaatcaatacaataatttgaatactctgttttatgtcggctatatcgtaggtcaatttcccggtcactacatcatgcaaacttttcctcttggaaaatttgtcggccttgtcaccttttcttggagtgtaatcgtttttttgcattgttgcgcctataattacggaggtcttattgcccttcgatttttccttggctttactgagtcttgcttactaccagctatggaggctactatgggcatgttttttactcatcaagaacaggcatttctgcagcctgtattttggatctcatgtctaagctgcggtattcctgctggttttattgcctatggccttgagtttgtcacgaaaagcattgcaccctggaagctctttatgatcattaccggtggtattacattcttcttaagtattttccttttcttctactatccagacaatccatcaaaggccagatttttaactgacgaggaaaaattgtataccattgatcgtgtacgcaagtccactaggggtggaattgaaaacaagattttcaagaagcaccaatttatagaagcgctgaaagatccaattacttggctatttacttttgccgccttcacactcatgctctctaacaacttggcttatcaacaaaatcttatttttacaagtttaaacgtctcagacctcaattctactttagttggcgttgctcttgctggatataatactgtgagcgctattattgctacttttgccatgtatcttattccaaatcaaagtgcataccatgctatgttttggatgctgcccagtattactggaggtattgctttcgtagccctgccttggtccaacagaattggagagttggctactatgattattgcatccgattttggtatcacatacatcattgctttaggatggaccactgctacatccactggctatacgaaaaaactgactcgtggtttgatgtttatggttggatatgccattgccaacatcatttcacctcagctatggcaaagccgtgatgcacctagatattatccggcgtggattgtgcaaatcgtagttgcatggtttgtcacacccataatttacctggtagcacgagtgattttggcaagacgcaataagcagagaaaggaattgaaagataagaaaattgcggaaggcagtctggaaaccatagaaaagacttatgttgacacagtggatgaattcggcaatcccgtcaaagtactgattgataattctatgttggatttaactgacatggaaaacttaaactttgtttatcctctttaa

SEQ ID NO: 8584 - protein, 570 aa, Schizosaccharomyces pombe 972h-
MTESIISSRTASISSKEGYEIRQGSTDSSSLDLEKKENAVDTTIAKPFDSDEDIADVEKAGGKKINNSLIDETFAFMQDAKKLDPLTPKQESKLKWKLYIYLLLMLGFLDMMLFIGKATLSYSTILGLFDDVHITSNQYNNLNTLFYVGYIVGQFPGHYIMQTFPLGKFVGLVTFSWSVIVFLHCCAYNYGGLIALRFFLGFTESCLLPAMEATMGMFFTHQEQAFLQPVFWISCLSCGIPAGFIAYGLEFVTKSIAPWKLFMIITGGITFFLSIFLFFYYPDNPSKARFLTDEEKLYTIDRVRKSTRGGIENKIFKKHQFIEALKDPITWLFTFAAFTLMLSNNLAYQQNLIFTSLNVSDLNSTLVGVALAGYNTVSAIIATFAMYLIPNQSAYHAMFWMLPSITGGIAFVALPWSNRIGELATMIIASDFGITYIIALGWTTATSTGYTKKLTRGLMFMVGYAIANIISPQLWQSRDAPRYYPAWIVQIVVAWFVTPIIYLVARVILARRNKQRKELKDKKIAEGSLETIEKTYVDTVDEFGNPVKVLIDNSMLDLTDMENLNFVYPL

SEQ ID NO: 8585 - DNA, 1494 bp, Schizosaccharomyces pombe 972h-
  CDS (1)..(1494)
atggagaagacagaagaagaaaattacagtattaaggagttgggtgaaaaaggatcagacagccaagaggatgttgctgtgatttttgcagagaaacatcccattattgacaaatcgctaaatcgaaaactcaaattaaagacagatttatgggttatgccacttctctgcctcatttcagcatttcaatatatggacaaatccaccagtaattattcatcaattatgggtattcgcaccgatttaaatatggtgggcaatcaatacaattgggttggtacgtctttttatcttggttttatggtattctcgttaccattatccactctgttacaaaaatttcctcttagcaaagtaacgtctgccttcattgtggcctggggtatattaatgaccttgacttgcctggtgcattcttatgcttcctatatcgctactcgtactttgttgggtatattggaatcagttattacgccagcttttgttttgtttattgcacaatggtatagaaaagaagaacaattttttcgtatggcattccttgtagcctggaatggacttggtggtcttattggaggaagtatgtcttacggcttgtataaacgagagcttgaaaacaatttaaccatgtccccttggagaatcttatttattatcactggattgattaccataattaacggggttttcatatttattcacattcccgatgaaccctccaaagcttggttcttgagtgaaaaggaaaaggatcttgtcctcaagcgtttagacactgatcatgcagggcttggcagcaaaaagtttaagaaataccaaatattggaagcttgtcgagatgtacgtatgtacttatactttttcctacaaatagccgttgctatccctaatggtgggctttcaaattttagtagcatcatgttaaagaatcttggctacgtaaaaggtaaggcattgcttatgaatatgcccacttcctccatttcgtttgctgccttaactttgtttggccttatcccagagtttacgaatagacgaatggatattgctttggttggcctggctattaacttaacttccggatcacttattgcatttgcaaaacctacacatgcacaacttgcaggatactggttgtttggcatttcaccaattccatatatttgcatccttagctgcatttcgtctaatagcgcaggccacaccaaaaaagtttttatgagcgctgtttccatgattggatattgcgttggaaatatggtcggcccccaaacatttaggtctacacaagctccaaaataccaaggagctaaagtatcatttgtcgtttgttattgcgttgctatatttattattattgctatttatgccgttaatgtgcgagagaatcgcagaagggatgaaaaaaacgaatatttatcaaatgaattgagtgaggaagacaaaaaggatttgaccgactttgaaaatcccgaatttcgttattctatttaa

SEQ ID NO: 8586 - protein, 497 aa, Schizosaccharomyces pombe 972h-
MEKTEEENYSIKELGEKGSDSQEDVAVIFAEKHPIIDKSLNRKLKLKTDLWVMPLLCLISAFQYMDKSTSNYSSIMGIRTDLNMVGNQYNWVGTSFYLGFMVFSLPLSTLLQKFPLSKVTSAFIVAWGILMTLTCLVHSYASYIATRTLLGILESVITPAFVLFIAQWYRKEEQFFRMAFLVAWNGLGGLIGGSMSYGLYKRELENNLTMSPWRILFIITGLITIINGVFIFIHIPDEPSKAWFLSEKEKDLVLKRLDTDHAGLGSKKFKKYQILEACRDVRMYLYFFLQIAVAIPNGGLSNFSSIMLKNLGYVKGKALLMNMPTSSISFAALTLFGLIPEFTNRRMDIALVGLAINLTSGSLIAFAKPTHAQLAGYWLFGISPIPYICILSCISSNSAGHTKKVFMSAVSMIGYCVGNMVGPQTFRSTQAPKYQGAKVSFVVCYCVAIFIIIAIYAVNVRENRRRDEKNEYLSNELSEEDKKDLTDFENPEFRYSI

SEQ ID NO: 8587 - DNA, 1494 bp, Magnaporthe grisea 70-15
  CDS (1)..(1494)
atgtcggaaaaggagcaaaccatcgttgacccgaaacataatggcgggaatgttagcgtcagcgacggcgatgctgccttgcagtttcttaacaatggcacggcgacagtcatgacagaggccgacgagaagcgactgcttaggaagattgaccgcaccattatgcctctgatgttcgcgtgctattttctgcaatacctcgacaagaccctcatcaactatgccaacgtcatggggctgcaaaaggacacgggcatcaacacagatcagtactcacagctggccctcatcttttacgtctcgtacctcgttttcgagttccccaccggctacctgatgcagcgactcccaacatccaaatacctcggcttcaacgtctgcgcttggggcatgatggttgcgtgcaccgcggcggcgaacagctgggcgggacttgtgaccctgagggtgctgctgggctgcttcgaggccgtcgtggctccctcgctgatcctcatcaccaccatgtggtaccgcaagtcggagcagcctccacgcgtgggcttgtggtacgtcggcacgggcatcggcaagatggtgggcgccttgacgtcttttgggttccagcactacaccggcaacgtcatgcggtcgtggcagatcatgttcctcgtgtttggactgataacagtcgccgtcgggatcctggtcgtgctcttcatgccggacagccccatgaagtcacgactgacccaagaagaaaaagtctgggcgatcgagcggctcagaggcaacaagacgggcgtcgaaaacaagcacctcaaaaagtaccaggtgtatgagtgttttcgagacccgcagacttttctgctcgtcttgattgtcctttcgtcaaacatacccaacggcttcatcagcagctaccaggcgtctgtcatccaaagctttggttttacctccaagcaggctgccttgctgtctataccctcgggtgccgttgcctgcttcgccacaatcaccggaacctggtttgccgggagattcaaccttaggggccccttcatccttgccactctcggaatgggctttcttggcagcaacctcatggcattcctgccagaggatggctatgttgtcggaaagatgatcggcaactactcggccaatttcatcggctcctccctgcccctgatgtactcgtacgccggggccaactacgccggccacaccaagaaggttaccatgaatgccattgtactgatatcattttgcttgggcaacattatcggccccttgacattccgcgagcaggacaagccgcgcttcatcccggccaaaatcgccatggtcgtgaccacggcgttcgccgctctgctgaccgtcgtcctcatgctctactacaggtgggagaacaagaggcgggaccaaaagtacgcgcacgaggcccacagggagaacagcgagttttttgacctcacggaccgcgagaaccatgaattcaggccagttgtttga

SEQ ID NO: 8588 - protein, 497 aa, Magnaporthe grisea 70-15
MSEKEQTIVDPKHNGGNVSVSDGDAALQFLNNGTATVMTEADEKRLLRKIDRTIMPLMFACYFLQYLDKTLINYANVMGLQKDTGINTDQYSQLALIFYVSYLVFEFPTGYLMQRLPTSKYLGFNVCAWGMMVACTAAANSWAGLVTLRVLLGCFEAVVAPSLILITTMWYRKSEQPPRVGLWYVGTGIGKMVGALTSFGFQHYTGNVMRSWQIMFLVFGLITVAVGILVVLFMPDSPMKSRLTQEEKVWAIERLRGNKTGVENKHLKKYQVYECFRDPQTFLLVLIVLSSNIPNGFISSYQASVIQSFGFTSKQAALLSIPSGAVACFATITGTWFAGRFNLRGPFILATLGMGFLGSNLMAFLPEDGYVVGKMIGNYSANFIGSSLPLMYSYAGANYAGHTKKVTMNAIVLISFCLGNIIGPLTFREQDKPRFIPAKIAMVVTTAFAALLTVVLMLYYRWENKRRDQKYAHEAHRENSEFFDLTDRENHEFRPVV

SEQ ID NO: 8589 - DNA, 1545 bp, Gibberella zeae PH-1
  CDS (1)..(1545)
atggcaacgttttcagctcaagacgcattagacgtcaagaagatgcaaccctttgacactcatgatgtcgaagccgatattaagcaaggcaccgtcgaagaccttgatgaagcagagctgtttctccaacaacatggcattcctcactctcgactaaacgagctcatggccgatgaggaagctctcaagaaactccgccgaaaagtcgactggactcttatgccgcttctctgcggtacatacctcctccaatacgtcgacaagcaggcattgggctactcagccgtctttgatctgttcacaaccacaggaatgactcctgacgaatactcctggatggcatcaatcttctactttgcctacctcgtcgccgagtggccagcatcatacctcacccagcgtctccccacaggcacagtcgtgagcagtttcgtcatcatctggggtgccatcctctgccttacagcagcctgccacaacttcaccggcctcgccatctgccgtttcctcctcggtacctttgaagccgtcatcacaccagcctttatgctcatcgtatcacaatggttccgccgcgagacgcagccttcccgcgcaggtctcttctactgcttcaacggattcggcgccatgttcggcggcattctgttctacggtgtcggtcaagcaaagggctgggccgtgtggcgtaccatctacgtgctctgcggtggaatgaccatctgctggggcatcgttctgttcttcttcctgcccaacaacatcctcactgctaagcgatacaccattgaggagcgggccatgcttattgcacagagcgcgaggaacaagacgggtgtgtttaaccgcaagatcaagtggaaccagatccgcgaggttttctctgatatgcagatctggctactgttcttctacgttcttctcaacgagatcatcaacggtggtattgccaacttctcaaagcttatcgtcaagggcttcacacatgatgcgctgctcactacagcgtacggtatcccgtatggtgcttgcaacgccatcttcatgttcactggcccttttgtggcgtccaagtttaagaacgtccgaactattgtgatgtgtgtttggctcatccctacacttattgccgtgaacctcttctggcagcttcctcgaagcaacaagggtggtttactcgctggttattacatgtgcgcatctttcgtcggtgccctcatcgtcgctctccaaatgcccgcttcaaacgtcggtggttacaccaagcgtaccactgccacagcctttgtcttcctggcctactgtatcggcaacatcatcggtcctcacggctgggttggctccgaggcacctatttaccagaccggctgcaagcttatcattggctgtgtagcaggccaagttgtaattgccatcattctgcgttttgtgctcatccgtcgaaaccgtctccgtgatgagcaaggacctgttattgaggacgagaacgccgcgttgcaggatctcactgatttcgagaaccccaacttccgttactcttactag

SEQ ID NO: 8590 - protein, 514 aa, Gibberella zeae PH-1
MATFSAQDALDVKKMQPFDTHDVEADIKQGTVEDLDEAELFLQQHGIPHSRLNELMADEEALKKLRRKVDWTLMPLLCGTYLLQYVDKQALGYSAVFDLFTTTGMTPDEYSWMASIFYFAYLVAEWPASYLTQRLPTGTVVSSFVIIWGAILCLTAACHNFTGLAICRFLLGTFEAVITPAFMLIVSQWFRRETQPSRAGLFYCFNGFGAMFGGILFYGVGQAKGWAVWRTIYVLCGGMTICWGIVLFFFLPNNILTAKRYTIEERAMLIAQSARNKTGVFNRKIKWNQIREVFSDMQIWLLFFYVLLNEIINGGIANFSKLIVKGFTHDALLTTAYGIPYGACNAIFMFTGPFVASKFKNVRTIVMCVWLIPTLIAVNLFWQLPRSNKGGLLAGYYMCASFVGALIVALQMPASNVGGYTKRTTATAFVFLAYCIGNIIGPHGWVGSEAPIYQTGCKLIIGCVAGQVVIAIILRFVLIRRNRLRDEQGPVIEDENAALQDLTDFENPNFRYSY

SEQ ID NO: 8591 - DNA, 1506 bp, Gibberella zeae PH-1
  CDS (1)..(1506)
atgggcaacgaatccaatgtggtctgtgaggcaaatgccccctcgatcgagcctccttcgaaaggcaagacagtgacaaagaaatacgccgatgtaactcttcgtctcattgaagagcacggggatcatgctgagcctctgtctcccgaagaagagaaaaaagtccgaagaaagctatatctgcggctggtggggttgctttcgactatcaacatcatgctctttatcgataaatctactttgggctatgcagcaatcctcgggcttttcgaagagactggcatctcacaggctcagtacaataacttgaacacaatgttctacgtaggatatctcgcatttctgtggccgggccactacctcatgcaacgtttacccttcagcaagttcattgctggtattatcttcacatggtctatcgtcatcttcctccattgtgtcgcaacccgatatgcaggactcattgtacttcgacttgccttgggtgcagctgaaggagtagttgttcctgcgctcgagatgaccattggatttattgcgtatggtctcctttggaccagtgggccggttctgccctggaagctgctccatatcgttactggaggtatcactttcatcctctccatctgggtctggttcgactaccccagtaaccctgccgaggctaggtttttgacgctccaagagaagatccatatcattaagcgtgttcaacaatcacagcaaagctcaattgagcaaaagcaattcaagagatcgcagttcatcgaaaccctgaaagatccggtgtcttggttattcgcactacaggctttcaccctcatgtactgcaacaatctcacctatggtcaaaagaacctcctcgtcacatcgctcggtgttactccacttgagtctactcttgttgcagtggccgggggcggcttcggcatcgtcaactgtgtcatcgcggcatttgccctatggaaataccctaggaacttggcgttgcactgcactctttggtgcatacctgctattgccggtggtatcgggatggtgacagtaccctgggaccgaaccataggtctccttgcctgcatgttcttggctgctcacacctatggcgtcgcatacatcatagctcttgggtggaccaactcttcagctgcaggctatactaaaaagctgacaagaaatgtcatgttcatgattggttacagtgctggaaacctagtatcgccccagatctgggttgcatcagctaaaccaagattctacggagcttggtcctcgatgatcgtcatcagttggttcggaacacctgtcattttgtggattattcacttcattctggctcggaggaacgaaatccgaaaggagaggatcaatgccgctggtgaaaacgatggttatcactacgttgaacagcttgacgagggtggcagattggtcaaagtcaaggttgaagttgccatgttggatttgacggatctggagaatgagagtttcatctatccgctgtag

SEQ ID NO: 8592 - protein, 501 aa, Gibberella zeae PH-1
MGNESNVVCEANAPSIEPPSKGKTVTKKYADVTLRLIEEHGDHAEPLSPEEEKKVRRKLYLRLVGLLSTINIMLFIDKSTLGYAAILGLFEETGISQAQYNNLNTMFYVGYLAFLWPGHYLMQRLPFSKFIAGIIFTWSIVIFLHCVATRYAGLIVLRLALGAAEGVVVPALEMTIGFIAYGLLWTSGPVLPWKLLHIVTGGITFILSIWVWFDYPSNPAEARFLTLQEKIHIIKRVQQSQQSSIEQKQFKRSQFIETLKDPVSWLFALQAFTLMYCNNLTYGQKNLLVTSLGVTPLESTLVAVAGGGFGIVNCVIAAFALWKYPRNLALHCTLWCIPAIAGGIGMVTVPWDRTIGLLACMFLAAHTYGVAYIIALGWTNSSAAGYTKKLTRNVMFMIGYSAGNLVSPQIWVASAKPRFYGAWSSMIVISWFGTPVILWIIHFILARRNEIRKERINAAGENDGYHYVEQLDEGGRLVKVKVEVAMLDLTDLENESFIYPL

SEQ ID NO: 8593 - DNA, 1653 bp, Kluyveromyces lactis NRRL Y-1140
  CDS (1)..(1653)
atgactgctactaacagtttggataaggacgatgcaatcatcgagaaactcgatagagtcaactcgctgcttagcgaaggccatgcgatcgaacattactccgaggattccgacgatactgaattgagggacgataagactaagagtaagtatgccgtggtttcctcgagggatgcagatgctacgctagggttcttggaggaattcgatccacaagtgcctgcgattactgctgagcaggagaagaggttatcccgtaaggtcacgtggatcattgtgtccttaactgctttcatcaatttgattctttactcggataaggcaacagcttcttatgcatcgattttgggtttatgggaagaagttggaatcactcaaaatcagtacaataactccaatacattgttttatgtcggcttcatcgtgggtcaggctaacctttactttgtgcaaacatacccattgaaatacgttgtgtctgtcatgactgctctatggaccattgttatcttcttacactgtgcttgtaccaattacagaagtttctacgtactacggttcttcttgggttttgtcgaatccgttgctataccttgtttgaacacaacgatgggacaatttttgacagctgatgaaaaagcggcttcagcgccaatgttttacagtacctgtgttggtgtcactatcccagttggtttcatcgcttatggtgttttgaacatcacttcaacctcggtttcgttatggaaaatctttatgatgatcattggtgcttgtactttcttgctaaccatcttggtcttgttcatctatccaaataacccaactgatgctaagttcttgaatactaatgaaaaagtttgggtcattagaagagtgcaacagaccactggttcatctatcgagcagaaagttgtcaagaagcaccaaattaaagaagcgctgcttgatcctatctcgtggttgtttgctgccttcttccttttgcaacagttggccaataacttaccataccaacaaacacttttgttcaaatccattggtaatatctccagtttagactctactttggtgtctgttgcttctggtgggtttgcagtcgcttgttgtatcctggctaccactttcctattgtatttcaagaattatacggcattttcagtggtgttctggactatcccatctttcgttggttccattgcaatggtttccattccattcgacaaacatattgctttgttggccatgttgtgtatggcttctccagccttcggtgtcccatggattctaatgttcagttggaattctacaacatgctcagggtacacaaagaaattgactagaaacgccatagtgatgttctttttctgtgttgccaatttaatttcacctcaattatggcaagaaaaggacggcccaagatacatcccagcatggatcgttcaaattgtgctatcgttctccattgctccatcgattgcaatcgtcatctggtacattctaaggaagagaaatcaagaaagagccattaatttggaagctgaagaaaagaagttcggtttgatcgaagtcaacggtgaaagcatcaaagctaacatcgcaatgttggatttaacagatcatgagaataaaactttcatttatccattgtga

SEQ ID NO: 8594 - protein, 550 aa, Kluyveromyces lactis NRRL Y-1140
MTATNSLDKDDAIIEKLDRVNSLLSEGHAIEHYSEDSDDTELRDDKTKSKYAVVSSRDADATLGFLEEFDPQVPAITAEQEKRLSRKVTWIIVSLTAFINLILYSDKATASYASILGLWEEVGITQNQYNNSNTLFYVGFIVGQANLYFVQTYPLKYVVSVMTALWTIVIFLHCACTNYRSFYVLRFFLGFVESVAIPCLNTTMGQFLTADEKAASAPMFYSTCVGVTIPVGFIAYGVLNITSTSVSLWKIFMMIIGACTFLLTILVLFIYPNNPTDAKFLNTNEKVWVIRRVQQTTGSSIEQKVVKKHQIKEALLDPISWLFAAFFLLQQLANNLPYQQTLLFKSIGNISSLDSTLVSVASGGFAVACCILATTFLLYFKNYTAFSVVFWTIPSFVGSIAMVSIPFDKHIALLAMLCMASPAFGVPWILMFSWNSTTCSGYTKKLTRNAIVMFFFCVANLISPQLWQEKDGPRYIPAWIVQIVLSFSIAPSIAIVIWYILRKRNQERAINLEAEEKKFGLIEVNGESIKANIAMLDLTDHENKTFIYPL

SEQ ID NO: 8595 - DNA, 1653 bp, Kluyveromyces lactis NRRL Y-1140
  CDS (1)..(1653)
atgacaaacacagagaagcaaacggggctcttgaatgactcctcagaccattcgtctgttcattctagagacgagaagattcaagcagtggtttcgatcacggcgaacgagatcgcagatcgcgatgccttgattactaccatcttgtctccggatggcaaagaagtgaaaatcaccggtgatgtcgatgatgctatgaagttggcattgaagtctcagaatgtcgttttgactccagaaaaggatgctaagttattgaggaagatcgatttgatgcttttccctatcatgtgtattatttattctgtgcaattcatggacaaaattaccacatcgaatgctgctatcatgggtcttcaaactgatttgaaaatgcacggtgagcaatactcttacgttggatctgcattttatttcggttaccttggtggattattcattttgccattcctaatgcaaaagaccaaaaaattcatgaagatgttaaccagcatcatcgttatctggggtatggtccttgctctacacgctgctccctctgttaattacccatcgttcatcttcttgagatgtttattgggttttcttgaatccgccatcactcctgcattcaccattatcacatcacaatattggaagaaagaagaacagttctctagaattacctgctggttcgggttcaacggtcttggtagtatctggggtggtgcaattgcatatggactctacattcataaagattcttacccgcttgccgcttggaaattggtgttcattatcactggttgtatcacaatcgtcgtcggatttattatgatgatccacttgcccgattcgccagataaagcttggttcttcagcgaagaggagaagttgttacttgtggagaggattagagagaatcaacagggtttcggtaaccaccatattaagaaatatcaaattgtcgaagcattcaaggatgttagaacttggttgtacttccttttctccgtatcatccaatattccaaatggtggtatcactaatttctcctcgatcttactaaaagaagacttccaatttagtaccgataagagtttattagtcaacatgggttccggtgcggttgaattggttggttgtccattatttgggatgttatccttttggtgtttgaagcgtaaatataaggtcgttgggtcaagattggcctgggcattctttgctaccgctatatgtttcatgggtgtttgtatgcttgcctttgctaagcatgataagagtgcaaggttagccggtctaatgttatttggtatctctccagtctccttcatttgtgtcttgtcctgcatctcttccaataccttaggtttcacgaaaaaatggacagtttcctctatcaatttgttggcttatgcaagtgccaacattgcaggtccacatacattcattgctactcaggctcctagctatactggggcaaagatttcattagtggtcaactatgcagcagcgatggtcattatcgttcttatttacatcgtcaatgccagagaaaacaagagaagagacaagattgaagcagaaagaactcatgaacaagtggtggagaacattgagttcgctgatctaacagatttcgagaatttgaaattcaggtacgcaatctaa

SEQ ID NO: 8596 - protein, 550 aa, Kluyveromyces lactis NRRL Y-1140
MTNTEKQTGLLNDSSDHSSVHSRDEKIQAVVSITANEIADRDALITTILSPDGKEVKITGDVDDAMKLALKSQNVVLTPEKDAKLLRKIDLMLFPIMCIIYSVQFMDKITTSNAAIMGLQTDLKMHGEQYSYVGSAFYFGYLGGLFILPFLMQKTKKFMKMLTSIIVIWGMVLALHAAPSVNYPSFIFLRCLLGFLESAITPAFTIITSQYWKKEEQFSRITCWFGFNGLGSIWGGAIAYGLYIHKDSYPLAAWKLVFIITGCITIVVGFIMMIHLPDSPDKAWFFSEEEKLLLVERIRENQQGFGNHHIKKYQIVEAFKDVRTWLYFLFSVSSNIPNGGITNFSSILLKEDFQFSTDKSLLVNMGSGAVELVGCPLFGMLSFWCLKRKYKVVGSRLAWAFFATAICFMGVCMLAFAKHDKSARLAGLMLFGISPVSFICVLSCISSNTLGFTKKWTVSSINLLAYASANIAGPHTFIATQAPSYTGAKISLVVNYAAAMVIIVLIYIVNARENKRRDKIEAERTHEQVVENIEFADLTDFENLKFRYAI

SEQ ID NO: 8597 - DNA, 1620 bp, Kluyveromyces lactis NRRL Y-1140
  CDS (1)..(1620)
atgtctgaattgaaaatagaaaacgaagatgctgaagtagtcgataaagatgataaattgcaaaacgggaaatacaccgaatttgagactagctcagattcaattgataaaaaggaaaaaaaaattgatgtcaaagatgctgacgaacttcttaaatttatggacaaatacgaatctaccgtggaaccacttactgaggaggaagagaaaaagtttgttaagaaaaacttcgctgctgtatctctattaaccattcttgttacgttaatccttttcatggataaatcaacaatcggttatactaccattcttggaatctatacagacacaggaatcagtaaaggcgactttaacaacttaaattctatattctacgctgggtaccttattgctcaatggccatgtcatatattaatgcaaaaattgcccttgggaaaatatctcgctggaagtattttctcctgggcaataattgtagggttgacaggaatctgtaataattatggtagtttaatggcttgtcgtttttttttaggtgccaccgaagccgtggtggttcctgcttgtgagattacccttggtatgttccttactacggagcaacgtgaaattgttcaaccagtgttttgggcagctacagcagcagcacctttactttcatcgttcatttcttttggattgatgcatacgaatacatccacttatccttggagaatatttatggcaatcaatgctggtttatcgttgatacttgccataattgtcttactcctctaccctgataaccctgctaacgcaaagtttctgtcaacaaaagaaaaagtctatcttataaagcaagtgcaacggtcaacggaatcatcaattgaacagaagacaatcaaaaaatatcaaatttatgaaacattcaaagatccagtttcatggttgttctttttccaaagttttactcttatgctgtcaaattcattgacataccaacagaaccaattgtatgttgatatcggtgtcgacaacctaggatcttcattggtttctgcggctgggagtgtttgggacattctactgtacttgatattcgcttttgttatcctcaactatccaaatcaaagtggttatattgcagccggttgtctgattctaccaattgcgtccagtattgcgatggttacaatagattggtccaacaaatatgcgttgttagcctgtatgatcttagccggctcctcaaagggtatcacatacattattgctttgggatggacgacatcatctgcagccggttataccaagaaactctacaggaacgtaatgtttatgttggcatatggcgctgcaaacatcatttctcctcaactctggaatccaaaggatgccccaagatactatccatcctggattattcaaattgtggtttcattcttccttaatattgttattttgttaacaatcagatacattttggcgaaaaggaacaaagaaaggtatcaatgggttcaagaacatccagaagacaactttggtattgtttctttcacagaaggagtcaacgaaagagttaatctagccatgctagatcttaccgattttgaaaacaaaagatttatctacccactatga

SEQ ID NO: 8598 - protein, 539 aa, Kluyveromyces lactis NRRL Y-1140
MSELKIENEDAEVVDKDDKLQNGKYTEFETSSDSIDKKEKKIDVKDADELLKFMDKYESTVEPLTEEEEKKFVKKNFAAVSLLTILVTLILFMDKSTIGYTTILGIYTDTGISKGDFNNLNSIFYAGYLIAQWPCHILMQKLPLGKYLAGSIFSWAIIVGLTGICNNYGSLMACRFFLGATEAVVVPACEITLGMFLTTEQREIVQPVFWAATAAAPLLSSFISFGLMHTNTSTYPWRIFMAINAGLSLILAIIVLLLYPDNPANAKFLSTKEKVYLIKQVQRSTESSIEQKTIKKYQIYETFKDPVSWLFFFQSFTLMLSNSLTYQQNQLYVDIGVDNLGSSLVSAAGSVWDILLYLIFAFVILNYPNQSGYIAAGCLILPIASSIAMVTIDWSNKYALLACMILAGSSKGITYIIALGWTTSSAAGYTKKLYRNVMFMLAYGAANIISPQLWNPKDAPRYYPSWIIQIVVSFFLNIVILLTIRYILAKRNKERYQWVQEHPEDNFGIVSFTEGVNERVNLAMLDLTDFENKRFIYPL

SEQ ID NO: 8599 - DNA, 1587 bp, Debaryomyces hansenii CBS767
  CDS (1)..(1587)
atggctgaaaagcaaactgaatctgagtctctttctcaagcatctgcagcttcttctgtagatgcgcttaacagcgacgaagacgctatagtcagtactaaatatgctgatgtagcagtttcatttatgcaagctcatgattcccaaactcctattattactcctgagcaagatatggcgctcagtagaaaattgttatggcgcgtcttgggtcttacttttttaatcaacatgattatgtatatggataaagctactttatcatacagttccatctctggattctgggaagctactggattagaccaaaataaatataataatgttaacacaattttttatgttgggttcatcgtcggtcaattaccaggtacttatttaattcaaaaattatcaatcagtaaattaatttttggtattacatttttttggtccatagatattttcttgcattgtgcggcttataattatgcgggtgttatagtgttaaggtttttcctcggattacttgaatcggttgcaataccaattatgcttaccaccaatggtatgcttttaagtcagcatgttagagaactgactcaaccagttttctacgcttcatgtatggcatcacctattccaattgggttcataagttacggtgtcttgtacgctggtgctgacattggtgattggcgagtcttgaatattattataggtggattaaccttaatcttatctgtatttgttttcttctcatacccagataatccaattaatgcatcttttttgaccacagaagaaaaagtctgggtcattagaaaagttcaaaatacttcccaccagtctattgaacaaaaaatgttcaaaaagcatcatgcaattgaagctttcaaggatccaatttcttggttaatcgttggtttcttccttttacaacagttagctaataacttaccttatcagcaaacaatcttatacgaagaaatgggtggattaagtaatttaaactcaactttagtgacagttgcaggtgctggatttgctgtactttggtcattagctgcatgtctttttatgatatggaaaccaagaaagacttgtctcacaattatttggaccaccttaccatcccttgccggttcaattgcagctgtttcccttccattgactaatgctataggtgtattggcagctatttccttagcctcacaatcctttggtgttggatggatttgtgcatttggtttaggacaaacgactgcaggtgcaagttataccaagagattggtcagaaatgcaatgttcatggtttcatattctgttgcaaacattatctcaccacaactatggagagctaaggatgctcctaattatatccctgcatgggttgttcaaattgtgctaagttttttcactgccccagttttgattggtactgtatggtttattttacatagaagaaacaaagagagattaacaactttggatgaaaaactgaaggttggtcatgtcaagaacgatgaaggtgaagttttcgaagttaacgttgttgctttagaccttacagatttagaagataaaactttcatttacccaacttaa

SEQ ID NO: 8600 - protein, 528 aa, Debaryomyces hansenii CBS767
MAEKQTESESLSQASAASSVDALNSDEDAIVSTKYADVAVSFMQAHDSQTPIITPEQDMALSRKLLWRVLGLTFLINMIMYMDKATLSYSSISGFWEATGLDQNKYNNVNTIFYVGFIVGQLPGTYLIQKLSISKLIFGITFFWSIDIFLHCAAYNYAGVIVLRFFLGLLESVAIPIMLTTNGMLLSQHVRELTQPVFYASCMASPIPIGFISYGVLYAGADIGDWRVLNIIIGGLTLILSVFVFFSYPDNPINASFLTTEEKVWVIRKVQNTSHQSIEQKMFKKHHAIEAFKDPISWLIVGFFLLQQLANNLPYQQTILYEEMGGLSNLNSTLVTVAGAGFAVLWSLAACLFMIWKPRKTCLTIIWTTLPSLAGSIAAVSLPLTNAIGVLAAISLASQSFGVGWICAFGLGQTTAGASYTKRLVRNAMFMVSYSVANIISPQLWRAKDAPNYIPAWVVQIVLSFFTAPVLIGTVWFILHRRNKERLTTLDEKLKVGHVKNDEGEVFEVNVVALDLTDLEDKTFIYPT

SEQ ID NO: 8601 - DNA, 1560 bp, Debaryomyces hansenii CBS767
  CDS (1)..(1560)
atgatagatgaaaaacaatatgctacagataaagtgcaggaggtcgactcgagtcttgacatagagaataacgtcattacaacgataatatcaccacatactggtaaggttgttaacattaccaatgatgttgacgaggccatgaaattcgttgatgacgagaagcaagttgaaattgatgcaaaaacaaatagaagaattcttcgcaaaatcgatatgtgtctaatgccagtgatgtgcttattatattgtttccaatttatggataagttgtctaattcttttgcttcaattttgggattgagagaagacttgaatatggtcggagatatgtactcgtggacaggtactgcgttttatcttggttatttggtattcgagtttccggcttctcttttgttgcagaggtttccagttgtcaaaacagtatctgtatttattattgtatggggggttatattgtgcttgcatgccgttcctgactatgctggtttcattgccttgaggaccatcttaggaatgttagaaagttcagttactcctgcatttgttattttgaccagtcaatggtataagaaagaggagcagttcattagaaccgcattatggttcagttgtaatgggattggtacgatacttggatctggggccattgcatataatgtctatatgaatgatggttcgtactctatggacgcttggaaattgattttcattatcacaggctgcttaacaatcttcttaggttttgttgtcatgatccatctccctgatacaccaacacaagcatggttccttaccgaagaagaaaaagtgcttgttgtagagagaatcagatcaaatcaacaagggtttggtaacaaacactttaaaaagcatcaatttatagaagcaatcacagattttaaaacctggttattttttatatttgcaatcgccaataatattcctaatggaggtataactaattttggaagtattttgttaactggtatgggttactcaccatctcaagctttgttgatgcaaatgcctcagggtgcaactgagattgttggctgtactttgtttgcatgcggtgtactttactttccttatcgtatgttttgggctatagctggtactgtcattgtcgtcatatcagaatgcatgttggcatttgcaagtcaagaaaaagctcaatatgcgggctttacactctatacgttttctccgattgggttcatttgtgtattatctatcatctcttctaacgtggcaggccatacaaagaaggttacgacgaatgctattttcttggtcggttactgtattggtaaccttattggacctcaaacattcattgatactcaagctcctgcttatactggagcaaaaatatctatcgtggttaatggatttgcttcattaattgtacttattataatttggctcgtttatgctttcgataataagaagagagataaactaggtaaaaacgaagaattcgaaaacattcaaaaccatgagtttgcagacttgactgataaagaaaatcctagctttagatacgaattatag

SEQ ID NO: 8602 - protein, 519 aa, Debaryomyces hansenii CBS767
MIDEKQYATDKVQEVDSSLDIENNVITTIISPHTGKVVNITNDVDEAMKFVDDEKQVEIDAKTNRRILRKIDMCLMPVMCLLYCFQFMDKLSNSFASILGLREDLNMVGDMYSWTGTAFYLGYLVFEFPASLLLQRFPVVKTVSVFIIVWGVILCLHAVPDYAGFIALRTILGMLESSVTPAFVILTSQWYKKEEQFIRTALWFSCNGIGTILGSGAIAYNVYMNDGSYSMDAWKLIFIITGCLTIFLGFVVMIHLPDTPTQAWFLTEEEKVLVVERIRSNQQGFGNKHFKKHQFIEAITDFKTWLFFIFAIANNIPNGGITNFGSILLTGMGYSPSQALLMQMPQGATEIVGCTLFACGVLYFPYRMFWAIAGTVIVVISECMLAFASQEKAQYAGFTLYTFSPIGFICVLSIISSNVAGHTKKVTTNAIFLVGYCIGNLIGPQTFIDTQAPAYTGAKISIVVNGFASLIVLIIIWLVYAFDNKKRDKLGKNEEFENIQNHEFADLTDKENPSFRYEL

SEQ ID NO: 8603 - DNA, 1659 bp, Debaryomyces hansenii CBS767
  CDS (1)..(1659)
atgatatcatttaaagtatcaaaaaacaacagcaatagcagttccagtatatattcggctgcgatttcacatttggaagaaggtaagatgaaaggtttagttgagcatgtggagacagtcgaaactggtccacacggaaagggaaaattgcatttgcgggatggtgataacatagatgaagaaagagttgataaagatatcctagcctacatggaagatagtgctattgaaattgatgatacaaccaacaaaaggttaagaagtatgataaataagagaatattaccatgcatgatcgttacttattttttgcaggcattagataaaggtacactttcttttgcatctataatgggtataagagaggatgccggattggtaggtcaacaatactcgtggttaacaacttgtacttacttggctgtattattttgggaatggccaacaaattggataatccaaaagttaccaattgctaaatatttggctttcaatattatagcctgggggattgtcttaagttgccatgcgttgggaaaaaactttgcaattttggttgttgtgagaaccttattagggttctttgagtgctgctgtcaaccatgttttattctaatgtctgccatgtggtataagagatccgaacaggctctgattattgccttatggtatatgatgaatggtgggcagcagattgttggtggtttgctatcatattgcttttcgttgattgacggagcagcattaagaaactgggaaatattatttttgacttacggatgcattactgtggtatggggggtttttgttttatggtggactccagattctccaatgaaagctaaatgtttctctgaaacggataaaaaattgatggttgaaagagtccgttcgaaccaaactggaatccagaataaagagttcaaaaaatatcaactttatgaagctttgagtgatcctcaaacttactgttatttttttattcaatttttaacatcattgccaacctctggactaggggcatttgctaatataattatctcgtcttttggtttttctgtcttacaaactcaattattagctatggtattaggtgcttatttgattgttttattattatcatctgcatggttatcatctagatttaaccaaaacattctttttatgatttgctatgtggtgccttcgattattggcactgttgtattgatgacagtaacatatactggaatggatacagactcttacgaatataaacttaggcgaggagtattgctcttctgctattatttaacattgtccttttggggtgttgccaacttgggactttctttgctctcaaggaatattgctggtcaaactaaaaagtctttctgtactgctttaaactttgttgggtgggctgtcggtaattgcgttggtccccaggttttcagagaccaggattcaccaaggtatttgactgcatttgcaactcacatgggctgttatgctgctctaataatcttattactatgtatgagattatggttgatgaaagaaaattttagaaaagataaactcatcgaaagaggtgaagcagttgctgacagcaaattgaagcatgcttttgaagacttaacagatatggaaaatgttaacttccgttatgcgtattaa

SEQ ID NO: 8604 - protein, 552 aa, Debaryomyces hansenii CBS767
MISFKVSKNNSNSSSSIYSAAISHLEEGKMKGLVEHVETVETGPHGKGKLHLRDGDNIDEERVDKDILAYMEDSAIEIDDTTNKRLRSMINKRILPCMIVTYFLQALDKGTLSFASIMGIREDAGLVGQQYSWLTTCTYLAVLFWEWPTNWIIQKLPIAKYLAFNIIAWGIVLSCHALGKNFAILVVVRTLLGFFECCCQPCFILMSAMWYKRSEQALIIALWYMMNGGQQIVGGLLSYCFSLIDGAALRNWEILFLTYGCITVVWGVFVLWWTPDSPMKAKCFSETDKKLMVERVRSNQTGIQNKEFKKYQLYEALSDPQTYCYFFIQFLTSLPTSGLGAFANIIISSFGFSVLQTQLLAMVLGAYLIVLLLSSAWLSSRFNQNILFMICYVVPSIIGTVVLMTVTYTGMDTDSYEYKLRRGVLLFCYYLTLSFWGVANLGLSLLSRNIAGQTKKSFCTALNFVGWAVGNCVGPQVFRDQDSPRYLTAFATHMGCYAALIILLLCMRLWLMKENFRKDKLIERGEAVADSKLKHAFEDLTDMENVNFRYAY

SEQ ID NO: 8605 - DNA, 1560 bp, Debaryomyces hansenii CBS767
  CDS (1)..(1560)
atggttacagaaagtaagaaaaatgaaatctctaatgaaatattggaggtgaactccgacatggactttgaggatcagggtataaccaagattgtttctcctcatacaggtaaagtagtcaatattactggtgatgtggatgaggccatgaaatatgcagacaacgaaaaggtgatcgaaattgatgaaaagacgaatagaaggatactccttaaaatagatatgtgcttgatgcccataatgtgtttattgtattgctttcagttcatggataagttatccaattcttttgcttcaatcttagggttgagagaggacttgaatatggttggtgatatgtactcatggaccgggacgtcattctaccttggttatttggtatttgaattcccagcttctatgttattacagagatttcctgttgtcaaaacagtatccgtatttattattatctggggagttatattgtgcttgcattctgttcctcaatacgccggttttatcgctttaagaacagtcttaggaatgctagaaagttctgttactcccgcatttgtaattttgacgagccagtggtataaaaaagaagaacaatttatcagaacagccttatggtttagttgtaacggaattggtatgatattaggttctggtgccattgcctacaatgtctatattgaccaagcaaattattctttggaagcatggaaacttatcttcattattactggatgtttaacgatctttttgggcttcgtaattatgttgcatttccctgatacaccaacgaaagcctggttcttaaacgacgaagagaagagtctagtggtagaaaggattagaactaatcaacaggggttcggaaataagcattttaagaaacaccaatttattgaagcacttttagactttaagacatggctattctttatattttcgattgcaaataacataccaaacggtggtataacaaattttggtagtattttgttaaccggtatgggatattcacctgccaatgctttattgatgcaaatgccatcaggtgccgttgaagttgttgggtgcaccttgttggcttgtggtgttcttttttatccgtatcgtttattttgggcaacagtcggaactgttattgtaattatatcagaatgtatgttggcattcagttctaatgttaaagtgcaatactctggtttctgtttatatacattatcacctattggatttatttgtttattgtctattattgcttctaatgtggcgggccacactaagaaggttactacaaatgccatttttttaatcggttactgtgttggaaatttaataggccctcaaacatttatagataaacaggctcctgagtatactggagctaaaatatctattgtggttaacggttgtgtttcgttggtggttcttattttaatatggtattcatattgggtggataacaagaaaagggataataatttcgacaaagctgaaaatgtcgaacatcttgaattcgctgatctaacagataaagaaaatccagcctttagatatgaactatag

SEQ ID NO: 8606 - protein, 519 aa, Debaryomyces hansenii CBS767
MVTESKKNEISNEILEVNSDMDFEDQGITKIVSPHTGKVVNITGDVDEAMKYADNEKVIEIDEKTNRRILLKIDMCLMPIMCLLYCFQFMDKLSNSFASILGLREDLNMVGDMYSWTGTSFYLGYLVFEFPASMLLQRFPVVKTVSVFIIIWGVILCLHSVPQYAGFIALRTVLGMLESSVTPAFVILTSQWYKKEEQFIRTALWFSCNGIGMILGSGAIAYNVYIDQANYSLEAWKLIFIITGCLTIFLGFVIMLHFPDTPTKAWFLNDEEKSLVVERIRTNQQGFGNKHFKKHQFIEALLDFKTWLFFIFSIANNIPNGGITNFGSILLTGMGYSPANALLMQMPSGAVEVVGCTLLACGVLFYPYRLFWATVGTVIVIISECMLAFSSNVKVQYSGFCLYTLSPIGFICLLSIIASNVAGHTKKVTTNAIFLIGYCVGNLIGPQTFIDKQAPEYTGAKISIVVNGCVSLVVLILIWYSYWVDNKKRDNNFDKAENVEHLEFADLTDKENPAFRYEL

SEQ ID NO: 8607 - DNA, 1488 bp, Yarrowia lipolytica CLIB122
  CDS (1)..(1488)
atgagcaagtgcaacgactcgaaatcgctcgaaaaaacgttcccggaccctgcagatgaaaagctggacgtggaagtaggagaggtcaacgatatcaccctggatgccgctacagacaaacgactgctgcgcaagattgacatgtatctgtgcccagtcatgatgctcgtttacgcggtccaatttatggacaagagcaccaatgccaccgcttcggttatgggtctgagaacagacctgcatatggagggcaacgactattcatggtcgggaacggccttctacctgggatatctagtgttcgagtttccagccgtgtacatgctccaacgactacctttcatccgaactctctcagccttcatcgttctctggggtgtagtattgtgtctccatgctacccccaactatccgggattcattgctctgcgaaccctcctgggcatgttggagtcggctgttacgccggcctttgtcatcatcacgtctcaatggtacaagcgcgaggagcagtttcttcggacgtctttctgggtcggatccaacggcctcgggatcattgttggctgtctgatggcttatggactagccatcaaccaccatcttccaatccatggctggaagctcgttttcatcatcactggtgtcatcaccattgccacggggattctgattctgttccacttccctgatgacccctccaaggcgtggtttttgaccgaagaagaaaagaagctagtggtcatccgggtgcgaaccaaccagggctcgtttgcgaacaaacagttcaaaagaaaccagttcatcgaagcgttcaaagaccccagatcctggctctacttcttctactctattgcctccaacattcccaatggcggaatcaccagttttggcagcattctcttttcggaaaccctggggttgggacccgtcagaggcctgcttctccagaccccccagggagcggtggaaatcgtgggatgcgtgctgtttggtctcttggcacaatacacccaatggcgtctgttctggtcaattgtcgcccagctgattgccacagtcgcaatgtgtctgttggcgtttctgccccacatccaagccgccggcctagccggcctctatctgctctccgtctaccctgttggcctggtctgtatgctgtcgtcggtgggctccaatacaaccggacacacgaaaaaagtgactgtcaacgccataatgctggtgggctattgcgtcggcaacatcattggtccccagaccttccgggccgacgatgctccggaatacgtgcctgccaaggtctccatggtggtgctgtttgcggttgccgtgggtctaaacaccgttctgctatttgtgaatcttgccgagaacaagaaacgagatagagagggccatatcaatccttccctagaggagctggaggagattcaaaactccgacatgaccgaccaggaaaaccggtactttagatatgtcatttga

SEQ ID NO: 8608 - protein, 495 aa, Yarrowia lipolytica CLIB122
MSKCNDSKSLEKTFPDPADEKLDVEVGEVNDITLDAATDKRLLRKIDMYLCPVMMLVYAVQFMDKSTNATASVMGLRTDLHMEGNDYSWSGTAFYLGYLVFEFPAVYMLQRLPFIRTLSAFIVLWGVVLCLHATPNYPGFIALRTLLGMLESAVTPAFVIITSQWYKREEQFLRTSFWVGSNGLGIIVGCLMAYGLAINHHLPIHGWKLVFIITGVITIATGILILFHFPDDPSKAWFLTEEEKKLVVIRVRTNQGSFANKQFKRNQFIEAFKDPRSWLYFFYSIASNIPNGGITSFGSILFSETLGLGPVRGLLLQTPQGAVEIVGCVLFGLLAQYTQWRLFWSIVAQLIATVAMCLLAFLPHIQAAGLAGLYLLSVYPVGLVCMLSSVGSNTTGHTKKVTVNAIMLVGYCVGNIIGPQTFRADDAPEYVPAKVSMVVLFAVAVGLNTVLLFVNLAENKKRDREGHINPSLEELEEIQNSDMTDQENRYFRYVI

SEQ ID NO: 8609 - DNA, 1503 bp, Yarrowia lipolytica CLIB122
  CDS (1)..(1503)
atgtccctgtctccatccacctccgatgtggagaaaaactccgttcgaaaaccgagtctggactcggatgccgaggtcgaaaagacccccggcgtgatgctggacacccagatcatcgacgaggccaccaatacccgcattctccggaaaatcgacctctgtctcatgccgctgatgatgttcatctacgtggtccagttcatggacaagagcaccaactcgctggcgtcagtcatgggaatgcgccaggatctcggcatgaagggcgacgactactcgtggtccggaaccgccttctacattggctatcttgcgttcgagttcccggccgtcttcatgctgcaaaagttccccatggccaagactttgtccgtgtttgtggtgctctggggcatggttctgtgctgccacgcggtgccccggtttggcggcttcatcgctctgcgaacgattctgggcgtcctggagtccgccgtcaccccggcgtttgtcattctcaccgcccagtggtacaagcgagaggagcagtttctgcgaacgtccatctggtttgcttccaacggcctcggtctcattctcggctccctggtggcctacggactcaccgagaaccaccatctgcccatgcacggctggaagctgctctttatcatcaccggagtcttgaccatggctctgggaatcgtcatcttcttccatattcccgacgacccctccaaggcgtggtttttgaacgaagaagagcgaaaactggtgctggcacgaatcgcctccaaccagcagggctttgaaaacaaaacgttcaagaaagaacaggtttgggaggctctcactgacatccgaacctggctctactttctcttctccgtctccaataacatccccaacggaggtctcaccaacttttccaccatcctgctgtctgaaaccattggtctaggacccacccgagcactgctcatgcaaactccccagggaggagtcgagtttgttggctgtatcttcctgggatgggttgtccagagaacagagagaagatgtctgatcgccaccatcgctcaggccattgccctggtggcttcttgcctgctcgctttccttccacacagccagggagccggactctgtggcctctatctcgtcatgctgtatcccattggtctcatttgtgtgctgtctttggtcgcctccaacaccgccggccataccaagaaaatcagtgtcaacgccattctgctgatcggatactgcctcggcaacctcctgggaccccagacgttccgagctgaagacgccccggcctacactgcggccaaaatctgcattgtcgtcttcttcggcctggctatcggcatcaccatgctcatctggtttgtcaacgtcagagagaacagacgacgagaccagttgtatggaggcgacatcaccgaagccgagctccacgagctgcagacggccgatctcaccgacagacagaacaagcatttccgctatgctttttag

SEQ ID NO: 8610 - protein, 500 aa, Yarrowia lipolytica CLIB122
MSLSPSTSDVEKNSVRKPSLDSDAEVEKTPGVMLDTQIIDEATNTRILRKIDLCLMPLMMFIYVVQFMDKSTNSLASVMGMRQDLGMKGDDYSWSGTAFYIGYLAFEFPAVFMLQKFPMAKTLSVFVVLWGMVLCCHAVPRFGGFIALRTILGVLESAVTPAFVILTAQWYKREEQFLRTSIWFASNGLGLILGSLVAYGLTENHHLPMHGWKLLFIITGVLTMALGIVIFFHIPDDPSKAWFLNEEERKLVLARIASNQQGFENKTFKKEQVWEALTDIRTWLYFLFSVSNNIPNGGLTNFSTILLSETIGLGPTRALLMQTPQGGVEFVGCIFLGWVVQRTERRCLIATIAQAIALVASCLLAFLPHSQGAGLCGLYLVMLYPIGLICVLSLVASNTAGHTKKISVNAILLIGYCLGNLLGPQTFRAEDAPAYTAAKICIVVFFGLAIGITMLIWFVNVRENRRRDQLYGGDITEAELHELQTADLTDRQNKHFRYAF

SEQ ID NO: 8611 - DNA, 1509 bp, Yarrowia lipolytica CLIB122
  CDS (1)..(1509)
atgaatgattcaagagcctttgaagaccctcggtctgttgagaaacaatctggccacattgactatgatgacaaagcagacattgagattggagagacctgtatcaccgatctcacggagctggatccagctacagataaacggcttctgcgcaagattgatctctacatttgtcctgtcatgatgctggtgtatgcagttcagttcatggacaaacagaccaactccacagcttcggttatgggtttgagacaagatctccacatggagggcaacgactactcgtggtcgggaacttccttttaccttggctatcttgcgtttgaattccctgccgtctaccttctccaacgactaccgttgattcgaacattgtcttccttcatcattttgtggggaatcgttctgtgtcttcatgctacgcccaactaccccggattcattgctctgaggaccattctgggcatgctggagtctgctgtgactccggcctttgtcatcatcacttcccagtggtataagcgagaggagcagtttctgcggacctctttctggcttggagccaacggactcggtctgattattggctgtctaacggcctatggacttgctatcaaccacaatttgcccatacatggttggaaactggtcttcatcatcaccggagtgatcaccattgctgtgggtatcctcattctgttccacttccccgacgagccgtcaaaggcgtggtttctgacagaagaggaacgcaagttggtcgtgatccgcgtccgaggtaaccagggctcgtttggaaacaaaaagttcaaaaaacaacagtttgtcgaagccttgagagacccccgcacctggatctacttcttgtactgcatctcctccaacattcccaacggaggtatcaccaacttctccaccattctgttttcagaaacccttggcctgggacccattcgaggactcctgatgcaaacccctcagggcgccgttgaactaggaggctgtatcattttcggactcctggcacagtacactcaatggcgtctgttctggtcaattgtagctcaattgatcgcagccgtggccatgtgtttacttgcgttcctacctggcaaccaatcggcaggtctggcgggactctatctgctcatcatctaccccgttggcttcatttgtatgctctcctcagtagcatccaacactactggacacaccaaaaaggtgactgtcaacgccatcatgctcataggctactgtgtgggcaacattatcggaccccagacctttagagcagatgatgctcctcaatacgtgcctgccaaggtgtccatggtcgttcttttcttcatagccgtcggtctcaacaccctgttgttgtttgtcaacattgtggagaacagaaagcgagacaaggaaggcaccatgaacccttctccgcaagagctggctgagatccagacttcagacatgacagacatggaaaatcggtactttagatacgccatttag

SEQ ID NO: 8612 - protein, 502 aa, Yarrowia lipolytica CLIB122
MNDSRAFEDPRSVEKQSGHIDYDDKADIEIGETCITDLTELDPATDKRLLRKIDLYICPVMMLVYAVQFMDKQTNSTASVMGLRQDLHMEGNDYSWSGTSFYLGYLAFEFPAVYLLQRLPLIRTLSSFIILWGIVLCLHATPNYPGFIALRTILGMLESAVTPAFVIITSQWYKREEQFLRTSFWLGANGLGLIIGCLTAYGLAINHNLPIHGWKLVFIITGVITIAVGILILFHFPDEPSKAWFLTEEERKLVVIRVRGNQGSFGNKKFKKQQFVEALRDPRTWIYFLYCISSNIPNGGITNFSTILFSETLGLGPIRGLLMQTPQGAVELGGCIIFGLLAQYTQWRLFWSIVAQLIAAVAMCLLAFLPGNQSAGLAGLYLLIIYPVGFICMLSSVASNTTGHTKKVTVNAIMLIGYCVGNIIGPQTFRADDAPQYVPAKVSMVVLFFIAVGLNTLLLFVNIVENRKRDKEGTMNPSPQELAEIQTSDMTDMENRYFRYAI

SEQ ID NO: 8613 - DNA, 1476 bp, Yarrowia lipolytica CLIB122
  CDS (1)..(1476)
atgaacaacaaaacatcaccatccacatcgctggagaaacagctcgacgaacaccatgtggctgaagtcgatgatctggtcccctacgaacttgacccagagaccgatagacgcctgctaagaaagaccgacctctacctatgtccagtcatgatgtttgtttacgcggttcagttcatggacaagtccaccaactccacagcgtccgttatggggcttcgagaagacttaggcatgaagggagacatgtactcctggacaggaacggcattctacctcggctatctcgcattcgagttcccagcagtctaccttcttcaacgattccctctcatcaagaccctcagtaccttcatcattgtctggggaatagttctgtgtctccatgccacgcccaactatgctggatttatcgccctcagaactattctgggcatgctcgagtctgccgtgactccagccttcgtcattgttactgctcaatggtacaaaagagaagagcagtttctccgaaccgccatctggctaggggctaacgggatcggtatcattgtgggctccctcatggcttatggacttgctaacaacaacagtctaccgatacatggctggaaactcgtctttattattacaggagtcatcactatctttgcaggtgttgtggttctgtttcacatccctgatgacccttcaaaggcctggtttctgacccccagcgagcggaaactagtgttgatccgaatcagatccaatcagcagggctttgagaacaaaaagttcaaaaaggaccagttcatcgaggctttcacagacatacgaacctggctctacttcttcttctgcttgacctccaacatccccaacggaggtatcacaaacttcaataccatcttgttctctgagactttaggactaggaccagtaaaaggacttctgatgcaaagtccacagggagccactgaactagtgggctgcattctgtttggtttgctggttcaatacactcagaaacgacttctcatgtccatgattgcccagtccatctcagtaatggccatgtgtctcctagcattcattccagataaccaggctgcaggtctggctggactctacattctcatcatctaccctgtgggattcatttgtattctgtcttcggtggcttccaacactgctggtcataccaagaaggtcaccgtcaatgctattcttctcattggatactgcgtgggaaacctcattggtccccaaacattccgagcttcggacgctccctcttatgtgcctgcaaaggtgtcaatggtggttctcttcttcgtcgccataggtctcaacggagtgctcatgtgggtcaactaccgagaaaacaagaagcgagacgaagagggttgttttgctacccccgagcagctggaaaagatccaatgccaggatcttactgacaagcagaaccgtttctttagatatgccaactag

SEQ ID NO: 8614 - protein, 491 aa, Yarrowia lipolytica CLIB122
MNNKTSPSTSLEKQLDEHHVAEVDDLVPYELDPETDRRLLRKTDLYLCPVMMFVYAVQFMDKSTNSTASVMGLREDLGMKGDMYSWTGTAFYLGYLAFEFPAVYLLQRFPLIKTLSTFIIVWGIVLCLHATPNYAGFIALRTILGMLESAVTPAFVIVTAQWYKREEQFLRTAIWLGANGIGIIVGSLMAYGLANNNSLPIHGWKLVFIITGVITIFAGVVVLFHIPDDPSKAWFLTPSERKLVLIRIRSNQQGFENKKFKKDQFIEAFTDIRTWLYFFFCLTSNIPNGGITNFNTILFSETLGLGPVKGLLMQSPQGATELVGCILFGLLVQYTQKRLLMSMIAQSISVMAMCLLAFIPDNQAAGLAGLYILIIYPVGFICILSSVASNTAGHTKKVTVNAILLIGYCVGNLIGPQTFRASDAPSYVPAKVSMVVLFFVAIGLNGVLMWVNYRENKKRDEEGCFATPEQLEKIQCQDLTDKQNRFFRYAN

SEQ ID NO: 8615 - DNA, 1578 bp, Candida albicans SC5314
  CDS (1)..(1578): transl_table=12
atgtccgaaaaaaaagaattgaaaaaccagaccgatatcgaaccgataatatcgttcaccaaagaagatatcgaagataataaaccacatgttttaactacaatcatttctccctctggtaaggagattgctattaccaatgatgttgatcaagctatgaagctcgcccttgagcacaagggtgaaaccatcgagttagacagtgttcaggcggataaattacttcgaaaaattgatttgtacttattacccgttatgtgcttgttgtattgctttcaattcatggataaattaacaacaagttatgcttcagtacttgggttaagaaaagaattaaaaatgcaaggtgacatgtatagttggacggctactgcattttacttgggatatcttgtctttgaattcccagcctcaatgcttttgcaacgattccccgttgctaaaacagtgtcagttttcattattctttgggggatgatattggctttgcattctgttccccaatacccagggtttgttgccttgagaactattttgggaatgttggaactgagtgtgacacccgccttcactattatcacatctcaatggtacagaaaggaggaacaattccttagaacttcttggtggtttgcttctaatggtatcggtactattgtaggactggctattgcttatgggttatttgaaaatgatgggaactattctttaccagcttggaaactcgtgtttattgtcactggttgcttgacaatatttttaggattcatagttatggttcatatccctgacacaccggcaggtgcttggtttttaacagatgaagaaaaattaatggtagtggaacgtattagaaccaatcaacaaggttttggtaacacacatttcaaaaagcatcaattcatagaagcattgactgatcatagaacttggttgtttttgttatttgcattgtctaataatattccaaatggaggattgacaagtttcggtaccatcttgttaaacgaagattttggctacaccccatctaaatcacttttgatgcaaatgcctcaaggagctgtcgagattgttgggtgtgtcttattggcttggctttgtaaatttctcccatcacgtatgttgatgggtattactgcaacatccattactgttttagctgaatgtctcttggctttttgtaagagtaacagtgcaagattggctggtttctatctttatttgttagggccacttgggttcatttgctgtttgtcatgtgtatcttctaacgttgttgggcatacaaagaaggtgaccacaaatgccatgtatttgatagcttattgtgttgggaatttgattggaccacaaacatttatcagcacgcaggcaccaggctataccggagcaaaagttgctattgttgtttgtgggtttgtttcattgtttacattgattgcaatctatatttcttattacattgaaaacaagaaaagaaactcaagaccaccagttgatatgagtcatattgaaaactacgagttcgccgacttgacagataaagaaaatccaaattttagatatagcatttag

SEQ ID NO: 8616 - protein, 525 aa, Candida albicans SC5314
MSEKKELKNQTDIEPIISFTKEDIEDNKPHVLTTIISPSGKEIAITNDVDQAMKLALEHKGETIELDSVQADKLLRKIDLYLLPVMCLLYCFQFMDKLTTSYASVLGLRKELKMQGDMYSWTATAFYLGYLVFEFPASMLLQRFPVAKTVSVFIILWGMILALHSVPQYPGFVALRTILGMLESSVTPAFTIITSQWYRKEEQFLRTSWWFASNGIGTIVGSAIAYGLFENDGNYSLPAWKLVFIVTGCLTIFLGFIVMVHIPDTPAGAWFLTDEEKLMVVERIRTNQQGFGNTHFKKHQFIEALTDHRTWLFLLFALSNNIPNGGLTSFGTILLNEDFGYTPSKSLLMQMPQGAVEIVGCVLLAWLCKFLPSRMLMGITATSITVLAECLLAFCKSNSARLAGFYLYLLGPLGFICCLSCVSSNVVGHTKKVTTNAMYLIAYCVGNLIGPQTFISTQAPGYTGAKVAIVVCGFVSLFTLIAIYISYYIENKKRNSRPPVDMSHIENYEFADLTDKENPNFRYSI

SEQ ID NO: 8617 - DNA, 1578 bp, Candida albicans SC5314
  CDS (1)..(1578): transl_table=12
atgaccgaaaaaaaagaattggaaaaccagactaatatccaaccgataatatcgttcaccaaagaagatatcgaagataataaaccacatgttttaactacaatcatttctccctctggcaaggagattgctattaccaatgatgttgatcaagctatgaagctcgctcttgagcacaagggtgaaaccatcgaggtagacagtgttcaggcaagtaaattacttcgaaaaattgatttgtacttattacccgttatgtgcttgttgtattgctttcaattcatggataaattaacaacaagttatgcgtcagtgcttgggttaagaaaagaattaaaaatgcaaggtgacatgtatagttggacggctactgcattttacttgggatatcttgtctttgaattcccagcctcaatgcttttgcaacgattccccgttgctaaaacagtgtcagttttcattattctttgggggatgatattggctttgcattctgttccccaatacccagggtttgttgccttgagaactattttgggaatgttggaactgagtgtgacacccgccttcactattattacatctcaatggtacagaaaggaggaacaattccttagaactgcgtggtggtttgcttctaatggtataggtactattgtaggactggctattgcttatgggttatttaaaaataatggaaactattctttaccagcttggaaactcgtgtttgtcgtcactggttgtttgacgatattcttaggattcataattatggttcatatccctgacacaccagcaggtgcttggtttttaacagacgaggaaaaattaatggtagtggaacgtataagaactaatcaacaaggttttggtaacacacatttcaaaaagcatcaattcatcgaagcattgactgatcacagaacttggttgttttttttgtttgccttatctggtaatattccaaatggaggcttgacaagttttggtaccattttgttaaacgaagattttggttacaccccatctaaatcgcttttgatacaaatgccccaaggagctgttgaaattgttgggtgtgttttgtttgcttgggtttgcaaatttttcccatcacgtatgttgatgggtattattacaacatctattgctgtcttagcaaattgtctcttggctttttgcaaaggcactagtgcaagattggctggtttctatcttaatttgttagggccacttgggttcatttgctgtttgtcatgtgtatcttctaacgttgctgggcatacaaagaaggtgaccaccaatgccatgttcttgatagcttattgtgttgggaatttaattggaccacaaacatttatcagtacacaagcaccaggctacaccggagcaaaagttgctattgttgtttgtgggtttgtttcattgtttatattgattgcaatctatgtttcttattacattgaaaacaagaaaagaaactcaagaccaccagttgatatgagtcatattgaaaactacgagttcgccgacttgacagataaagaaaatccaaattttagatatagcatttag

SEQ ID NO: 8618 - protein, 525 aa, Candida albicans SC5314
MTEKKELENQTNIQPIISFTKEDIEDNKPHVLTTIISPSGKEIAITNDVDQAMKLALEHKGETIEVDSVQASKLLRKIDLYLLPVMCLLYCFQFMDKLTTSYASVLGLRKELKMQGDMYSWTATAFYLGYLVFEFPASMLLQRFPVAKTVSVFIILWGMILALHSVPQYPGFVALRTILGMLESSVTPAFTIITSQWYRKEEQFLRTAWWFASNGIGTIVGSAIAYGLFKNNGNYSLPAWKLVFVVTGCLTIFLGFIIMVHIPDTPAGAWFLTDEEKLMVVERIRTNQQGFGNTHFKKHQFIEALTDHRTWLFFLFALSGNIPNGGLTSFGTILLNEDFGYTPSKSLLIQMPQGAVEIVGCVLFAWVCKFFPSRMLMGIITTSIAVLANCLLAFCKGTSARLAGFYLNLLGPLGFICCLSCVSSNVAGHTKKVTTNAMFLIAYCVGNLIGPQTFISTQAPGYTGAKVAIVVCGFVSLFILIAIYVSYYIENKKRNSRPPVDMSHIENYEFADLTDKENPNFRYSI

SEQ ID NO: 8619 - DNA, 1581 bp, Candida albicans SC5314
  CDS (1)..(1581): transl_table=12
atgaaaagtgaaaaagattctgaaattcaaggtatcaacatagaacctattgtttcttttactaaggaagaccttcaacttgacaaatcccatgtgttgaccactgttatttctccttctggtaaggaagtcgccattaccaatgatgttgaccaagttatgcaatttgtcctcgaccaccaaaatacaaaggtcgtattagacgaagccactgacaaaaaactccttagaaaaatcgacatgtatatgctaccagtgatgtgtttattatattgtttccagtttatggataaactgtcaactagttatgcatcaatattagggttaagagaggatttgaatatggtgggtgacatgtatagttggatcgctacggcattttacttggggtatcttgcctttgagtttcctgcatcaatgcttttacaacggttccctgtggccaagacagtgtcagtattcattatagtatggggaattattttatgtttgcattcggttccccagtacccagggtttattgctttgagaactattttgggaatgttggagctgagtgtgacacctgccttcactattatcacctctcaatggtataaaaaagaggaacaatttctaagaacttcgtggtggtttgcatttaatgggataggaactattcttggtctggcaatagcctatggattatatcaaaacgatggaaactattctttaccaacttggaaacttgtatttatagttacaggctgtttaaccatcttcttgggatttgtcgtcttgatacatattcctgataccccaacacaagcatggttcttgacagatgaggaaaaattgttggtcgtggaacgtattagaactaaccaacaagggtttggcaacactcacttcaaaaagaaccagttcatagaggctttaactgattacagatcatggttacttgttatttatgctttatcaagtaatatacccaatggtggattaaccaatttcagtggtatcttgctatatgaggatttccagtacagtgaagccaaatcactcttgatgcagatgcctcaaggagcagttgaaattgttggttgtgtgttgcttgcctggtgttctcaattcatttcatctcgattattgatgacagttttcacaacgagtttgacaatcatgtcagaatgtctcttagcgttttatcctgaaaaaagcggtagactagttggtttatatcttcctatgcttgaccctcttggatttatttgttgtttgtcgtgtgtatcctccaactttgctggacataccaaaaagatcaccactaacgcaatgtatttgattgcctattgcacagggaatttgattgggccccaaacatttgttagttctcaagctccacagtatattggtgccaaggtgggcatgatagctgggagcagtgttgctttattgtctttgatttgcttatacttttcctatgtttgggaaaacaaaaaacgggattcaaggacgatggttgatatgagccacattgaaaactatgaattcgctgatttgactgataaacaaaatccaaactttagatatagcaagtag

SEQ ID NO: 8620 - protein, 526 aa, Candida albicans SC5314
MKSEKDSEIQGINIEPIVSFTKEDLQLDKSHVLTTVISPSGKEVAITNDVDQVMQFVLDHQNTKVVLDEATDKKLLRKIDMYMLPVMCLLYCFQFMDKSSTSYASILGLREDLNMVGDMYSWIATAFYLGYLAFEFPASMLLQRFPVAKTVSVFIIVWGIILCLHSVPQYPGFIALRTILGMLESSVTPAFTIITSQWYKKEEQFLRTSWWFAFNGIGTILGSAIAYGLYQNDGNYSLPTWKLVFIVTGCLTIFLGFVVLIHIPDTPTQAWFLTDEEKLLVVERIRTNQQGFGNTHFKKNQFIEALTDYRSWLLVIYALSSNIPNGGLTNFSGILLYEDFQYSEAKSLLMQMPQGAVEIVGCVLLAWCSQFISSRLLMTVFTTSLTIMSECLLAFYPEKSGRLVGLYLPMLDPLGFICCLSCVSSNFAGHTKKITTNAMYLIAYCTGNLIGPQTFVSSQAPQYIGAKVGMIAGSSVALLSLICLYFSYVWENKKRDSRTMVDMSHIENYEFADLTDKQNPNFRYSK

SEQ ID NO: 8621 - DNA, 1560 bp, Ustilago maydis 521
  CDS (1)..(1560)
atggtcgactcgattgcacaacagactgcgctcaaatcgcctccatcgtcagacaagggtgatctcgatgacgcggtcaatgtcacctcgccttaccacatctcctctaccccttaccagggtgagaatgccaaagctgcagctctcgcagcctccgcttcggacatcacccccctcgaacgaaagaaagtgctccgcaagatcgacaccatcctcatgccgctcatgtgtgttgccgtcttgcttcaatttctcgacaagacttcgctcaactacgcctcgctcctaggtatcaaaaaagatacaaacctcaagggtcaagaatactcgtggttgggatccttcttctacgttggctacctgatcgcttcgcctgttcacggtttctttttgcaaaaagtcaacctcacgcgctacgtagcagcttgcatcgcgctctgggccatctcacttggctcgcatgcggcatgcaaaacctatggccaactgttggcggttcgcttcctcctcggttggttcgaagccgctttgactccgtcgttcatcttgctcaccggacgcttctacacaaagcaggaacaggtgacacgaacctcgatctggtttgccaataacggttgggctcagatcctcggaggtggtatctcgtatgctctgcaggtgcaaaagccttcgcacctcaaggtgtggcagcaaatgtttctaatcctgggaggcattgcgttcatctttggcatcatagtacttctcttcatgcctgattcgccagcaaccatccggtacctcaacgaacgcgaacgtcaggttgcagtgcaccgtatcaaggaaaacaagtcgggtattcacgacacaaagtggaagtgggagcagttctgggaggcaatccgcgacccgaggctctacatgttcttcctcgccgtctgcagtgccaacattgccaacggaggtgtgtcgaatttctcgagcgccatcatctcggcttttcactacgacaacaagacgaccgcgcttctcggtatggctcctggtgccatggaagtggtcgctgtttactttggcgcttggctctcttacaagacgcgcacgcgtgtgattccaggcgtactcatgttcgctttcgccatcgtaggtggctgcatgatgatcgccgtccctgctgctcacaaggctgttcgcttcaccggattcgtcatcgtctactgctacccggtcgccagtcctttcttgtacagttggctcagtggtagtgtttccggaaccacaaagagaatcgtcttcaatgcatggcttcaagtcggatactcggtcggtaacctcatcggacctcaaacgtaccgcgccaaagatgcgcccaactatgtgcccgcgaaaatcactctcgtagccatgttcggctttgcatctctttgcttgatcgccatcggctcaacccattatctgtggaacaagcaaaatggcacactcgacgacagtcccgagggcgcaaaggtcatcgaagatcacgaagacctaaccgatttgaccgataagcagcgttcaaatttcagatacccttactag

SEQ ID NO: 8622 - protein, 519 aa, Ustilago maydis 521
MVDSIAQQTALKSPPSSDKGDLDDAVNVTSPYHISSTPYQGENAKAAALAASASDITPLERKKVLRKIDTILMPLMCVAVLLQFLDKTSLNYASLLGIKKDTNLKGQEYSWLGSFFYVGYLIASPVHGFFLQKVNLTRYVAACIALWAISLGSHAACKTYGQLLAVRFLLGWFEAALTPSFILLTGRFYTKQEQVTRTSIWFANNGWAQILGGGISYALQVQKPSHLKVWQQMFLILGGIAFIFGIIVLLFMPDSPATIRYLNERERQVAVHRIKENKSGIHDTKWKWEQFWEAIRDPRLYMFFLAVCSANIANGGVSNFSSAIISAFHYDNKTTALLGMAPGAMEVVAVYFGAWLSYKTRTRVIPGVLMFAFAIVGGCMMIAVPAAHKAVRFTGFVIVYCYPVASPFLYSWLSGSVSGTTKRIVFNAWLQVGYSVGNLIGPQTYRAKDAPNYVPAKITLVAMFGFASLCLIAIGSTHYLWNKQNGTLDDSPEGAKVIEDHEDLTDLTDKQRSNFRYPY

SEQ ID NO: 8623 - DNA, 1569 bp, Cryptococcus neoformans var. neoformans B-3501A
  CDS (1)..(1569)
atgtctgacagcaaacaccttgatgacgagaagaatgtcggcgtcacggctgccgatgtcagtgtcttaccagcaaccgccgatgatgtgcactgcgttcagcttcaagatgtcgatgaagcagccgctttcgtcgctggctgggagggagagattacagaggagatgaatgcaaggattaggaggaaatgtgattggcaccttctgcctctcatgatgaccctctacttcgtccagttcacagataaaaccactctcggttcatcagctatcttgggaattaaaaccgacacacacctttcacaggctgagtacaactggctcggtacaatcttttatctttcttatttaattttcgaatggccacaatctcttgctcttcaaaagtttcctccaggaaaatggatggcttgtaacattctcgtttgggctgtctgtctttgttgtcacgcggcctgcaagaactttgctggtctctttgtttgccgttttctccttggtgtatgtgaaggcagtatcacggctggcttcttgattttgaccagtatgttctatacccaagaggaagcaactcaacgtgtcggctactggttcttaatgaacggtactgctcaaatattcaacggtgttgtctctttcggagtgtatcacgtcaaccccgacatcatcgccccctggaaagtctacatgctcatcacaggtctcctcacccttgtcgtcggtctctgcttctggtttttcatacccaacaaccccatgaccgcctacttccttaccaaagaggagaggatcatcgctattgagaggttgaggggtaagagtaccggtatcgagaacaagacttggaagaaggaacagttcattgaggcacttaccgactggaagtgctggacatttgccatttacgctggttcgaacaatgtggccaactctctcaccaacatgaccagcttgatcattaattcctttggattcaccgtctggcaaactactcttctgggcactgtctccggtgccatcgagatccttaccatctggtcctccgttcttgtcatcaaaaaattccccaatgcccgaggatacgtcggcgcatcctactctattcctaatgttgtctccggtattttgcttgtcgccctgccctggacagccaaaggtgctttgctctttgccgtttatttgggtggtgtgggtactcctggtttcgtgctttctctgtcgtggtgttcgacttccaacactgggcacacgaagaaggctactgcaaatgcgatgcttcttatcggatactgtctcggtaatcttctttctccgcagatgtgggaagccaagtacgctcctcgatactatgttccctggggtattatccttggtacctacgttgtcaaccctatcatccttctcggtatacgatttttcctcaaccgtgagaacgagcgccgagacagactcgtcgagaagggagagcttgtacatgaaaagtttgtggatgagtatggagaagagattgatcctactttcttggatatgaccgaccgtaagaatctgtctttcaggtatcctctttaa

SEQ ID NO: 8624 - protein, 522 aa, Cryptococcus neoformans var. neoformans B-3501A
MSDSKHLDDEKNVGVTAADVSVLPATADDVHCVQLQDVDEAAAFVAGWEGEITEEMNARIRRKCDWHLLPLMMTLYFVQFTDKTTLGSSAILGIKTDTHLSQAEYNWLGTIFYLSYLIFEWPQSLALQKFPPGKWMACNILVWAVCLCCHAACKNFAGLFVCRFLLGVCEGSITAGFLILTSMFYTQEEATQRVGYWFLMNGTAQIFNGVVSFGVYHVNPDIIAPWKVYMLITGLLTLVVGLCFWFFIPNNPMTAYFLTKEERIIAIERLRGKSTGIENKTWKKEQFIEALTDWKCWTFAIYAGSNNVANSLTNMTSLIINSFGFTVWQTTLLGTVSGAIEILTIWSSVLVIKKFPNARGYVGASYSIPNVVSGILLVALPWTAKGALLFAVYLGGVGTPGFVLSLSWCSTSNTGHTKKATANAMLLIGYCLGNLLSPQMWEAKYAPRYYVPWGIILGTYVVNPIILLGIRFFLNRENERRDRLVEKGELVHEKFVDEYGEEIDPTFLDMTDRKNLSFRYPL

SEQ ID NO: 8625 - DNA, 1599 bp, Cryptococcus neoformans var. neoformans B-3501A
  CDS (1)..(1599)
atggccgcagttgacgacaaagtcagcatcgagcatgtcgagtcgggagatcactacaccaaacaccatgtcacccaggaggaggtcaagcatggtgacaatgccctgaaatacattggtgatgaacgagtagaagtcacacaagaggatgatgcgcgaattaggaggaaaaccgacaagtacattttgtctttactagcatgggtgtacttcttgcaaatcctagacaagactgtattgggttatgccaacactttcggtctctccgaggacacaaatctcgttaacaaccaatactctctccttggttccatcaatgccattgtccagttggcttggcagccattctcgtcctacttaatcgtcaaagttcctgccagatatctcatgcctgccatggttttcggctggggtgcagctcaagcatgcatggcggcggctcacaattttggcggtttaatggcgtcgcgagccattttgggtctgtttgaagctggttgtcttccgctcttttctcttcttacctctcagtggtaccgtcgatctgagcaacctgtccgagtggccgtctggtactcgactaatggtcttgccactatcgtggccgctcttctttccttcggtctcagccacgtcgactcccctcacatcaagtcctggcaactcattttcattgtctgtgggattatcacctgtgttacagctccaatcgtctacatgttcgtcgatgccgatgtcgcttcggctcgtttccttacggaagaagacaaggccaaaggcattgagcgactccgtgcgaaccaaacaggtaccggttccaacgagttcaaagtatctcacgtctgggaactcttctgcgatcccaagtcctatcttttcttggcgatttctcttctcctcaatgttggcgcctcagtgactaacatctttgggccgacgctcatcaagggctttggattcaacagcaggatcacctctctgctcaatatgccattcggattccttcagttcgtcgcgattctggctgggtgttactgcgcgtacaagttcaagctcaagtcagctgtcctcgccgtttttatcatccctgttatcattggtctcgctctcttgtatgtcgagaatgccgcagctgttttgaagcaagctcctgctcttgtcggatattatctccttgccttccttttcggcgccaatccaatcatcgtatcttggatcgttgccaacactggtggtcaaacaaaaaaggctctccttatgagtgtatacaacgccggatcgtccgctggtaatatcattggtcctttgctcttccaagacaaggacaagcctcactatcttcctggtatcaaagccactctcggtatcttctgtgccttgatggcgtgtgtcggtatcactgcggctcttcttttcgctcttaacaaacagaggcagagacaacgtgttgctgtcggcaaacctcaatacatcaaggatacttctatgagcaacaagtacgaagcctatggtgctgatgacgtggacggaaggctcggtcagaatgccttgcttgacttgaccgactttaaaaacgacgagttcgtgtatgtgtattag

SEQ ID NO: 8626 - protein, 532 aa, Cryptococcus neoformans var. neoformans B-3501A
MAAVDDKVSIEHVESGDHYTKHHVTQEEVKHGDNALKYIGDERVEVTQEDDARIRRKTDKYILSLLAWVYFLQILDKTVLGYANTFGLSEDTNLVNNQYSLLGSINAIVQLAWQPFSSYLIVKVPARYLMPAMVFGWGAAQACMAAAHNFGGLMASRAILGLFEAGCLPLFSLLTSQWYRRSEQPVRVAVWYSTNGLATIVAALLSFGLSHVDSPHIKSWQLIFIVCGIITCVTAPIVYMFVDADVASARFLTEEDKAKGIERLRANQTGTGSNEFKVSHVWELFCDPKSYLFLAISLLLNVGASVTNIFGPTLIKGFGFNSRITSLLNMPFGFLQFVAILAGCYCAYKFKLKSAVLAVFIIPVIIGLALLYVENAAAVLKQAPALVGYYLLAFLFGANPIIVSWIVANTGGQTKKALLMSVYNAGSSAGNIIGPLLFQDKDKPHYLPGIKATLGIFCALMACVGITAALLFALNKQRQRQRVAVGKPQYIKDTSMSNKYEAYGADDVDGRLGQNALLDLTDFKNDEFVYVY

SEQ ID NO: 8627 - DNA, 1602 bp, Phaeosphaeria nodorum
  CDS (1)..(1602)
atgtctgctcagcaggagatcaacaaggctgaaatcgagacgagcgaatcgatccacaaacccctgcaaaacacccgcggtaaagacaaagctgcagagcttcttgcggccaacgaccgcatcgttgtaacttcagaggagaacaggagagtccttcggaaaatcgatcttgtcattcttccgatcctgttgtccgtttacttcctccaaagtttggacaagaccaccctctcatacgcttctgtgttcggcctcatcaccgatgcgaaacttgatcccaactcccagcagtattcatggctgggaagcatcgtgtacattgcgcagttggtgatgcagccgctggtcgcattcttcctagtcaagtttcccacgggcaaattcaccggcataatggttttcacctggggtgtcattctgtgtggcatggctggtgcgcacaacttcgggggcctgatggctactcgcttcctactgggtgctttcgagtccgctgtcgcacccgccttcatcgccgtcgtgcaaatgtggtacaagcgctccgaacaaacgaaccgtaatgcagcatggtatgctatgctgggcatagtgaacatcatcggcagtttgctttgttttggccttggccacatcaagtcgaacatcctgtactcgtatcagatcatcttcctcttctgtggtctgctcaccgtcgttacgtccgtttttgtctacatctacatgcccgactcaccgatggaagctaaattcctcaacgaccaagataaactcatcgctgtcgagcgcctcaggatgaaccagatgggtgtcgcttcgcgcgtgtggaaatgggaccatgtcttcgaagcattcctggacgtcaagacatggctctggttcttcatgctgacggccgtctcaattcccagtggtggtatcacgactttcggtccgctcattatccagggcttcggttttggcaagttcgagacaattcttttcaacatgccatttggcgcggtacaaatcttcgcaacgtgtggaggtgcttggttggcaacacgttacaaaatgaagtcggtcatcctgatcggtctttgcattccacccattattggcatcatcattttgatggtggttggacgaaaaccttcagaccgaggcgttttgctcttcggttactacatgacctctttctatccaggtatttcgccgctcatctactcctggtcaggccaaaacactggaggagatacgaagaggaaggtgaccaccagtctactattcgtaggcgccagtgccggcaatatcgtcggaccacacctgttcaagccatctgagaagccgtactataggcgcggcctacaagtcaatcttgcgcttttcgtcttgatcattgtgctggtcgtagtggcaatggcttggattaagctcctcaaccgcaagcacgctgctactcgcgagagtctaggaaaagctgtgaatattgttgacttgagtatggagaacagccgacaggtagatgctgaggaggctgagaatgtgggtgcgagtggcgttggagacaaggcgttcgatgatgtgactgacatcaagaacgaggatttcatctacgtatattag

SEQ ID NO: 8628 - protein, 533 aa, Phaeosphaeria nodorum
MSAQQEINKAEIETSESIHKPLQNTRGKDKAAELLAANDRIVVTSEENRRVLRKIDLVILPILLSVYFLQSLDKTTLSYASVFGLITDAKLDPNSQQYSWLGSIVYIAQLVMQPLVAFFLVKFPTGKFTGIMVFTWGVILCGMAGAHNFGGLMATRFLLGAFESAVAPAFIAVVQMWYKRSEQTNRNAAWYAMLGIVNIIGSLLCFGLGHIKSNILYSYQIIFLFCGLLTVVTSVFVYIYMPDSPMEAKFLNDQDKLIAVERLRMNQMGVASRVWKWDHVFEAFLDVKTWLWFFMLTAVSIPSGGITTFGPLIIQGFGFGKFETILFNMPFGAVQIFATCGGAWLATRYKMKSVILIGLCIPPIIGIIILMVVGRKPSDRGVLLFGYYMTSFYPGISPLIYSWSGQNTGGDTKRKVTTSLLFVGASAGNIVGPHLFKPSEKPYYRRGLQVNLALFVLIIVLVVVAMAWIKLLNRKHAATRESLGKAVNIVDLSMENSRQVDAEEAENVGASGVGDKAFDDVTDIKNEDFIYVY

SEQ ID NO: 8629 - DNA, 1557 bp, Phaeosphaeria nodorum
  CDS (1)..(1557)
atggcgagtgcaactgagacacccagatcgcacgacatggagaaagatacatccctaggcctcaagggcaacatcggcgagaagctgcagaaacactcgcacgatgcggatgcggcgatgcaggcgtttgaaggcatggatgggcaggtcattgagttgacagaggagaagagtagggcgttgttgaagaagattgataggcatttgatgccgatcatgtgcatcgtctacgggctgaattatctcgacaagacgacgctgagctatgcgagtatcatgggcttgcggtcgcctccgtcggataataagctcaagtccggcattgatttgcaaggtgatcagtatcagtggctgggctcgatgttttactttggatatgttgcttgggagtatccgacgacgaggcttctgcaagtcctgccgctggggaagtattcggcgttcaatatcatcatgtggggtatcgtgctgtcctgcttcgctgcggttgagaattacgctggcgcgattgccattcgctttttcctgggtttgtttgaatctgcggtcacgcccgggttcgcactgtttacgagccagtggtacacgaagaaagagcagggtgcgaggacgggcatatggttctccttcaacggcttcgctcaaatcttcggtggctgtctagcctacggcattgcagtcggctgccgcaaaacaggcacaacaatcgagccctggaaaatcgtcttccttgctactggtctcctgaccactctctgcggcatcctcttcctctggatcgtgcccgacaaccagatgaactgccgctggctgagcaaagaagaccgcatcctcgccatcgagcgcatccgcatgaacggccaaggcgtaggcaacaagcactttaaattctaccagctcaaagaagcgctactcgatccgttgagttgggcgtttttcttctacgctttgatagccgccatacccaatggttcggcactccttttccatttgtctgctgagttgagcggcatatcaaacttcttctcccaactcatcgtgtcctttggctacacgcccgaagaatcccttctctacggcacacccggcggcgccgtcgaagtcgtcttcctaatcgcgtgcggctgggcgggcgacaagtacggctaccgcatccttatatccacgactgggctttgcaccggcattctaggcatggttcttattgtcgccttgccgctggacaataacagcgggaggctggcggggtactacctgacgcaggcgagtccgacgccgtttgttgcgctactgagtttgatctcgagtaacgttgccgggtacacgaagaagactacggtggcggcgatgtatttgattgggtattgtgtggggaatatcattggcccacaaacattcagacctaaagacgcgcctcgctacgtccctgctgaaatcacaatcatcaataagaagaaggcgcaaattagggcggcgccggagtatgtgcatattccaaatcaggaatggcttgatttgacggatagagaaaatccggagtttgtttacactttgtag

SEQ ID NO: 8630 - protein, 518 aa, Phaeosphaeria nodorum
MASATETPRSHDMEKDTSLGLKGNIGEKLQKHSHDADAAMQAFEGMDGQVIELTEEKSRALLKKIDRHLMPIMCIVYGLNYLDKTTLSYASIMGLRSPPSDNKLKSGIDLQGDQYQWLGSMFYFGYVAWEYPTTRLLQVLPLGKYSAFNIIMWGIVLSCFAAVENYAGAIAIRFFLGLFESAVTPGFALFTSQWYTKKEQGARTGIWFSFNGFAQIFGGCLAYGIAVGCRKTGTTIEPWKIVFLATGLLTTLCGILFLWIVPDNQMNCRWLSKEDRILAIERIRMNGQGVGNKHFKFYQLKEALLDPLSWAFFFYALIAAIPNGSALLFHLSAELSGISNFFSQLIVSFGYTPEESLLYGTPGGAVEVVFLIACGWAGDKYGYRILISTTGLCTGILGMVLIVALPLDNNSGRLAGYYLTQASPTPFVALLSLISSNVAGYTKKTTVAAMYLIGYCVGNIIGPQTFRPKDAPRYVPAEITIINKKKAQIRAAPEYVHIPNQEWLDLTDRENPEFVYTL

SEQ ID NO: 8631 - DNA, 1530 bp, Phaeosphaeria nodorum
  CDS (1)..(1530)
atgagtacccaggaaaagcaagcaacccgtgattcgaaatcaggagatctatctccaattcctgattcggatgtcgaagttggaagcgtcggcgctgtcgatgaaacgcccgacggcgatgaggcacttcgcttcctcaaaaaccagcatgctgttggagaaatgacagcagaggaagagcgatcactcgtgaggaagattgactggatgatcatgccattgatgtgggcatgttattgtttacaataccttgacaagactttggtcaactacgcggctgtcatgggaatttacgacgatgccaacatcactacaagtcaattttcgaaccttgcccttttcttctatgtctcctacctagtgctggagtttcctcacggttatggcatgcaaagatttccgacagcaaagtacctcggtacctgtgtcagtctgtggggattcatcactgcgataacctgtgtctgcaagaactacggtgctctcgtagcgacccgtatcctcttgggttgcttcgaatcagctgtcgcgccgagcttgatcctgatcacatctatgtggtacaagaagaacgagcagccactgaggaccggcatctggtatgtcggggttggaactggaactatgatcggctctttgatctccttcggcttccagcactactatagcccgaccttcactagctggcagatcatgttcctggtagtcggtctaatcacagtgggtgttgtgatattcttactccctgacaatcctatgtcgtcccgtcttagccctgctcagaaagtgtgggctatcgaacgcctacgagagaacatgacagggatcgaaaacaagcgattcaagtggtatcaggttgtcgaatgtctaagcgacccacaaacttggatgctgtctctcattaccatctcgtccaatgtaccgaacggagccgtcagctccttccaatccacgctcatccaatcgttcggcttcgactcgaagaccaccgcgctgcttcaacttccttctggcgttgtaagcatcatttcgatcatcgcagctacttatctagctggacgcttcaaccaacgcggactcaacatttgcactctcttggtccccggtatcattggtggcgcactaatggctttcctacctgggcataacaagattgccaaattaatcggcaactatctcaccaactgcatcggatccagtcttccgttactgtattcttgggttgcggcaaatgttgcaggccataccaagaaagttacgatgaacgcgatcttgctcatgtccttctgcctcggtaatatcgtcggaccattgacgttccgtcaagctgatcagcccgattttatccctgcgaagatcaccatcattgttacatgtgcttttgcaggatttctgactatggcactgcgcgggtactatgtctgggaaaataagaggagagatcgattgacagatggaacacacgtggcaaacgaggagttcttggacatgacagacaaagagaacaaaaactttagatacaagttgtag

SEQ ID NO: 8632 - protein, 509 aa, Phaeosphaeria nodorum
MSTQEKQATRDSKSGDLSPIPDSDVEVGSVGAVDETPDGDEALRFLKNQHAVGEMTAEEERSLVRKIDWMIMPLMWACYCLQYLDKTLVNYAAVMGIYDDANITTSQFSNLALFFYVSYLVLEFPHGYGMQRFPTAKYLGTCVSLWGFITAITCVCKNYGALVATRILLGCFESAVAPSLILITSMWYKKNEQPLRTGIWYVGVGTGTMIGSLISFGFQHYYSPTFTSWQIMFLVVGLITVGVVIFLLPDNPMSSRLSPAQKVWAIERLRENMTGIENKRFKWYQVVECLSDPQTWMLSLITISSNVPNGAVSSFQSTLIQSFGFDSKTTALLQLPSGVVSIISIIAATYLAGRFNQRGLNICTLLVPGIIGGALMAFLPGHNKIAKLIGNYLTNCIGSSLPLLYSWVAANVAGHTKKVTMNAILLMSFCLGNIVGPLTFRQADQPDFIPAKITIIVTCAFAGFLTMALRGYYVWENKRRDRLTDGTHVANEEFLDMTDKENKNFRYKL

SEQ ID NO: 8633 - DNA, 1494 bp, Phaeosphaeria nodorum
  CDS (1)..(1494)
atgccgtcgctcgacaaggacatcgagacggttcagccttcgcctccggtttctgcgtcgtcgtctcatctggacgatgcatatgaggcgtacaagaataaccgcgacattgaagtcgacccggccgaggcgaagaagacgctacgcaagatagacaagcgcatcgttcctattctcttcttcatctacttgctccaatatcttgacaagaacggaatcaactatgcttctgcatacggcttcattgaaggcacgaatttgggcaagaatggatattcgtggctcggaagtattttctacttcggatatctcgtcggtcaatatccagccggctaccttctccagcgtctgcccatcgccaaattcctcggctactgcacaatcggctggggcgtgattctcatgaccacacctgcgtgcacgaattttgcaggcacagccgcaaaccgcttcctcctagggcttctcgagtctaccgtgaacccaggcttcgtgctgatcatgagtatgtggtatacatccgccgaacaaccattacggctcgaggcatactactgcacgaacggaatcgcaaccatgtttggtggcttgattggctatgcagtcggacatatcacgaccggcctgccgcgctggatgtacgtcttcatcatcttcggcaccttctccacattcatgggtatcatcactttactattccttccggacctgcctaccacggccccattcctaagtgaacgggaacgcgtagtcgccgtcgagagagtcgcagccaatcgccagggcgtgaagaacaggcacttcaaatcctaccaagcctggcagacgcttaaggatcccaagacgtggctgttattcatcatggcgacaggcgctcagatccccaactccgcgctgacttccttctcctccatcatcatcaagtcctttggcgtcgacacgctcggaaacgcattcctctcgctactcgccggtggcttcatatgcactcactggcccaatagccggtgcataaccatgaccgtggcaaacctaatctgcattgttggcgcatccatgctcgtcgcactgcctcacacggcgaaatggggccgcctgatcggtctctggctgtgctacttccagggtcttgggttttccatctcgctcacaattgtgtcttccaacattgcgggaaccactaagaagcaactcacgtccgccgccttgttcacagggtattgtgtaggcaacatcattggacctcaaacgttcaaggacagtgagaagcccggctacgagagcgcgtacattgccatgttgatcggatactcgatcaaattggcggccgtgttggtcttgtttgcgtacatgtggagtgtaaacaagaagcgggacgcagaggctgcgggtggcgtcgtggggttgacggaagaagaggagagagaggcagtcgagaagggcatgttggatgtgacggagattgataacaagggtttcaggtacattctgtag

SEQ ID NO: 8634 - protein, 497 aa, Phaeosphaeria nodorum
MPSLDKDIETVQPSPPVSASSSHLDDAYEAYKNNRDIEVDPAEAKKTLRKIDKRIVPILFFIYLLQYLDKNGINYASAYGFIEGTNLGKNGYSWLGSIFYFGYLVGQYPAGYLLQRLPIAKFLGYCTIGWGVILMTTPACTNFAGTAANRFLLGLLESTVNPGFVLIMSMWYTSAEQPLRLEAYYCTNGIATMFGGLIGYAVGHITTGLPRWMYVFIIFGTFSTFMGIITLLFLPDLPTTAPFLSERERVVAVERVAANRQGVKNRHFKSYQAWQTLKDPKTWLLFIMATGAQIPNSALTSFSSIIIKSFGVDTLGNAFLSLLAGGFICTHWPNSRCITMTVANLICIVGASMLVALPHTAKWGRLIGLWLCYFQGLGFSISLTIVSSNIAGTTKKQLTSAALFTGYCVGNIIGPQTFKDSEKPGYESAYIAMLIGYSIKLAAVLVLFAYMWSVNKKRDAEAAGGVVGLTEEEEREAVEKGMLDVTEIDNKGFRYIL

SEQ ID NO: 8635 - DNA, 1563 bp, Aspergillus oryzae
  CDS (1)..(1563)
atgtcgaaagcaacggtcacagactcagtcagcaccgtcaatgatgttgctcaactacctaagctcagtcaaagatatgccgatgagagttataagctcttttcgaaagtatcagtggcggatcctaccccagaggaggcaatcaaaattaggaataaatgtttgtggagggttttgccctttctttgtatagggtatcatatcatgtatgtggacaagcagacactgggaagttcagccattcttggcattatggatgatgcgcatctcaattcgactcagtacaattggttgtcatcaatcttctacttcggttaccttctcgcggagtggccgcagaactgggcccttcagcgcttccctgtcgccaaatggctggctatcaatcttgtcgtgtggggaggtattacgctccttcatataccatgcaatagctttgccacgttgttcgtcgttcgtttcttactaggggtagcagaggcatccatcgtacctgcctttctgttgatcttgtctatgttcttcacatatcaggaacaggccgttctaatgcctatcatgtggtcaatcggaaacgccagtcctatcacctctggtctactttcctatggggttttgtggattaagacgggtacctttgccccatggaaatggtttatggtcatcactggtggagtgacagtgatgtttgggttggcagtgtggctcttcttccctgacaaccctctgcgagccagcttccttacgccagaagagcgcgcacaggcaatccttcgcataaaggataaccattcgggcattgagcagaagcatttcaagaagtaccagtttatcgaggcagttaaagatccaaagtcgtggctgttcttcctacacgcctggtctcaggaaatggccaacggaatgaccaaccaatactcactaatcattaactcatttggattcactgtgcttcagaccacactactggggtgtgtaaccggaatagtcagcttcttctcgcttgcctcggcagcagtggttttagcgaagacaacaaactgcagagcttggatttctctcattgcatacattcctggggcaatatctagcattctgttgctaagtttaccctggtccaatcgatggggtttaatcacagggatatggatccgctcaactgtcggcattccgtatgcagttgtcatgatctgggctgccaacgcatctgctgggcatactaagaagaccacggtgatcgcgatgtatcatattggatatggattgggaaatatcctctcgccacagttatttcaaccgcgatggaagccgcggtatcgtcccacttggattattctattggtcgtcgcctgcatcctaccatcactcgtcattgtatatctgcgatggtatctctcgaaggaaaacaagcgccgtgatctgctgcagagtgaaacacttgtcaccgatacgggtgtggttgaagaggttgacaacgatggcaccaagcacgcccgtctagtggataagaaccagttggacctgacggatcgtgaaaacctttccttcttagacccagtctga

SEQ ID NO: 8636 - protein, 520 aa, Aspergillus oryzae
MSKATVTDSVSTVNDVAQLPKLSQRYADESYKLFSKVSVADPTPEEAIKIRNKCLWRVLPFLCIGYHIMYVDKQTLGSSAILGIMDDAHLNSTQYNWLSSIFYFGYLLAEWPQNWALQRFPVAKWLAINLVVWGGITLLHIPCNSFATLFVVRFLLGVAEASIVPAFLLILSMFFTYQEQAVLMPIMWSIGNASPITSGLLSYGVLWIKTGTFAPWKWFMVITGGVTVMFGLAVWLFFPDNPLRASFLTPEERAQAILRIKDNHSGIEQKHFKKYQFIEAVKDPKSWLFFLHAWSQEMANGMTNQYSLIINSFGFTVLQTTLLGCVTGIVSFFSLASAAVVLAKTTNCRAWISLIAYIPGAISSILLLSLPWSNRWGLITGIWIRSTVGIPYAVVMIWAANASAGHTKKTTVIAMYHIGYGLGNILSPQLFQPRWKPRYRPTWIILLVVACILPSLVIVYLRWYLSKENKRRDLLQSETLVTDTGVVEEVDNDGTKHARLVDKNQLDLTDRENLSFLDPV

SEQ ID NO: 8637 - DNA, 1545 bp, Aspergillus oryzae
  CDS (1)..(1545)
atggcggatgagaagacttccccacctaccaccgtcgatgtggagaaagacgtcaaggggcacgtcgatccagtgcttaaagaacatgcccaggatgcggatgaggcattgaaagcctttcaggaactccacggcgaagcgatcgagctcgatgccgcaacaaacaagcgacttttaagaataattgactggcatatgatgccgattatgtgttttgtatatggaatgaactacttggacaaaacaaccctatcctacgccagtgtcatgggacttaaatcggacctgaacttgaaaggcgacgaatatcaatggctaggcagtttgttttatttcggatacctggcatgggaatatcccaccaaccgattgctccagcgcctccccttgggtaaatactctgcggcttgcatcatcatttggggaaccattctttgttgcttcgccgctgtcagcaattattccggagccatcgctattcgtttcttccttggtgtcttcgaagcctctgttacaccaggctttgctttgttgacctcacagtggtacaccaagagtgaacaaagcagccgcgtcaacatctggttcagcttcaacggctggggacagatcctgggaggctttgtggcgtacggcatcgcggttggcacagagagacacgggtcagccatcgctccatggaagattgtcttcctttgcacgggtctattaaccgttgcgcttggtgttattttcctctggatagtcccagatagccaactgaatgcccgctggctaaagcaagaagatcgtgttctcgccgtcgctcgcgtcagagaaaaccagcagggtatcggaaacaagcacttcaagctctaccaggtcaaggaagcactcctagaccccatgacttgggcattcttcttctttgcacttatcgccaatattcccaatggcggtatcacaaacttcttcagccagctgatcactagcttcggctacactccccagcagagtctcctgtatggtactcccggcggtgcggttgaggttgtcgctctagttctcaacggttacgccggtcaatacacaggccagcgactcctttgcagcaccggcggcctagtcactgccatagtgggcatggtcctcattgttgctctccccctatcaaacaacgtcggacgtctgatcggttactacatgacccaagcaagcccgactccattcgtggccttgctctcgatggtctcctccaacgtcgccggttatactaaaaagactacagtcgctgcactatttttgatcggctactgcgcaggaaatatcatcggtcctcaagtcttccgccccaaagatgcccctcgctacgtgcccgccgagatcacgatcattgtctgctggggcgtctgtttgtttcttttggccttcatctggtggtggtatagcaaacagaatgctaagaagattcagatcacggagagctccggctacgtgcgactggagaatcaagaatggttggatctaactgatcgggagaaccatgaatttctttattcgttgtag

SEQ ID NO: 8638 - protein, 514 aa, Aspergillus oryzae
MADEKTSPPTTVDVEKDVKGHVDPVLKEHAQDADEALKAFQELHGEAIELDAATNKRLLRIIDWHMMPIMCFVYGMNYLDKTTLSYASVMGLKSDLNLKGDEYQWLGSLFYFGYLAWEYPTNRLLQRLPLGKYSAACIIIWGTILCCFAAVSNYSGAIAIRFFLGVFEASVTPGFALLTSQWYTKSEQSSRVNIWFSFNGWGQILGGFVAYGIAVGTERHGSAIAPWKIVFLCTGLLTVALGVIFLWIVPDSQLNARWLKQEDRVLAVARVRENQQGIGNKHFKLYQVKEALLDPMTWAFFFFALIANIPNGGITNFFSQLITSFGYTPQQSLLYGTPGGAVEVVALVLNGYAGQYTGQRLLCSTGGLVTAIVGMVLIVALPLSNNVGRLIGYYMTQASPTPFVALLSMVSSNVAGYTKKTTVAALFLIGYCAGNIIGPQVFRPKDAPRYVPAEITIIVCWGVCLFLLAFIWWWYSKQNAKKIQITESSGYVRLENQEWLDLTDRENHEFLYSL

SEQ ID NO: 8639 - DNA, 1440 bp, Aspergillus oryzae
  CDS (1)..(1440)
atggccgacattcaagcagaccgcaaaggtatttcgtccgaacatgagcatattgacccgcccgagaaacctcagcacttggctggggttgatgcagaaaccgcagcatatgcaactggtcctcctgtcgagatcgacaaagctaccgatcgacggctattctggaaggtcaataaacggatactcgtgtgcatggttggcacatacttctgccaagctcttgacaagggcactctgggtttcagttcgattatgggaattcaggaagacgcaggtctagatagcgacaaatataactggttggggaccatattgtacattggagtgcttgtgggggagtatccgaccaactttttggctcagaaattgccggtcgctaagtatcttgcggcgaatgtatttttatggggagtggtcatcgcatgcagcgcggccgccacgaacttccccggattaatggtcgttcggttcctcctggggtgctttgaatcctgcgtccagccaatctttattcaaatgacgtctatgtggtatacccgcaaggaacaaccaattttgacaagcctatggaattgcagaggtatcatggcctggggcaccagccattacataggccatgccatcaaatcctggcaactacttttccttgtcctcggggtagcaacttgtgtctgggctgtatttctggcctggtacctccctgacagcccgatgaaagcaaagtgctttaccgaggatgacaaacgcttgctcgtggaacgggttcgggcgaatgaaaccggtattcaaaacaagaccttcaagaaatatcaactagtggaagccctcaccgatcctatcatctggctttatgtcctcatgcaagtctcaagcacacttgtccttggtgggctgggtgtcttctccaacattatcatcaaaagcttcggatttaccacgctgcaaacacaattgctcaatatcgcacagggtgctgtcaccagcgccgtcatggtgggcggagcttcattgtcatcctggacggaccaaacaatcttggtcatgcatttgtggacaatgcaattcatctgggccgaaggaaaccttctattctcggtgatctcccgcaacgtcgccggtcaaacgaagaagtcgactgtgctcgccatgacattcattgcctgggccgccgggaatgcaaccgcaccgcagatcttccaatcctccgacgcaccacgctacaccaagggtttcactgcccatttctgtctctatggaattatgaatggcacgctgctcgttacacggtggcttttgatccgtcggaataaaggaaaaacagacgccacttctatggctgttgctgagaatggtagtcctgaagatatcggtcactcaggcgctttcttggatatgacggatgaggagaatccggattttcggggcttctcaattcattga

SEQ ID NO: 8640 - protein, 479 aa, Aspergillus oryzae
MADIQADRKGISSEHEHIDPPEKPQHLAGVDAETAAYATGPPVEIDKATDRRLFWKVNKRILVCMVGTYFCQALDKGTLGFSSIMGIQEDAGLDSDKYNWLGTILYIGVLVGEYPTNFLAQKLPVAKYLAANVFLWGVVIACSAAATNFPGLMVVRFLLGCFESCVQPIFIQMTSMWYTRKEQPILTSLWNCRGIMAWGTSHYIGHAIKSWQLLFLVLGVATCVWAVFLAWYLPDSPMKAKCFTEDDKRLLVERVRANETGIQNKTFKKYQLVEALTDPIIWLYVLMQVSSTLVLGGLGVFSNIIIKSFGFTTLQTQLLNIAQGAVTSAVMVGGASLSSWTDQTILVMHLWTMQFIWAEGNLLFSVISRNVAGQTKKSTVLAMTFIAWAAGNATAPQIFQSSDAPRYTKGFTAHFCLYGIMNGTLLVTRWLLIRRNKGKTDATSMAVAENGSPEDIGHSGAFLDMTDEENPDFRGFSIH

SEQ ID NO: 8641 - DNA, 1530 bp, Aspergillus oryzae
  CDS (1)..(1530)
atggccgatcctgagatgaaatctgccaagacggagccttcaaatttcgaggataatgtcgaacaactcgcaggagactatagcaatatagcaagcagagacaaagccctgaatctgttggctaatcgccatattgtctttgatcccaattctccgcaggcaaagcgagtgcgacagaagattgacatgcatatcatgccaatgatatttgtcatctactgtctccaactcatggacaaaaatagcttgtcatacgctgcaataatgggcattaaacaagacacgaatctcacaccctcacagtactcctggctaggttcgctcgtgtatttcggctacttagtaggtgatattcctgtgactttccttatgcaacggctacccatatccaagtacttcagcatcatgtgcatgatatggggaattattgttgccttacatgcggtatgccatgactttgccagtttggctacggtccgattttttttgggtgctatcgaggtctcaacggttcccgtggctatcctcattaccggcaccttttacacaaaggaagagcaagtcacaagagtggcgatttggtacacgacatccggatgggcagctgttttcggaggcttccttgcatgggcaatgtatcgtgcagacagctttcgatggcaagggctttttgtcctttatggagctatgacgtttctgactggagttgtcttatttctgttccttgcagcttcgccgaccgaagccaaatggttgaccgaggaagaaaaagtgattgcacttgaacgagtgcgaggcaataaaactggaaccgagatctggaaattcaacgcctcacagcttcgggaagctttacatgatgtccgcttgtacctgactttcctggtgcttatttcgattgggatgcctaacggtggactcactgctttcggtcctactatcatcaataactttggctacgatgtgcctacaacccagctcctgaacgtgggctctggtgcggctcaagtagttggcgttgtcctcgctctgttcgttgcgaaatggaccaaccgcaccatcgccggtgtgttcccacttgtactcgcatgtgttggggctgccatgatgcttggaatctcgagctcgaacaataatgctcgttacggtggttatgtgctcgcctatcaattcccgatctgcgttttgtccataaatacctttatgaccgcaggtatctctgggactacgaagaaatttgcctttgggtgtgcctaccaacttggctatgcgattggcaatattatcggcccccaaacatacagggcatccgatgcgcctgattactacactgcaaaatacaccatgctcgcgttctttgttgttgccgccattttgatcggtatttacggcgtgctccatcatcgatggaatcaaagaaatgaaaagcatgggccggctcctatgcccgaacattcgagcgctattgaaaacgaagaatttgccgacctcactgacttccagatgaggaacttcaaatatccgttatag

SEQ ID NO: 8642 - protein, 509 aa, Aspergillus oryzae
MADPEMKSAKTEPSNFEDNVEQLAGDYSNIASRDKALNLLANRHIVFDPNSPQAKRVRQKIDMHIMPMIFVIYCLQLMDKNSLSYAAIMGIKQDTNLTPSQYSWLGSLVYFGYLVGDIPVTFLMQRLPISKYFSIMCMIWGIIVALHAVCHDFASLATVRFFLGAIEVSTVPVAILITGTFYTKEEQVTRVAIWYTTSGWAAVFGGFLAWAMYRADSFRWQGLFVLYGAMTFLTGVVLFLFLAASPTEAKWLTEEEKVIALERVRGNKTGTEIWKFNASQLREALHDVRLYLTFLVLISIGMPNGGLTAFGPTIINNFGYDVPTTQLLNVGSGAAQVVGVVLALFVAKWTNRTIAGVFPLVLACVGAAMMLGISSSNNNARYGGYVLAYQFPICVLSINTFMTAGISGTTKKFAFGCAYQLGYAIGNIIGPQTYRASDAPDYYTAKYTMLAFFVVAAILIGIYGVLHHRWNQRNEKHGPAPMPEHSSAIENEEFADLTDFQMRNFKYPL

SEQ ID NO: 8643 - DNA, 1578 bp, Aspergillus oryzae
  CDS (1)..(1578)
atgagcaacaagggagaagagaaaaccacgactcgaagagcagcaaaaactgttgaagagaaatacgcagatgtcacattacgcattatcgaagaccatggggatgaattcgggcccctaagtcctgagaaggagaaaaagttgcgccggaagttgtatttgaatattatggtcctgctttctgcgattaatattgtactgtttatagacaagtctacgcttggttacgcagcgattcttgggcttttcgaggagacaggcatttctaaaaagcagtacaacgatttgaatacagtgttctatatcgttattcgaggctaccttgccgcacaatggcccgggcactatctaatgcaacgtctacccttcggaaagtttgtcagtgtcatcgtctttctatgggcagctgttattttccttcattgcgtggcgaccaagttcgccggtctagtagtcctccgacttgccctcggtgcagtggaggcagtcattgtacccgcgatggaaatgactatcggcatgttcttcaaccgtcaagaacaatccttcctccagcccattctctgggtgacttgccaaggagctcccatcgttgcaggtttcatcgcatacggtttgctctacagccatagcgcagttcttccttggaagctctttatgatcgtcaccggtggagtcaccttctttctctccatctgggtttggttctgctacccaagcaatcctgccgaagctcggttcctgactttggaagaaaaagtgcacgttattcgccgagtgcacgactccagccagagctcgatcgaacagaagcggttcaagagatctcagttcgttgaaactctgcgtgaccctgtatcttggctcttcgcgctacaagctttcactctgatgtactcaaataatcttacctatggccaacagaatcttctcacaacttctctcggtgtttcccaacttggttccacgctcgtcgctgtggcaggaggcggcttcggtgtcgtactttgtatcgttgccaccttcgtactaaaatggttcccaaagtacctagcgatccatggacttttctggtgtatccctgctatcgcgggcggaatcggcatggtggcgatcccctgggacaacaaactcgcgctcttagcctgtatgcttctagcgggacatacgtacggtatcacctatatcatcgcactcggctggacgacgtcctctgcagctggatacaccaagaagctcacacgcaacgtgatgttcatgctcggctacagcgtcggcaacctcgtatcaccgcagatctgggtacccagtgctgcacccagatactacggtgcatgggtatccatgatagtgattagttgggcagggacgcctgctatcttatgtatcatttggtttattctagcgcgtcgaaacgaggaacggagaaagtggattgcggaattgagtgacagtgagcgtgaggagggttgtgtggaacagctggatgagaatgggcagatcgtccgaaggaaggttgaccttgcgatgctggatttgactgatctggagaataagttctttatttacccgctctag

SEQ ID NO: 8644 - protein, 525 aa, Aspergillus oryzae
MSNKGEEKTTTRRAAKTVEEKYADVTLRIIEDHGDEFGPLSPEKEKKLRRKLYLNIMVLLSAINIVLFIDKSTLGYAAILGLFEETGISKKQYNDLNTVFYIVIRGYLAAQWPGHYLMQRLPFGKFVSVIVFLWAAVIFLHCVATKFAGLVVLRLALGAVEAVIVPAMEMTIGMFFNRQEQSFLQPILWVTCQGAPIVAGFIAYGLLYSHSAVLPWKLFMIVTGGVTFFLSIWVWFCYPSNPAEARFLTLEEKVHVIRRVHDSSQSSIEQKRFKRSQFVETLRDPVSWLFALQAFTLMYSNNLTYGQQNLLTTSLGVSQLGSTLVAVAGGGFGVVLCIVATFVLKWFPKYLAIHGLFWCIPAIAGGIGMVAIPWDNKLALLACMLLAGHTYGITYIIALGWTTSSAAGYTKKLTRNVMFMLGYSVGNLVSPQIWVPSAAPRYYGAWVSMIVISWAGTPAILCIIWFILARRNEERRKWIAELSDSEREEGCVEQLDENGQIVRRKVDLAMLDLTDLENKFFIYPL

SEQ ID NO: 8645 - DNA, 1443 bp, Aspergillus oryzae
  CDS (1)..(1443)
atgagttccaaggccctggatgtcgctgcctccagttgtccacgagcggatgtcgaacgatccaagcaaccccacggatacgatgacgctatcaaaatattcaacggggagtcaggagagatagatgtcgagttcaccgataaggaagcgtctgtcgtccgctggaagattgacttgatcattgttccaatggtaactgcgatggaacatctggtctctggtatcctatccactgctgcagtctatggactgagaacggatttgaacctgaagggccaacagtatagctggacatcatcgatcttctattttggatacctgttctggcaatacccaaattcgatcttcatgcaaaagcttcctatcggcaagtggatagggtccatgatcttcatgtggggactttgtgtcgccacaacggccgcgtcgactaatttcgcaacactcgccgtgaatcggttcttcttaggcctcttcgaagcttccaacaatcctgcattcaccctattagtcagtcaatacttcacgaagaatgagcatgccctgcgttcatgtatttggtgggctggtggaccaattggcgcatttattggtgatggtgtctcaaacggcatcggccatgtgcatggaaaactgtcccaatggcagtatctatatcttatctttggtcccatcacgatgctgtgggggatcatagtctttttcaccatgccctcctcacccatgtcggcgtggttcttgacacctcgggagaggaagattgctgttgttcgggtgcttcacaaccacgcgggtcttcacaatcgacaatacaaagtttatcaagtcaaggaagccctccgcgatcctcaggcgtggatgctgttctccattgtatttttacagtgtatacccggaggcggtttaaacgcatttaacaagattattctcacgggccttggtttttcaagtgtcgagtccactgttgtcgcgatgccagaacatgccgtccagcttgtcagtgtgttacttgcagcagctctaccgaccgatcggaaaatgtcgcgcttgggtgctgtatattcactgctgacttgtacggtatcctatataatgtgcatgtccctgatatcgtccaacattgctggattcaccaagaaaatgaccgtcagtgttatggttttcgtcggctactgcgtgggccaaattatcacaccgcaattctttctatcgcatgaagcaccaacctatcctaccggattccgtgcatatttcgttacctcgtccatgatgatctcacttgaagcggccctcatgttctatctgctgaatgaaaacaagcgccgggataaacgggcacttgagtcagcggcctctcagagtactggcgagcatcgaattgtagagacggatcttttagatctgacggattgggagagggctcaattcagatatgcctggtaa

SEQ ID NO: 8646 - protein, 480 aa, Aspergillus oryzae
MSSKALDVAASSCPRADVERSKQPHGYDDAIKIFNGESGEIDVEFTDKEASVVRWKIDLIIVPMVTAMEHLVSGILSTAAVYGLRTDLNLKGQQYSWTSSIFYFGYLFWQYPNSIFMQKLPIGKWIGSMIFMWGLCVATTAASTNFATLAVNRFFLGLFEASNNPAFTLLVSQYFTKNEHALRSCIWWAGGPIGAFIGDGVSNGIGHVHGKLSQWQYLYLIFGPITMLWGIIVFFTMPSSPMSAWFLTPRERKIAVVRVLHNHAGLHNRQYKVYQVKEALRDPQAWMLFSIVFLQCIPGGGLNAFNKIILTGLGFSSVESTVVAMPEHAVQLVSVLLAAALPTDRKMSRLGAVYSLLTCTVSYIMCMSLISSNIAGFTKKMTVSVMVFVGYCVGQIITPQFFLSHEAPTYPTGFRAYFVTSSMMISLEAALMFYLLNENKRRDKRALESAASQSTGEHRIVETDLLDLTDWERAQFRYAW

SEQ ID NO: 8647 - DNA, 1515 bp, Aspergillus oryzae
  CDS (1)..(1515)
atggcggaaaagcctcgatcttgtattgaccgggaaacaaaatgtaccgcgccttcggacactgtcgacggacagaaagaacgtggatcggttgatgtacttggcccggaagaggaaaagagactggtgaggaagatcgatcttcatttgatgccactcctcattattagttacggccttcagttcctggacaagacaagtctatcctacagtgcaattctaggcttaaaggaggatctgaaccttgtcgggcaagaatacagttgggcatcgagtatcttttacataggctatctcgcggcttcgtatccaatttcacttggattcgtcaagttccctctggggaaataccttagcttactcattttcctctggggcgctatcttgactctccacgctgttgctaacaattatgccgggctgatggtcttacgaaccttcttgggtgtgtttgagagcgctatcagcccaggcttctcattgataactggaatgtggtacacaccaccagagcacgtctctcgtcacacattttggttcgcaggaaatgccagtttcagcatcatcgggtcgctgattgcttacggtattgcgcattatcaggaccacttctcacaatggaagatgctgtttcttatttttggcctaataaccgtggcatggtcggttgtattgtggttttacctgccagactctccatcaaatgcacacttcctctcttcttctgaacgtgaatttgcttcactgcgaccgaagaagtttcaacgaacaacccagactaggaaatgggaccgcgatcaattcattgaatcctttacggatcctaaaacatggtggttacttattttctcattcgtcatctgtgttccaaatggcggcacgactagctttcaatctctcctgatcgctggttttggctacgataaataccaaaccattcttatgggtcttcccgcttcggcatttcaattggtagtcgtcttactagcgaccatattctgcacgaacgtccgcaagtcccgcctagttgcaattatcatgatatttgctatggccctcgcgggtatcctgatggtcaaattgcttccatcggaacagaagctgtcccggctcgccggttactggatgtcttcggcgatcgcgccagttttccccctcatgctttccctccacgcgagtaacacggccggattcaccaaaaagtcgaccgttgcggcattgatcttcgtggggtactgtgttggaaacttgatcggcccccagtttttcaaggactcggaagcaccgtactatcctactgcctacaccaccatcgtgatttgttatgctatagccatggcctcggcggttgtgtttcgagtctacttggggtgggagaataggcgacgtgataagcagcagggagtgcatatcaatccggaagaaacccgtgagattgacctgcacaccgatgagggcttggaccacgccgatgagacggatatccaaaaccgcagctttagatacattgtgtag

SEQ ID NO: 8648 - protein, 504 aa, Aspergillus oryzae
MAEKPRSCIDRETKCTAPSDTVDGQKERGSVDVLGPEEEKRLVRKIDLHLMPLLIISYGLQFLDKTSLSYSAILGLKEDLNLVGQEYSWASSIFYIGYLAASYPISLGFVKFPLGKYLSLLIFLWGAILTLHAVANNYAGLMVLRTFLGVFESAISPGFSLITGMWYTPPEHVSRHTFWFAGNASFSIIGSLIAYGIAHYQDHFSQWKMLFLIFGLITVAWSVVLWFYLPDSPSNAHFLSSSEREFASLRPKKFQRTTQTRKWDRDQFIESFTDPKTWWLLIFSFVICVPNGGTTSFQSLLIAGFGYDKYQTILMGLPASAFQLVVVLLATIFCTNVRKSRLVAIIMIFAMALAGILMVKLLPSEQKLSRLAGYWMSSAIAPVFPLMLSLHASNTAGFTKKSTVAALIFVGYCVGNLIGPQFFKDSEAPYYPTAYTTIVICYAIAMASAVVFRVYLGWENRRRDKQQGVHINPEETREIDLHTDEGLDHADETDIQNRSFRYIV

SEQ ID NO: 8649 - DNA, 1488 bp, Penicillium canescens
  CDS (1)..(1488)
atggacattttaaaagagagcccagagtgcagcgacaatgctgatcgtacagatggcgagatgctcgagttgagcggtggttacaccgtggaggaagaaagggcggttcttcggaaaattgacatggtcatccttccatttatgtgtttcgtctttttcctgcaatatctcgacaagcagagcctcagctatgctggtgtattcggtctcatcgaagatctcaatatgactagctcacagtactcgtggtctagctcgatcttctacgttggccaacttgtttccgagtaccctttcatctacttgatgagtcgacttccattgaccaagtttgtcggtgctaccgtaattgtctggggcatcatatgtatgtgcctcgcagctccaaccaatttcgcggggttcgccgctgtacgattcctcctcggcttcagtgaaggcgccgtctcacccgcctttgttacaatgacaagtatctggtaccggaagaaagagcacaacatccgcacagcattatggattaccatgaatggtctagcccaagtaattggctgcttcctaatgtacggtatcggtaagaatacctcactttctatcgcgccttggcgtgttttatttatcatctgtggtgccataaccgtccttgcaggcgtgggtttctttatactcatgcccaacggacctaaggacgcgtggtttctcaacgctcgtgagagagaggttccctcgctgcgcatggcagaagatcgggagggtggtgacaaaacgtccttctctatggtgcagctcaaagagacactcatagacccaaaagcatgggttgtcttctggtttggcgttttggtttgtatgcaatcgcctgtattgaccttcccgtcccttgtgatcaagtctataggctatagcaagcttgagactatgcgctacacagctccgtcgggagctgtgcagattgttctgttgtggatcggtgcaggtctggtgtatattttcccgcatcaacgatcactggttgtcctcgctctgattattccacctcttattggcactgttttcttgatgaagttggatgttgctgcccaatggggccttattgtttcttcatggctggcttcttgcattacggcatcgatgacaattcttctttcattggcggcttccaatttcaagggcaacacaaaacgcgccatcgtgaacggcatgttcttcattggttattgcgcgggttgtattgcttcgcctcagctgtggacacacagccctcgctatacctccggtgtgatcacgtcaattgtgacgtggtgtctacttttctgcgtggttattcttttccgcttcctatgtgtgtgggataataagaaacgcgatgagcagtcagcgaactcggatcctatgagtgtagaacaacatgttgcgctggatgagaacggtcttcctcagacagatcttacggacaaacaggatcgggagttccgttatgtatggtaa

SEQ ID NO: 8650 - protein, 495 aa, Penicillium canescens
MDILKESPECSDNADRTDGEMLELSGGYTVEEERAVLRKIDMVILPFMCFVFFLQYLDKQSLSYAGVFGLIEDLNMTSSQYSWSSSIFYVGQLVSEYPFIYLMSRLPLTKFVGATVIVWGIICMCLAAPTNFAGFAAVRFLLGFSEGAVSPAFVTMTSIWYRKKEHNIRTALWITMNGLAQVIGCFLMYGIGKNTSLSIAPWRVLFIICGAITVLAGVGFFILMPNGPKDAWFLNAREREVPSLRMAEDREGGDKTSFSMVQLKETLIDPKAWVVFWFGVLVCMQSPVLTFPSLVIKSIGYSKLETMRYTAPSGAVQIVLLWIGAGLVYIFPHQRSLVVLALIIPPLIGTVFLMKLDVAAQWGLIVSSWLASCITASMTILLSLAASNFKGNTKRAIVNGMFFIGYCAGCIASPQLWTHSPRYTSGVITSIVTWCLLFCVVILFRFLCVWDNKKRDEQSANSDPMSVEQHVALDENGLPQTDLTDKQDREFRYVW

SEQ ID NO: 8651 - DNA, 2354 bp, Saccharomyces cerevisiae
  CDS (562)..(2193)
ggatcccggcggatttttctttcttattgcaccttaatcaggtttacagcctatgactgactctggagtgtcctttcccagtatctgattgtttccgcaacatctatgcatatcagagaagcgttctcatcagtcacttgacaaatgctcgaggagctatcatttgctgataaggtgctacagcgcgctcctgccgcacgctttgttccttttcgataagagtccctcgcgttagtctgagtgaagtgcggaattcagcaaacgaataacaatcgaccttatgatcatgtggattatcggggcaaaagatttggccaagatgtcagagaacgttatcaccaatcactcacacaattaagtggtagtgtaactccgaagatacggctaatacttatcattatctggttttccgaatatacagattggatgaagtaatatatgtatataaatggaccaaggaaacatcaaattaggagatcatgagggaaaggtttaacataacaacattgaagaaaacaacaaaacaaggataatcaaatagtgtaaaaaaaaaaattcaagatgtcagcggatgctagtacaaattcgaatgcttccctagacgaaaaaaatttaaacatcacttcagaagctgaaatcaagaatgaagacgtaaccgcggagccagttctaagcacggtactatcacccaacggtaaaattgtctacatcagtgacaaggttgatgaggccatgaagttggctgaagaagccaaagaaatcgaagtgacaccagaagaagatagaaaacttcgttggaagatcgactattgtatgtttcctttgatgtgtatattgtatgctgttcaatttatggacaagatttccactagttcagcggcggtcatgggattaagaactgacttgaaaatgcatggtgaccagtattcatgggttacttccgccttttatttcggctatctatttatgaacctaggcccggtacagttcattttccaaaggaccagtcacatgtcaaaaatgcttgcggtttttattgtcatatggggaatgttattagctttacatgcagctccaacagttaagtatccttctttcattgttttgagagtacttttaggttgcgcagaaagtgttgtcacaccttgctttaccattatcactgctcaatactggaagacagaggaacaattcacaagagtatcaatttggtttggtatgaacggtcttggctccatcctgatcaacgcaattgcgtacggtgtttacattcaccaggattcttatgctattaaaggctggagaaccttatttgtcattactggtgtgataacaatcttcattggtatcttgatattcctgtggatccctgacgatccatcaaaagcaaggtttttatctaaaagagagaaattaatggttgtccaaagaattaggtctaaccaacaagggttcggtaatcacgagatcaaaaaataccaaattatagaggcgttgaaggatgttaggacgtggttatatttcctctttactgtgagctctaatattcctaatggtggtatttcaagttttatgagtattctattgaatagtgattttggatattcatcaaaggaaaccctattaatgggtttacctacaggtgctgttgaattggtaggttgtccactttttggtattctagcagtttatgcagccaataagaagataccattttggaaatataagttgagttgggctatttttgcagctgtcttagcattgattgctagctgcatgttagggtttgcaacaaactccaaaaaagcaagactggctggtgcttacctgtggtacatctcgcccgtctcatttatttgcgtactttccaatatcagtgcgaattcctcgggatatagtaaaaaatggactgtatcttcaataaacttagtagcatatgctgcagctaacttggcaggaccacaaacctttattgctaagcaggctcctaaatatcatggcgctaaggtcgctatggtcgtatgttatgctgttatgatcgtgcttctatctatactgctcatcgtcaatttaagggaaaacaagagacgtgataagatagctgccgagagagggttccctgaagaaacagagaatttagagttttctgatttgactgattttgaaaatccaaatttcagatacactttatgaaatagtggtgagatacactgacattattgttatcagagaagaatatataaaactaaaatacttaatatcaaaataaggaattttttatcaaagtagaatttctgtaagctacattctcttggtgtagaagatttctcgactgatgtaaaggacaagtcgac

SEQ ID NO: 8652 - protein, 543 aa, Saccharomyces cerevisiae
MSADASTNSNASLDEKNLNITSEAEIKNEDVTAEPVLSTVLSPNGKIVYISDKVDEAMKLAEEAKEIEVTPEEDRKLRWKIDYCMFPLMCILYAVQFMDKISTSSAAVMGLRTDLKMHGDQYSWVTSAFYFGYLFMNLGPVQFIFQRTSHMSKMLAVFIVIWGMLLALHAAPTVKYPSFIVLRVLLGCAESVVTPCFTIITAQYWKTEEQFTRVSIWFGMNGLGSILINAIAYGVYIHQDSYAIKGWRTLFVITGVITIFIGILIFLWIPDDPSKARFLSKREKLMVVQRIRSNQQGFGNHEIKKYQIIEALKDVRTWLYFLFTVSSNIPNGGISSFMSILLNSDFGYSSKETLLMGLPTGAVELVGCPLFGILAVYAANKKIPFWKYKLSWAIFAAVLALIASCMLGFATNSKKARLAGAYLWYISPVSFICVLSNISANSSGYSKKWTVSSINLVAYAAANLAGPQTFIAKQAPKYHGAKVAMVVCYAVMIVLLSILLIVNLRENKRRDKIAAERGFPEETENLEFSDLTDFENPNFRYTL

SEQ ID NO: 8653 - DNA, 1659 bp, Schizosaccharomyces pombe
  CDS (1)..(1659)
atgcctcaaccctcttacgctgatcagattaacgttgaagattcttcagattatgagaaagaccccaaagaatatgttgataaggaaaaaggatattttccacatgttataacttctcatatttctaagagctcgtctcagtcgcatccagatgtgtcaaatgcagtgcttgacgaaacgttcagttttatgcaagaagctaaagatctagaaccgctcacacctaaacaagataaaagattgcgttggaaattgtattttactgtacttgtaatgctcatgatactggatatgatgttatacattgacaaggccacactaagttactcaagtatccttggattatttgaagatacacacataaatagcaaccaatacaatgatataaatacgcttttttatgtgggatttgttattggacagatccctggtcatatgttactgcaaagatttcccgtcagtaagtttgttgctgcttcaacggctctctggacgattataattttcttgcattgcgccgcatataattttagtggtttaatggcacttcgtttttttctgggtcttgtagaatcctcgttgctacctaccatggaagcaaccattggcatgtttttccctcattctgagcaagctcttcttcagccctttttctatatttcatgctatggctgtaatattcctgcagggtttatagcctatggagtccaatatgcaaaaaacaccatatctccttggaagctctttatgataatcgtcggaggaatcacattttttttaactattggactctttttttattacccagataatacttctactgctagattcttgaccaagaaagagagattatacacagttgaccgtgtacgtagaagtaatcatagcggtattgagtcgaagactttcaagaagtatcaagtaatcgaggcgttaaaggatccagtgacatggttatttacttttcatgttttttgcaatcaactttccaacaatttagcttaccaacaaaatttactttttacaagcttgaatgtttctgatttgaattctaccttggtgggcgtcgctagtgccggatataattgcgttagcgcaattatagcaacttatatgatgagtgtgataaaaaaccaaagtgcctttcacggagctatatggtatatcccaagtattgccggaggaattgcgtgcgtagccatgtcatgggatcataaaattggggagttagcagctattattatagcaagcaattttggtatcccttttattatttctcttggatggacaacagcctcttgtgctggatacacaaagaagcttactcgtggtgttatgtttatgattggatatgccattgccaacatcattggcccacaaatgtggcagagtcgtgatgccccgagatattatcctgcttggattgttcaaatagtaattgcttggtctgtttctccctttgtattgctgatcattcgctggattcttgttcgaaggaacaaaaagcgccttgctcttcttgagcagaataaagaacagtatgaaaagacttggattgagacgattgattcttctggaaatcacgtttccggtttttacgaaaattctatgcttgatttgacagaccaggagaacctatcgtttatttatcccttataa

SEQ ID NO: 8654 - protein, 552 aa, Schizosaccharomyces pombe
MPQPSYADQINVEDSSDYEKDPKEYVDKEKGYFPHVITSHISKSSSQSHPDVSNAVLDETFSFMQEAKDLEPLTPKQDKRLRWKLYFTVLVMLMILDMMLYIDKATLSYSSILGLFEDTHINSNQYNDINTLFYVGFVIGQIPGHMLLQRFPVSKFVAASTALWTIIIFLHCAAYNFSGLMALRFFLGLVESSLLPTMEATIGMFFPHSEQALLQPFFYISCYGCNIPAGFIAYGVQYAKNTISPWKLFMIIVGGITFFLTIGLFFYYPDNTSTARFLTKKERLYTVDRVRRSNHSGIESKTFKKYQVIEALKDPVTWLFTFHVFCNQLSNNLAYQQNLLFTSLNVSDLNSTLVGVASAGYNCVSAIIATYMMSVIKNQSAFHGAIWYIPSIAGGIACVAMSWDHKIGELAAIIIASNFGIPFIISLGWTTASCAGYTKKLTRGVMFMIGYAIANIIGPQMWQSRDAPRYYPAWIVQIVIAWSVSPFVLLIIRWILVRRNKKRLALLEQNKEQYEKTWIETIDSSGNHVSGFYENSMLDLTDQENLSFIYPL

SEQ ID NO: 8655 - DNA, 2318 bp, Saccharomyces cerevisiae
  CDS (544)..(2115)
tctactgcacaatccttccgcacacacgcaattagctgccgacttgccccactagtaatcacctgcatctatataagataagatgaagaccttttacgtatcttgaaaaactatacaatagcaaagaaacctaccacccagaccctgtgcggagtatctcgaacttccagtatattactctcaagtagatgacgcgtaatagacaggttttattggcaaatttcgagtcgctatcattatcaacattaattatagggtggtgtttggttggttcgagtgccgtcataactatttgttttttttgcatatctggttgatcctccttagttaatatagtctctttgagtttcccttaaggaactgtcatttggtccggcggaaaacatggtggtgacagacagccttttcagaggtgatgagcaatctcgatgagcatctcagcgggtgcatatatacacgtatataagatagttcaaagtatgatagattaaagtttactttgttgttgctgagaagtagtgagagtgtcagcaaatcaatacaatgaaaaacatgtcacaacgatccatggacgtggagaagaaggcagctaacgctgatagttgttccgtaagtacctcgagcattaatgtagacgatgcggacgttgctttaagattcctgaaacagaacggtctcgacgaaagctccacggctaatgaagacgatgttgtagcaggcgaagaagccaacttctatggttcccatgaattatctcctaaggtcctgagaaaagttgacctcttcatcctgccctttttatgctgtacatatcttctgatgtttttggataaggctctgctgaactacgctgcatctatgggtatcaaagatcatttgaaaggtaacgaattttctaatttgggtactatcttttctgctgcttacattttcatggaacctgtggtcacttacttaattcaaaaattccccatttccaaaatcctaggtacttttattaccgtctggggtatcgtgttggcttgccatgctgcttgtaagacgtacgcctcgttgatggtcgttcgtactctcctaggtctctttgaatcctcgagtgcagttggttgtatcgctattagtggtatgtactatactaaatctgaacagagtgcaagaattggattctgggccacacaggctggtacaggttatattgtgggcgggttaatttcttttggctttttacattatcatggtaccgctttcacctcttggcaaataatgtttttggtcgttggtctggttacagttgcgtttggtgttctaacattcttataccttccagataacgtcaccaatgcttggttcctaaacaaagaggaaaaaattcaagttgttgagcatatcagagctaaccaaactggcctggaaacaaagaagtttaagaagcagcaagttaaagaactattccttcatgataagtttacttggccgatgcttttattaactgcatgttctcaaatttctactggtgccattggtacattttcagtgaccatcactggtacttttggtttcgacaagtacgaaacagcattactgcagttgcctattggtgccattacggctatgattattcttataacaactcaaatgttgtcccgctggggtcatatcacactcataaccacatctatgtatattccagctattataggttgtatcgttcttatcagtttacccttatcccataagatcggtaacttattttctctgtacttgctttacagtggttcctgtgtcattaccaatatttacatctggaattcatgcaacacctccggttacaccaaaagagtttttagaaatgctattacaatgattgtatacaatgtctcctgtattattgctccacagatgtttagggcatactctgctccacgttacataccagcaaagattgccttattggtcactcagtgtgtttgtgttcccctacaattatacattggctacatttgcaagaaggagaacgaaaagcgtgataaggaacaagaaggtcaagaaaggaagaagtaccaatttttggacttgactgatatcgaaaacagaaatttcaggtacatttactaataatcaacttttaatttacaatatataatatttttagtctgtaatattcaatattcaaagacacccaaacattcattgcacttggtatttaccaaaaaattgaagagaaaatttttgagatgaccatggatgaggcaatgaaagtcgaaatttgatccccgctactaacttctaaacatatcgtcaggacaattgagctgaaa

SEQ ID NO: 8656 - protein, 523 aa, Saccharomyces cerevisiae
MKNMSQRSMDVEKKAANADSCSVSTSSINVDDADVALRFLKQNGLDESSTANEDDVVAGEEANFYGSHELSPKVLRKVDLFILPFLCCTYLLMFLDKALLNYAASMGIKDHLKGNEFSNLGTIFSAAYIFMEPVVTYLIQKFPISKILGTFITVWGIVLACHAACKTYASLMVVRTLLGLFESSSAVGCIAISGMYYTKSEQSARIGFWATQAGTGYIVGGLISFGFLHYHGTAFTSWQIMFLVVGLVTVAFGVLTFLYLPDNVTNAWFLNKEEKIQVVEHIRANQTGLETKKFKKQQVKELFLHDKFTWPMLLLTACSQISTGAIGTFSVTITGTFGFDKYETALLQLPIGAITAMIILITTQMLSRWGHITLITTSMYIPAIIGCIVLISLPLSHKIGNLFSLYLLYSGSCVITNIYIWNSCNTSGYTKRVFRNAITMIVYNVSCIIAPQMFRAYSAPRYIPAKIALLVTQCVCVPLQLYIGYICKKENEKRDKEQEGQERKKYQFLDLTDIENRNFRYIY

SEQ ID NO: 8657 - DNA, 26 bp, Artificial sequence
  primer
atgtcaaaagttgacgtaaaaattgg

SEQ ID NO: 8658 - DNA, 28 bp, Artificial sequence
  primer
ttacaaaggatatataaaagtttcgttt

SEQ ID NO: 8659 - protein, 517 aa, Artificial sequence
  consensus sequence
  Variant (2)..(16): Xaa in position 2 to 16 is any amino acid
  Variant (17)..(19): Xaa in position 17 to 19 is any or no amino acid
  Variant (22)..(30): Xaa in position 22 to 30 is any amino acid
  Variant (32)..(40): Xaa in position 32 to 40 is any amino acid
  Variant (41)..(51): Xaa in position 41 to 51 is any or no amino acid
  Variant (53)..(58): Xaa in position 53 to 58 is any amino acid
  Variant (61)..(68): Xaa in position 61 to 68 is any amino acid
  Variant (69)..(71): Xaa in position 69 to 71 is any or no amino acid
  Variant (73)..(76): Xaa in position 73 to 76 is any amino acid
  Variant (77)..(77): Xaa in position 77 is any or no amino acid
  Variant (79)..(80): Xaa in position 79 to 80 is any amino acid
  Variant (82)..(83): Xaa in position 82 to 83 is any amino acid
  Variant (84)..(84): Xaa in position 84 is any or no amino acid
  Variant (86)..(93): Xaa in position 86 to 93 is any amino acid
  Variant (95)..(112): Xaa in position 95 to 112 is any amino acid
  Variant (113)..(114): Xaa in position 113 to 114 is any or no amino acid
  Variant (116)..(117): Xaa in position 116 to 117 is any amino acid
  Variant (120)..(121): Xaa in position 120 to 121 is any amino acid
  Variant (123)..(126): Xaa in position 123 to 126 is any amino acid
  Variant (128)..(134): Xaa in position 128 to 134 is any amino acid
  Variant (135)..(140): Xaa in position 135 to 140 is any or no amino acid
  Variant (142)..(156): Xaa in position 142 to 156 is any amino acid
  Variant (157)..(180): Xaa in position 157 to 180 is any or no amino acid
  Variant (182)..(188): Xaa in position 182 to 188 is any amino acid
  Variant (190)..(191): Xaa in position 190 to 191 is any amino acid
  Variant (193)..(200): Xaa in position 193 to 200 is any amino acid
  Variant (201)..(203): Xaa in position 201 to 203 is any or no amino acid
  Variant (205)..(206): Xaa in position 205 to 206 is any amino acid
  Variant (208)..(209): Xaa in position 208 to 209 is any amino acid
  Variant (211)..(211): Xaa in position 211 is any amino acid
  Variant (212)..(212): Xaa in position 212 is any or no amino acid
  Variant (214)..(223): Xaa in position 214 to 223 is any amino acid
  Variant (225)..(237): Xaa in position 225 to 237 is any amino acid
  Variant (238)..(238): Xaa in position 238 is any or no amino acid
  Variant (240)..(241): Xaa in position 240 to 241 is any amino acid
  Variant (243)..(244): Xaa in position 243 to 244 is any amino acid
  Variant (246)..(248): Xaa in position 246 to 248 is any amino acid
  Variant (249)..(249): Xaa in position 249 is any or no amino acid
  Variant (251)..(253): Xaa in position 251 to 253 is any amino acid
  Variant (255)..(266): Xaa in position 255 to 266 is any amino acid
  Variant (268)..(287): Xaa in position 268 to 287 is any amino acid
  Variant (288)..(301): Xaa in position 288 to 301 is any or no amino acid
  Variant (303)..(355): Xaa in position 303 to 355 is any amino acid
  Variant (356)..(394): Xaa in position 356 to 394 is any or no amino acid
  Variant (396)..(396): Xaa in position 396 is any amino acid
  Variant (397)..(397): Xaa in position 397 is any or no amino acid
  Variant (401)..(414): Xaa in position 401 to 414 is any amino acid
  Variant (416)..(418): Xaa in position 416 to 418 is any amino acid
  Variant (421)..(425): Xaa in position 421 to 425 is any amino acid
  Variant (426)..(427): Xaa in position 426 to 427 is any or no amino acid
  Variant (429)..(429): Xaa in position 429 is any amino acid
  Variant (431)..(460): Xaa in position 431 to 460 is any amino acid
  Variant (461)..(505): Xaa in position 461 to 505 is any or no amino acid
  Variant (507)..(507): Xaa in position 507 is any amino acid
  Variant (510)..(511): Xaa in position 510 to 511 is any amino acid
  Variant (513)..(514): Xaa in position 513 to 514 is any amino acid
  Variant (516)..(516): Xaa in position 516 is any amino acid
KXXXXXXXXXXXXXXXXXXDKXXXXXXXXXGXXXXXXXXXXXXXXXXXXXXYXXXXXXFYXXXXXXXXXXXPXXXXXQXXPXXXKXXXXXXXXWXXXXXXXXXXXXXXXXXXXXRXXLGXXEXXXXPXXXXXXXXXXXXXEXXXXXXXXXXXXXXXXXXXXXXXXXXXXXXXXXXXXXXXWXXXXXXXGXXTXXXXXXXXXXXPXXPXXAXXLXXXXXXXXXXRXXXXXXXXXXXXXXKXXQXXEXXXXDXXXWXXXXXXXXXXXXNXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXTKKXXXXXXXXXXXXXXNXXXPQXXXXXXXPXYXXXXXXXXXXXXXXXXXXXXXXXXXXXXXXXXXXXXXXXXXXXXXXXXXXXXXXXXXXXXXXXXXXXXXXXXXXXDXTDXXNXXFXY

SEQ ID NO: 8660 - protein, 20 aa, Artificial sequence
  protein pattern
  Variant (2)..(2): Xaa in position 2 is any amino acid
  Variant (3)..(3): Xaa in position 3 is Phe, Ile or Leu
  Variant (6)..(7): Xaa in position 6 to 7 is any amino acid
  Variant (9)..(9): Xaa in position 9 is Ala, Ser or Val
  Variant (10)..(10): Xaa in position 10 is Ala, Cys, Gly, Ser, Thr or Val
  Variant (11)..(12): Xaa in position 11 to 12 is any amino acid
  Variant (14)..(19): Xaa in position 14 to 19 is any amino acid
  Variant (20)..(20): Xaa in position 20 is Ala, Gly, Gln, Ser or Thr
RXXLGXXEXXXXPXXXXXXX

SEQ ID NO: 8661 - DNA, 1422 bp, Saccharomyces cerevisiae
  CDS (1)..(1422)
atgcgatcttatatgcagattcttcaaaaatttgccaaatttattgggccagggatattagtcagtgtggcttatatggacccaggaaattatgccactagtgtttccggtggtgctcaatacaaatataccttattattctctatttttatatccaacatttttgccgtacttttgcaatgtctctgtgtgaagctgggtactatcactggctatgatttggctgaaaactgtcgtcataatttgcctaaaaagctaaactataccctttaccttttcgctgaagtggcaatcattgctactgatctggccgaggttgtaggcactgccatcgctttacaaattcttttcaaaataccactaacttggggtgtcttattaacggtgctagatgttttggtaattttaatgttctacacaccaaacggccagtccttaaaaaaagttagggttttcgaatttggcgttgggattttggtcattggaacttgcatttgctttgttttggagctgtttaaagtttcaatcccagacaaagctgaattgtttaaagggtttttgccttcaaatatcatttttaaggaacaacaagctctttacatttcattgggtatcttaggtgccactgtgatgcctcattcattatacttgggctcatccattgttaaaccaagattgcacgattacgatttgaagaaatacggtaaggttaatgcccgcccaagtttaagcgctataaaatatacgttaaactatgcgtacgctgaactaatcatttctttgttcttaattgccacctttgttaattccgctattttaattgttgcaggtgctactttatcaggccaacctgaggcagaggatgctgatttgttatctatttacaaattactggtccactacatatctcctgcggcagggttaatctttgcattggccatgttatgttctggtcaatctgccggtatcatctgtacacttgccgggcaaatcgtttctgagggatttttacagtggtctttaccaccttgggccacaagattgtgcaccagattgattgccattgtaccatgtttatttgttactttaaccatgggggaaaagggaatttcagatattttgaatttttctcaagtggtcttgtccttaattttaccaatcgtttccgctcctttaatttattttaccgcaaatagaaagttgatggttgttcatgacgaaaatggtgtggtaagagcacctgccgatgttaacgccattgctgatgaaaccactccattgaactccaagcacagtaaaatagttgattttactaacagtcgtttgttgacctatacctctgttttcgtatgggctttaatcgggagcttgaattgctatttggtgatttcctatctcttaggtgccgacatccatttttaa

SEQ ID NO: 8662 - protein, 473 aa, Saccharomyces cerevisiae
MRSYMQILQKFAKFIGPGILVSVAYMDPGNYATSVSGGAQYKYTLLFSIFISNIFAVLLQCLCVKLGTITGYDLAENCRHNLPKKLNYTLYLFAEVAIIATDLAEVVGTAIALQILFKIPLTWGVLLTVLDVLVILMFYTPNGQSLKKVRVFEFGVGILVIGTCICFVLELFKVSIPDKAELFKGFLPSNIIFKEQQALYISLGILGATVMPHSLYLGSSIVKPRLHDYDLKKYGKVNARPSLSAIKYTLNYAYAELIISLFLIATFVNSAILIVAGATLSGQPEAEDADLLSIYKLLVHYISPAAGLIFALAMLCSGQSAGIICTLAGQIVSEGFLQWSLPPWATRLCTRLIAIVPCLFVTLTMGEKGISDILNFSQVVLSLILPIVSAPLIYFTANRKLMVVHDENGVVRAPADVNAIADETTPLNSKHSKIVDFTNSRLLTYTSVFVWALIGSLNCYLVISYLLGADIHF

SEQ ID NO: 8663 - DNA, 1383 bp, Bradyrhizobium sp. ORS278
  CDS (1)..(1383): transl_table=11
atggacgccaaatcgccagacctttcgcaactccatgccatggtttcgccgggtgacggcttgatgaccgacgggtggcgcaacgcgcgcggcgagccgtcgctgggcaacatgttcgcgtcggttcgaacctccgccaaaggttcgctgtggcggaagctgatagcctttctcgggcctggttatctcgtggccgtgggctacatggaccccggcaattgggcgacgtcgctcgccggcggttccaaattcggctacgtgctgctctccgtcgcgctgctctccaatctgatggccatcgtgctgcagtcgctatgcacccggctgggtgtcgcaaccgggcgcgacctggcgcaggcctgtcgcgactcgacgccgcgctgggtctcggtgccgttatggctgtctgcggagatcgcaatcactgcgaccgatctggccgaggtcatcggcaccgcgatcgggctcagcctcctgttcgggctgccgctgtcgatcggcgtctgcgtcaccgcgctcgatgtcttcctgatcctggcgctgcaggcgttcggctttcgctggatcgaggctttcgtggttgcgctgctcggaatcatcgcgctgtgcttcgcaatccagatcgcgatggcgcagccggactgggcgcaggtgatcaagggcttcgttccgagcggccagctgatcgccaatcccgaaatgctgtatctggcgctcggcattctcggcgcgaccgtgatgccgcacaatctctatctccattccgggctggtgcagacccgcggctatggcgatagcccggaggagaagcgcgaggcgatcacgctctcgacgatcgattcgacgatcgcgttgtgtctggcgctcaccatcaacgcctcgattctgatcctggccgcggccacattccacaagaccggacagcacgacgtcgccgagctcgaccaggcgcatgcgttcctggcgccgctgctgggatcgacgctcgcgccgacgctgtttgccatcgcgctgctgtgctgtggcctgaactcgacgatcactgccacgctgtctggccagatcgtgatggagggcttcctgcaatggcggatcgcgccgtggctgcgccgcctgatcacgcggatgatcgcgatcgtgccagccgttgtcgtgacgatctgggccggcgaaaaggccaccggacagcttctgattctcagtcaggtcgtgctcagcctgcagctgccgttcgccgtcgtgccgctggttctgatcacggcgagccgctcgaagatgggccagttcgtggcgccgcgctggttgacggccatcgccggcgcaatcgccgtggcgatcatcgtgctcaacgccaagctggtatgggatctcgcggcgggatga

SEQ ID NO: 8664 - protein, 460 aa, Bradyrhizobium sp. ORS278
MDAKSPDLSQLHAMVSPGDGLMTDGWRNARGEPSLGNMFASVRTSAKGSLWRKLIAFLGPGYLVAVGYMDPGNWATSLAGGSKFGYVLLSVALLSNLMAIVLQSLCTRLGVATGRDLAQACRDSTPRWVSVPLWLSAEIAITATDLAEVIGTAIGLSLLFGLPLSIGVCVTALDVFLILALQAFGFRWIEAFVVALLGIIALCFAIQIAMAQPDWAQVIKGFVPSGQLIANPEMLYLALGILGATVMPHNLYLHSGLVQTRGYGDSPEEKREAITLSTIDSTIALCLALTINASILILAAATFHKTGQHDVAELDQAHAFLAPLLGSTLAPTLFAIALLCCGLNSTITATLSGQIVMEGFLQWRIAPWLRRLITRMIAIVPAVVVTIWAGEKATGQLLILSQVVLSLQLPFAVVPLVLITASRSKMGQFVAPRWLTAIAGAIAVAIIVLNAKLVWDLAAG

SEQ ID NO: 8665 - DNA, 1653 bp, Oryza sativa (japonica cultivar-group)
  CDS (1)..(1653)
atggaggagggggcgaagatcgggagggagcacgagcagcagcagcagcagcacgggagggtgaacggtagcgggagggtcgcggccgtcggtggcggcagcggcggtggcggggacgagattgagattgaggtcgccgcagccgcaggggcttcgccgtcgcggcaacacggcggtctgcacggcgatgtccaggcacccacttggaagagatttcttgcacatgttggtcctggatttgttatctccatcgcataccttgatcctagtaacttgcagactgatttggtagctggatccagccacagatattcgttgctatgggtactcctatttgggttcatatttgtgttgactgtacaatcattggcagcaaatttgggtatcattacaggaaggcacctcgctgagttgtgcatgggtgaatatccaaagtatgtcaagtactgcctatggttactagcagagcttggtgttattgctgccactataccaggagttttaggaactgctttagcctacaacatgctactccacatccctttctgggccggtgtcctagcatgtggggcatgcactttcctaattctcgggttacaaggatatggggctcggaaaatggagttcactatatcagttcttatgttggtgatggctacttgcttttttatggaacttggcaaagttaatcctcctgctggtggggtaattgaggggctttttatcccaaggcccaaaggggattattctacttcagatgcggttgctatgtttggttctcttgttgttccgcataatctcttcctacattcttctttggtgctaacgagaaaaatgccatatacttccaaaggacgcaaggatgcttctacattcttcttgcttgagaatgcattagctctgttcattgcactacttgtaaatgtcgctattgtatcaatatctggtactatatgtgccaacaatctctcatttgccgacacaagcacgtgcagcagtctaacattgaattcaacttatgtactactcaagaatattttgggaaaatcaagttcaactgtgtatggtgtggccttattagtttctggacagagctgcatggtggctacgagttatgctggccaatacatcatgcagggcttctccggaatgagaaagtgcatcatatatcttgttgctccttgtttcaccttattacctagtttgataatttgcagcattggtggtactttacgagtgcatcgaattatcaacatagctgcgattgtactatcatttgtgctgccgtttgctctaattccactcattaaattcagtagcagctgcacaaatataggaccatacaagaatgcaacatctattatccgaatcgcgtggatactgtcattggtgattattggaatcaatatttatttcttctgtactagctttgtcgcttggcttgttcatagcgaccttccaagggttgttaatgcaataattagcagccttgttttccctttcatggcagcctatattgctgctctgatctacttggctttcagaaaagttaacctttcagatccattccccaccaattcagtttctggtgagattgaagttcaacacatacaaatacaagagaagcaggaagatttaggtgtacatttatga

SEQ ID NO: 8666 - protein, 550 aa, Oryza sativa (japonica cultivar-group)
MEEGAKIGREHEQQQQQHGRVNGSGRVAAVGGGSGGGGDEIEIEVAAAAGASPSRQHGGLHGDVQAPTWKRFLAHVGPGFVISIAYLDPSNLQTDLVAGSSHRYSLLWVLLFGFIFVLTVQSLAANLGIITGRHLAELCMGEYPKYVKYCLWLLAELGVIAATIPGVLGTALAYNMLLHIPFWAGVLACGACTFLILGLQGYGARKMEFTISVLMLVMATCFFMELGKVNPPAGGVIEGLFIPRPKGDYSTSDAVAMFGSLVVPHNLFLHSSLVLTRKMPYTSKGRKDASTFFLLENALALFIALLVNVAIVSISGTICANNLSFADTSTCSSLTLNSTYVLLKNILGKSSSTVYGVALLVSGQSCMVATSYAGQYIMQGFSGMRKCIIYLVAPCFTLLPSLIICSIGGTLRVHRIINIAAIVLSFVLPFALIPLIKFSSSCTNIGPYKNATSIIRIAWILSLVIIGINIYFFCTSFVAWLVHSDLPRVVNAIISSLVFPFMAAYIAALIYLAFRKVNLSDPFPTNSVSGEIEVQHIQIQEKQEDLGVHL

SEQ ID NO: 8667 - DNA, 1638 bp, Oryza sativa (japonica cultivar-group)
  CDS (1)..(1638)
atggaagggactggtgagatgagagaggttggacgagaaactctccatggaggtgtggtgcagagtgttagtgagactgatgagtacaaagaaaagactattgacagtgaaaaagatgggcagtttcgggtgcagccaagatggaggaaattcttggctcatgttgggcctggagctctggtggccattggcttcctagatcctagcaacttggaaactgacatgcaagctggagctgacttcaagtatgagcttctgtgggtcatcttagttgggatggtctttgcacttctgatccaaacattagctgccaaccttggagtgaaaacaggaaggcaccttgctgaactgtgcagggaagagtacccgcactatgtcaacattttcttatggatcattgcggagttggcggtgatttctgatgacattcctgaagtgttgggcacagcttttgcgttcaacatattgcttaagattccagtgtgggctggagttattctcacagtgttcagcaccctcttgcttcttggagtacagagatttggggctcggaagctggagttcatcatagcagcattcatgttcactatggcagcttgcttcttcggagagctaagctatttgaggccgtctgcaggagaggtggtcaagggcatgtttgtcccttctctccaagggaaaggcgctgctgccaatgcgatcgcactctttggcgctatcatcacaccatacaacttgttcttgcactctgctctggtcctgtcaaggaagaccccacgatcagacaaaagcatcagagctgcttgcagatacttccttattgagtgtagtcttgcattcatcgtggctttcctcataaatgtttcagtcgttgttgttgctggatccatttgcaatgcgaataatctttctccagctgatgccaacacgtgtggtgacctaactctgcaatccacacctcttttactcaggaatgttttggggagatcaagctcggtggtgtatgctgttgcgctgctagcttctgggcaaagcaccactatcagttgcacgttcgctgggcaggtcatcatgcaggggtttctggacatgaagatgaagaattgggtaaggaacctcatcacccgagtcatcgccatagctcctagcctcatcgtctccattgtcagtggtccctcaggcgccggcaagctaatcatcctgtcatcaatgatcctgtcatttgagctgccgttcgctctcatccctctactcaagttctgcaacagcagcaagaaagttggacccctcaaggaatccatctatacggtggtgatcgcgtggatcctgagcttcgcgctcatcgtcgtcaacacctacttcctagtgtggacatacgtggactggctcgtccacaacaacctccccaagtatgccaatggcctcatctccgtggtggtgttcgcgctcatggccgcctacctggtcgccgtcgtctacctgacgttcaggaaggacacggtggcgacgtacgtgccggtgccggagcgggcgcaggcgcaggtggaggccggcgggacgccggtggtggacgcctccgccgccgacgaggaccagccggctccgtacaggaaggaccttgccgatgcttccatgtag

SEQ ID NO: 8668 - protein, 545 aa, Oryza sativa (japonica cultivar-group)
MEGTGEMREVGRETLHGGVVQSVSETDEYKEKTIDSEKDGQFRVQPRWRKFLAHVGPGALVAIGFLDPSNLETDMQAGADFKYELLWVILVGMVFALLIQTLAANLGVKTGRHLAELCREEYPHYVNIFLWIIAELAVISDDIPEVLGTAFAFNILLKIPVWAGVILTVFSTLLLLGVQRFGARKLEFIIAAFMFTMAACFFGELSYLRPSAGEVVKGMFVPSLQGKGAAANAIALFGAIITPYNLFLHSALVLSRKTPRSDKSIRAACRYFLIECSLAFIVAFLINVSVVVVAGSICNANNLSPADANTCGDLTLQSTPLLLRNVLGRSSSVVYAVALLASGQSTTISCTFAGQVIMQGFLDMKMKNWVRNLITRVIAIAPSLIVSIVSGPSGAGKLIILSSMILSFELPFALIPLLKFCNSSKKVGPLKESIYTVVIAWILSFALIVVNTYFLVWTYVDWLVHNNLPKYANGLISVVVFALMAAYLVAVVYLTFRKDTVATYVPVPERAQAQVEAGGTPVVDASAADEDQPAPYRKDLADASM

SEQ ID NO: 8669 - DNA, 1653 bp, Oryza sativa (japonica cultivar-group)
  CDS (1)..(1653)
atgagcggcccaatgcaacgctcgtcgcagccacagtttatctctagcgtcgagcggaacaatcaatcgaatggtcctggcactcctcttattgacagcatagatgttgatcagattgttattccagagaaaaatagttggaagaacctattttcatacatagggcccggatttcttgtctctattgcgtatattgatcctggaaattttgagacagacctacaggctggagcacagtacaaatatgagcttctttggatcatacttattgcgtcatgtgctgctcttataattcaatcacttgcagctaggctaggagtcgtgactgggaagcacctggccgagcattgcagagctgaatatccaaaggctacaaatttcatattatggattcttgcggaactagctgtagttgcatgcgacattcctgaagtaattggaactgcttttgctttgaacatgctctttaaaatccctgtgtggtgtggtgttctgataactggactcagcactctgatgctactgttactacaacaatatggggtccgtaaactggaatttctgatagctattctggtgtcattaatagcaacttgtttcttagttgagcttgggtattctaaaccaaattcttcagaagttgtgaggggcctttttgttcctgaacttaaagggaatggagccacaggtcttgctatctcactacttggtgctatggtgatgccgcataatctttttctccactcagcattggtactatcaagaaaagtgccacggtcagttcatgggatcaaagaggcatgtagattctatatgattgaaagtgcatttgccctcacgatagcgttcctcattaacatatctatcatatctgttagtggtgctgtctgcgggtcagataatttgagtcctgaagaccagatgaattgcagtgatcttgatcttaacaaagcttcgtttttgttaaagaatgtcctcggaaactggagctcaaagttatttgcagtagccttgttggcgtctggccagagttctacaattacaggaacttatgcgggacaatatgtcatgcaggggtttctagatcttcggatgacaccctggatacggaaccttctaactaggtccttggcaattctgccaagtctgattgtttcgataattggaggttcctcagcagctggacagttgattatcattgcatcgatgatactgtcatttgagcttccttttgctctagttccactcctaaaattcacaagcagcaggacaaaaatggggcagcacacaaattcaaaagccatttctgtgataacatggggaattggttcgtttatcgttgtcatcaacacctacttcctgataacaagctttgtcaagctgcttctccacaacggtctatcgactgtatcccaagtattctccgggatattcggtttcctggggatgctcatatacatggctgcaattctctacctcgttttccggaagaacaggaaagctaccctgccattgctggagggcgattcgacggtccgcatagtaggtcgcgacacggccactgaaggagaaggttctcttggccatctgccccgggaggacatctccagcatgcagcttcctcagcagcgaactgcttctgatctcgattag

SEQ ID NO: 8670 - protein, 550 aa, Oryza sativa (japonica cultivar-group)
MSGPMQRSSQPQFISSVERNNQSNGPGTPLIDSIDVDQIVIPEKNSWKNLFSYIGPGFLVSIAYIDPGNFETDLQAGAQYKYELLWIILIASCAALIIQSLAARLGVVTGKHLAEHCRAEYPKATNFILWILAELAVVACDIPEVIGTAFALNMLFKIPVWCGVLITGLSTLMLLLLQQYGVRKLEFLIAILVSLIATCFLVELGYSKPNSSEVVRGLFVPELKGNGATGLAISLLGAMVMPHNLFLHSALVLSRKVPRSVHGIKEACRFYMIESAFALTIAFLINISIISVSGAVCGSDNLSPEDQMNCSDLDLNKASFLLKNVLGNWSSKLFAVALLASGQSSTITGTYAGQYVMQGFLDLRMTPWIRNLLTRSLAILPSLIVSIIGGSSAAGQLIIIASMILSFELPFALVPLLKFTSSRTKMGQHTNSKAISVITWGIGSFIVVINTYFLITSFVKLLLHNGLSTVSQVFSGIFGFLGMLIYMAAILYLVFRKNRKATLPLLEGDSTVRIVGRDTATEGEGSLGHLPREDISSMQLPQQRTASDLD

SEQ ID NO: 8671 - DNA, 1617 bp, Oryza sativa (japonica cultivar-group)
  CDS (1)..(1617)
atggagattgagagagagagcagtgagagagggagcatcagctggagagctagtgcggcacatgatcaagatgccaagaagctcgacgcagatgatcagctgctaatgaaggagcctgcatggaaaaggttccttgcccatgttggtcctggattcatggtgtctttagcctacttggatcctggcaatttggaaaccgatctgcaagccggagccaaccacagatatgagctgctctgggtgattctgattggactcatcttcgcacttatcatacagtcgctagcagctaatcttggagtggttacagggaggcatctggctgagatctgcaagagtgagtaccccaagttcgtcaagattttcctatggctgctggcagagttggccgtcatcgctgcagatatcccagaagttatagggacggcctttgctttcaacatattgttccatattccggtgtgggtcggcgtcctcatcaccggcaccagcactctactgcttcttggcctccaaaaatacggggtgaggaagctggagtttctgatatcgatgctggtgttcgtgatggcggcgtgcttcttcggggagctgagcatcgtgaagccgccggcgaaggaggtgatgaaggggctcttcatccccaggctcaacggcgacggcgccaccgccgacgccattgccctcctcggagctcttgtcatgccccacaatctgttcttgcattctgccttggtgctatcgaggaagacaccggcatcagtcagaggaatcaaggacgggtgcaggttcttcctgtacgagagcgggttcgcgctgttcgtggcgctgctgataaacatcgccgtcgtctccgtctccggcaccgcctgctcctccgccaacctctcccaagaggacgccgacaagtgcgccaacctcagcctcgacacctcctccttccttctcaagaacgtgctgggcaagtcgagtgcgatcgtgtacggcgtggcactgttggcatctgggcagagctccactattaccggcacatacgctggacagtacatcatgcagggtttcttggacatcaggatgaggaagtggcttcggaacctgatgacaagaaccatcgccatcgcgccgagcctcatcgtctccatcatcggcggctccaggggcgccggccgcctcatcatcatcgcttcgatgatactgtccttcgagctgccgtttgctctcatccctcttctcaagttcagcagcagtaagagcaagatggggccccacaagaactctatctatataatagtgttctcgtggttcctgggtctgctcatcatcggcatcaacatgtacttcctgagcacgagcttcgtcggctggctcatccacaacgacctccccaagtacgccaacgtgctcgtcggcgccgccgtcttcccgttcatgctcgtctacatcgtcgccgtcgtctacctcaccatcaggaaggactccgtcgtcaccttcgtcgccgactcctccctcgccgccgtcgtcgacgccgagaaggccgacgccggcgacctcgccgtcgacgacgacgagcccttgccgtaccgcgacgacctggccgacatcccgctcccaaggtag

SEQ ID NO: 8672 - protein, 538 aa, Oryza sativa (japonica cultivar-group)
MEIERESSERGSISWRASAAHDQDAKKLDADDQLLMKEPAWKRFLAHVGPGFMVSLAYLDPGNLETDLQAGANHRYELLWVILIGLIFALIIQSLAANLGVVTGRHLAEICKSEYPKFVKIFLWLLAELAVIAADIPEVIGTAFAFNILFHIPVWVGVLITGTSTLLLLGLQKYGVRKLEFLISMLVFVMAACFFGELSIVKPPAKEVMKGLFIPRLNGDGATADAIALLGALVMPHNLFLHSALVLSRKTPASVRGIKDGCRFFLYESGFALFVALLINIAVVSVSGTACSSANLSQEDADKCANLSLDTSSFLLKNVLGKSSAIVYGVALLASGQSSTITGTYAGQYIMQGFLDIRMRKWLRNLMTRTIAIAPSLIVSIIGGSRGAGRLIIIASMILSFELPFALIPLLKFSSSKSKMGPHKNSIYIIVFSWFLGLLIIGINMYFLSTSFVGWLIHNDLPKYANVLVGAAVFPFMLVYIVAVVYLTIRKDSVVTFVADSSLAAVVDAEKADAGDLAVDDDEPLPYRDDLADIPLPR

SEQ ID NO: 8673 - DNA, 1557 bp, Oryza sativa (japonica cultivar-group)
  CDS (1)..(1557)
atgggggtgacgaaggcggaggcggttgccggcgacggcgggaaggtggtggacgacatcgaggcgctcgccgatctcagaaaggagccagcatggaaaaggtttttgtcccacattggaccaggctttatggtctgtttggcttacctcgatcctggaaatatggagactgatctacaagctggtgccaatcacaaatatgagcttctttgggtgattttgattggcctgatctttgcactgattatacaatcattatcggctaatcttggagtggtgacagggcgccatcttgctgagctgtgcaagactgaatatccagtatgggtgaaaacctgcttatggctgctagcagaactagctgtgattgcttccgatattccagaagttataggtacaggatttgctttcaaccttttgttccacataccagtgtggaccggggttctcattgctggctctagcacgcttcttcttcttggactgcaaagatatggggtaaggaaactggaggttgtggtcgcgctattggtgtttgtcatggcagggtgcttcttcgtggagatgagcatagtcaagcctccggttaatgaggtccttcaaggattattcatccccaggctcagtgggcccggtgccacaggagactccattgcccttcttggggctcttgtaatgccgcacaatctattcttgcactctgccctggtgctgtcgaggaatacacccgcatcagcaaaaggaatgaaggatgtctgtaggttcttcctctttgagagtgggatagctcttttcgtggctctgcttgtcaacattgcaatcatctctgtctccggcactgtatgtaatgcaaccaacctttcaccagaagatgctgtaaaatgcagcgaccttacattggactcctcatccttcctcctcaggaatgtgctaggaaagtcaagtgcgacagtgtacggtgtagcactcttggcttctggacagagctcgaccattactggcacttatgctgggcaatatgttatgcaggggttcctagacatcaaaatgaaacagtggcttcggaacctgatgacacgcagcattgccattgtgcctagcttaatcgtctccatcattggagggtctagtggcgccggtcgtctcatcgtcattgcatcgatgattctatcctttgagctaccatttgctctgatccctcttctcaagttcagcagcagcagcaacaagatgggtgaaaacaagaactccatctatattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgagcacagcaaagagccacccgtgtag

SEQ ID NO: 8674 - protein, 518 aa, Oryza sativa (japonica cultivar-group)
MGVTKAEAVAGDGGKVVDDIEALADLRKEPAWKRFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 8675 - DNA, 1626 bp, Oryza sativa (japonica cultivar-group)
  CDS (1)..(1626)
atggcccccctccccgccgccgccaccgccaccgcctcctccgccgccacccccgccgacgacgaggcccactccctcctcccttccaccccctccaacgaggaggatgacgacgacctcgaggagcgcgcctacgaggcgaccgagaaggtcatcgtctcgatctcggacttccccgacgccgacgacgacgaggaggagtccgggctcgccacctccaccgccgcctcggggatcccgcccttctcgtggaggaagctgtggctgttcacggggccggggttcctcatgagcatcgcgttcctcgacccggggaacctcgagggggacctgcaggccggggcggtggccggggacacgctgctgtggctgctcctgtgggcgacctccatgggcctcctcgtccagctgctcgccgccagggtgggcgtcgccacggggaggcacctcgccgagctctgccgcgacgagtacccctcctgggcgcgccgcgcgctgtggctcatggccgaggtcgccatggtcggggccgacatccaggaggtgatcggcagcgccatcgccatcaagatcctcagccgcggcttcctccctctctgggccggcgtcgtcatcaccgccttggattgtttcatttttttgtctcttgaaaactacggggtgaggaaattagaagctgtatttgcgattctaattgcgactatggctgtctcctttgcatggatgtttactgataccaagccaaacatgaagaacctgttcataggtattttggtcccaaaattgagctccaggacaataagacaagcagttggggttgttggatgtgttatcatgccacacaatgtgtttctccattcagcgcttgttcagtcgagaaaaatagacccaaacaaggaacaccaagtccgtgaagcgttgagatactattcaatagagtcaaccatcgccttggctgtgtccttcatgataaatctctttgtaacaactgtttttgcgaaaggattttatggcacaaaagaagctggtaatattggccttgaaaatgctggacagtatctacaggagaagtttggtggagggtttttccctatcctctacatttggggaattggactattagctgcggggcagagtagtaccataacgggaacatatgctggacagtttataatgggtggatttttgaacttgaagttgaaaaaatggatcaggtcactcatcacccgaagctttgcgattgtgccaacgataattgtcgcactcttcttcgataaatcggattcgctggatgttctaaacgagtggctaaatgtgcttcaatcaattcagatcccttttgccctgattccgctgataactttggtttccaaggagaaagttatgggggtatttaaaataggtcgaaatactcaagctgtgacctggacagtggcgacactattgatcacgatcaatggctatctcttgctggatttcttctcttcagaaataagaggcctattatctggctcaattctctgcgtggcagtacttgcttatgcttcttttgtattgtatctcatcctgcggggtaccgagctgccaaatcagatcatcacaactatacgcaagagtttttcatga

SEQ ID NO: 8676 - protein, 541 aa, Oryza sativa (japonica cultivar-group)
MAPLPAAATATASSAATPADDEAHSLLPSTPSNEEDDDDLEERAYEATEKVIVSISDFPDADDDEEESGLATSTAASGIPPFSWRKLWLFTGPGFLMSIAFLDPGNLEGDLQAGAVAGDTLLWLLLWATSMGLLVQLLAARVGVATGRHLAELCRDEYPSWARRALWLMAEVAMVGADIQEVIGSAIAIKILSRGFLPLWAGVVITALDCFIFLSLENYGVRKLEAVFAILIATMAVSFAWMFTDTKPNMKNLFIGILVPKLSSRTIRQAVGVVGCVIMPHNVFLHSALVQSRKIDPNKEHQVREALRYYSIESTIALAVSFMINLFVTTVFAKGFYGTKEAGNIGLENAGQYLQEKFGGGFFPILYIWGIGLLAAGQSSTITGTYAGQFIMGGFLNLKLKKWIRSLITRSFAIVPTIIVALFFDKSDSLDVLNEWLNVLQSIQIPFALIPLITLVSKEKVMGVFKIGRNTQAVTWTVATLLITINGYLLLDFFSSEIRGLLSGSILCVAVLAYASFVLYLILRGTELPNQIITTIRKSFS

SEQ ID NO: 8677 - DNA, 1257 bp, Pseudomonas aeruginosa PAO1
  CDS (1)..(1257): transl_table=11
gtggcggtgccggccgacgcctcgccgctgcgcaagctggcgctgttcgtcggccccggcctgctggtctcggtcggctacatggaccccggcaactgggccaccgccatcgaggcgggctcgcgcttcggctacgcgctgctgttcgtagtggtgctggcgagcttttccgggatgctcctgcaaagcctctgttcgcgcctggggatcgccaccggccgcgacctcgcgcagctctcccgggagcgctaccgccctggcgtggcgcgtggccaatggctgctggcggaactgtcgatcgtcgccaccgaccttgccgaggtgctcggcgcggcgctggccttccacctgctgctgggcgtctcgattaccaccggggtggtcctcaccgccttcgataccctgatcgtgctggccctgcagggcgccaacttccgccgcctggaggccatagtgctggggctgatcgcgaccatcggcgcgtgtttcttcgtcgaactggtgctgatcggcccctactggccggatgtcgccgccggcttgcggccgtcctgggacacgctgagcagccaggagccgctgtacctggcgatcggcatcctcggcgcgacggtgatgccgcacaacctctacctgcattcgtccgtggtgcagacccgggtcagcggcgacgacgcggcgagcaaacgctcggcgatccgcttttcccggctcgacaccatcggctcgctgtccctggcgctgctggtcaatgcggcgatcctgatcctcgccgccgcggctttccacggtagcggccataccgaggtggtggagatccaggacgcctaccacctgctcgacccgttggtgggcggcgccctggccagcttcctgttcggcttcgccctgctggcggcggggcaaagctcgaccttcaccggcaccattgccgggcaggtggtgatggagggtttcctccgggcgaagattccctgctggcagcggcgcctgatcacccgcggcctggccctggtgccggccttgatcggcgtgctctggctgggcgaagccgcggtaggcaagctgctggtgctcagccaggtggtgctcagcctgcaattgccgttcgccctgtggccgctgattcgcttcagcagcgaccggggcctcatgggggagttcgtcaacccgcgctgggtcagcgcgctggcctggtcgttgttcggcctgatctcggcggcgaacctgaccttgctgtatttctggttcggctga

SEQ ID NO: 8678 - protein, 418 aa, Pseudomonas aeruginosa PAO1
MAVPADASPLRKLALFVGPGLLVSVGYMDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEAAVGKLLVLSQVVLSLQLPFALWPLIRFSSDRGLMGEFVNPRWVSALAWSLFGLISAANLTLLYFWFG

SEQ ID NO: 8679 - DNA, 1239 bp, Escherichia coli O157:H7 EDL933
  CDS (1)..(1239): transl_table=11
  misc_feature (1153)..(1153): s is g or c
  misc_feature (1155)..(1155): s is g or c
atgacgaactatcgcgttgagagtagcagcggacgggcggcgcgcaagatgaggctcgcattaatgggacctgcgttcattgcggcgattggttatatcgatcccggtaactttgcgaccaatattcaggcgggtgccagcttcggctatcagctactgtgggttgtcgtttgggccaacctgatggcgatgctgattcagatcctctctgccaaactagggattgccaccggtaaaaatctggcggagcagattcgcgatcactatccgcgtcccgtagtgtggttctattgggttcaggcagaaattattgcgatggcaaccgacctggcggaatttattggtgcggcgatcggttttaaactcattcttggtgtttcgttgttgcagggcgcggtgctgacggggatcgcgactttcctgattttaatgctgcaacgtcgcgggcaaaaaccgctggagaaagtgattggcgggttactgttgtttgttgccgcggcttacattgtcgagttgattttctcccagcctaacctggcgcagctgggtaaaggaatggtgatcccgagtttacctacttcggaggcggtcttcctggcagcaggcgtgttaggggcgacgattatgccgcatgtgatttatttgcactcttcgctcactcagcatttacatggcggttcgcgtcaacaacgttattccgccaccaaatgggatgtggctatcgccatgactattgccggttttgtcaatctggcgatgatggctacagctgcggcggcgttccacttttctggtcatactggtgttgccgatcttgatgaggcttatttgacgctgcaaccgctgttaagccatgctgcggcaacggtctttgggttaagtctggttgctgccggactgtcctcaacggtggtggggacactggcagggcaggtggtgatgcaggggttcattcgcttccatatcccgctgtgggtgcgtcgtacagtcaccatgctgccgtcatttattgtcattctgatgggattagatccgacacggattctggttatgagtcaggtgctgttaagttttggtatcgccctggcgctggttccactgctgattttcaccagtgacagcaagttgatgggcgatctggtgaacagcaaasgsgtaaaacagacaggctgggtgattgtagtgctggtcgtggcgctgaatatctggttattggtggggacggcgctgggattgtag

SEQ ID NO: 8680 - protein, 412 aa, Escherichia coli O157:H7 EDL933
  misc_feature (385)..(385): The Xaa at location 385 stands for Arg, or Gly.
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLAMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKXVKQTGWVIVVLVVALNIWLLVGTALGL

SEQ ID NO: 8681 - DNA, 1290 bp, Mycobacterium tuberculosis CDC1551
  CDS (1)..(1290): transl_table=11
ttggtggcgggcgaatttcggttactctcgcatctttgttcgcgtggatcgaaagtcggtgagttggcccaggacacccggacttccctgaagacgagctggtatctgctcgggccagcctttgtcgcggccatcgcctacgtcgaccccgggaacgtggcagccaacgtcagctccggcgcccagttcggctacctgttgttatgggtgatcgtcgccgccaacgtgatggccgccctggtgcagtacctgtcggcaaagctcgggctggtgaccggacgctcactgccggaagcgatcggcaagcgaatgggacgcccggcccggctggcctactgggcacaggccgagatcgtcgcgatggcaaccgatgtggccgaagtgatcggcggagctatcgcattgcggatcatgttcaacctgccgctgccgatcggcgggatcatcaccggggtggtctcgctgctgctgctgacgatccaggatcggcgcggtcaacgtttgttcgagcgcgtcatcaccgccttgctgctggtgattgccatcggcttcaccgccagtttcttcgtcgtgacaccaccccccaatgcggtcctcggcggtttggcaccgcgctttcagggaaccgagagcgttcttttggccgcggcgatcatgggggcgaccgtcatgccgcacgccgtctacctgcattcaggtctcgcgcgcgaccggcacgggcatcccgatccgggccctcagcggcgccggctgctgcgcgtcacccgctgggatgtcggcctggcgatgctgatagccggcggggtaaacgccgcgatgctgctggttgccgcgctgaacatgcggggccgtggggacaccgcctcgatcgaaggcgcctaccacgccgtccacgacaccttgggggcgacgatcgcggtgctcttcgcggtcgggttgctggcgtccggcttggcgtcgtcgtcggtgggtgcttacgccggcgcgatgatcatgcaggggctgctgcactggagcgttcccatgctggtgcgccgcctaatcacgctgggccccgcgttggcgatacttacgctgggcttcgaccccacccgcacattggtgctctcacaggtggtgctgtcgttcggtattccgtttgcggtacttccactggtcaaactcaccggcagccccgcggtgatgggcggcgacaccaaccatcgcgccacgacttgggttggctgggtggtcgcggtgatggttagtctgctcaacgtgatgctgatctatctcacggtgaccggctga

SEQ ID NO: 8682 - protein, 429 aa, Mycobacterium tuberculosis CDC1551
MVAGEFRLLSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLIYLTVTG

SEQ ID NO: 8683 - DNA, 1254 bp, Clostridium acetobutylicum ATCC 824
  CDS (1)..(1254): transl_table=11
atgcgtaaaattaatatttttaaaggaaagcataatccacaacgtacagcaatagatttttttaagtatgttggtcctgggcttttagtaactgttggttttatagatcctggaaattgggcatcgaatgtatctgctggatcagactatggatattcgcttttatggatagttactttgtcaactataatgcttataatacttcaacataacgctgctcatcttggaatagttactggtgattgtctttcagaggctgttagcaagaaatttaaaccttggcttacaaatataatactttacagtgctataggagcagcaatatctacagctatggcagaacttcttggaggagcaattgcccttaatatgctctttaggcttcctataaaaattggaactttaattatgttatcgctagttatttggatgcttttttctagctcttataaaaagcttgagaggtggattataggatttgtttcaataataggtttatcatttatatttgagcttttattggtaaaggtaaattggcaagtggcagcagtgagttttgtgtctccaagttttcctaaaaactctatgcctataataatgagtgttttgggagctgttgttatgcctcacaacttatttcttcattcggaaataatacaaagtagacaatggaatgttgaaaaggaagatgttataaaaagacagctcagatacgaatttttggatacaattatatcaatgattgtaggatttgctataaacagtgctatggttttattggcagcatcaactttttttaaaatgcatgttagtgtaagtgaattatctcaagcacaagctttattgaaaccgcttttaggaggttctgcttctgtagtatttgcactggcgcttttattttcaggtatagcttcaacggttacggctggaatggctggaggaagtatttttgctggaatatataaggaaccttatgatatagaagatagtcatactcaaataggtgttattataactatggttttagctgctgtaattatattttttataaaagatccatttaaaggattaatatattcccaaatgattttaagtatacagcttccaataactatatttactcaaatttatcttacatcttctaaaaaagttatgggaaagttctctaattcattattagacagagttttacttggaataatagcagtaatagttacagctttaaatatagctttgttagttagttatttttaa

SEQ ID NO: 8684 - protein, 417 aa, Clostridium acetobutylicum ATCC 824
MRKINIFKGKHNPQRTAIDFFKYVGPGLLVTVGFIDPGNWASNVSAGSDYGYSLLWIVTLSTIMLIILQHNAAHLGIVTGDCLSEAVSKKFKPWLTNIILYSAIGAAISTAMAELLGGAIALNMLFRLPIKIGTLIMLSLVIWMLFSSSYKKLERWIIGFVSIIGLSFIFELLLVKVNWQVAAVSFVSPSFPKNSMPIIMSVLGAVVMPHNLFLHSEIIQSRQWNVEKEDVIKRQLRYEFLDTIISMIVGFAINSAMVLLAASTFFKMHVSVSELSQAQALLKPLLGGSASVVFALALLFSGIASTVTAGMAGGSIFAGIYKEPYDIEDSHTQIGVIITMVLAAVIIFFIKDPFKGLIYSQMILSIQLPITIFTQIYLTSSKKVMGKFSNSLLDRVLLGIIAVIVTALNIALLVSYF

SEQ ID NO: 8685 - DNA, 1371 bp, Agrobacterium tumefaciens str. C58
  CDS (1)..(1371): transl_table=11
atgatttgcaattgcattaattcgatttccatgaaagcacagaagatggacaagccagtctttggatggcgacggaacggcgatgatctctcgctgtctgacgttcacagttcgatccgcatcaaaccggatgccagcacgtttcgccgggcaatggccttttttggccccggctatctcgtcgctgtcggttacatggatcccgggaactgggcgacgtcgctcgccggcggctccaaattcggctacacgctgctggcagtcgcgctggtttccaacatcatggcgattgtgctgcagtcgctctgtgcccgtcttgcgatcgcctccggccgcgatctcgcccaggcctgccgtgatgcctatccgaaacccgttgccatggtgctgtggctgctcgcggaaatcgccatcatcgccaccgacattgccgaggtgatcggcaccgccatcggcctcaacctgatcttcggcattccgctggaacttggcgtcctcatcaccgcgctcgatgtgttcctgatcctctatctgcaaaagctcggttttcgctgggtggaggcactggtcatcacgctgctcggcgtcatcgccgtgtgtttcgccattcagctggcgctggccgatcctgactgggggcaggtgatcctcggttttgcgccgacgacggagattgtcaccaatccggacatgctttatctggcgctcggcattctgggtgcgactgtcatgccgcataatctctatctgcattcgggcatcgtgcagacccgcgaaatcggccccaccattgccgaaaaacgcgaggcgctgaaattcgccacgctcgattccaccatcgcgctgatgttcgctttgctcatcaacgcctcgatcctcattctcgcggcggcgaccttcaacaaaacggggcagactaatgtcgccgaactcggcgaagcgcatagtctgcttgcgccgctgctcggccttgccatagcgccgacgctgttcggcgtggcgcttctgtgctgcggcatcaattccaccgtcacggcaacgctcgccggccagatcgtgatggaaggtttcctcaagatgcggctcgccccatggctgcgccgcctcatcacccgcgccatcgccatcgttcccgccgccggcgtcaccatcttttatggcgacagcggcacgggccagctgctgatcctgacgcaggtggtgctcagcctgcaactttccttcgccgtcttcccgcttgtgatgtttacctccgacaaggccaagatgggtgagttgcgctcgccactctggctctcggccattgcgtggttgatcgcggtggtgattgcggcgctgaatgtgaagttgctgatggattttatggggtga

SEQ ID NO: 8686 - protein, 456 aa, Agrobacterium tumefaciens str. C58
MICNCINSISMKAQKMDKPVFGWRRNGDDLSLSDVHSSIRIKPDASTFRRAMAFFGPGYLVAVGYMDPGNWATSLAGGSKFGYTLLAVALVSNIMAIVLQSLCARLAIASGRDLAQACRDAYPKPVAMVLWLLAEIAIIATDIAEVIGTAIGLNLIFGIPLELGVLITALDVFLILYLQKLGFRWVEALVITLLGVIAVCFAIQLALADPDWGQVILGFAPTTEIVTNPDMLYLALGILGATVMPHNLYLHSGIVQTREIGPTIAEKREALKFATLDSTIALMFALLINASILILAAATFNKTGQTNVAELGEAHSLLAPLLGLAIAPTLFGVALLCCGINSTVTATLAGQIVMEGFLKMRLAPWLRRLITRAIAIVPAAGVTIFYGDSGTGQLLILTQVVLSLQLSFAVFPLVMFTSDKAKMGELRSPLWLSAIAWLIAVVIAALNVKLLMDFMG

SEQ ID NO: 8687 - DNA, 1263 bp, Thermoanaerobacter tengcongensis MB4
  CDS (1)..(1263): transl_table=11
atgattacaaaagtcaaaaatttatttaaaggtgaacatcgccctaaacttatggctttagattttattaaatacataggtcctgggctactggttactgtgggttttattgacccgggaaattgggcttctaatgttgctgcaggttcgtcttacggttataagcttttatggatggtgactttatctactatcatgctcattatactccagcacaatgctgcacatctgggtatagttacaggttattgcatgtctgaagctgcaactaagtttttaaagccttttacttcgaggttagttcttatttcagctgtctttgcggcgattttgacggcgatggcagaaattttaggtgccgcgatagctcttcaaatgctttttaagataccgataaagataggaagtttgattactgttgtttttgtgtcatggatgctttatacaaattcctataaaaagttggaaaagtggattataagttttgtatctcttattggcatttcttttatatttgagctttcgctaattgatgtgaaatgggcagaggtagcttcaagctgggtgaaaccagaatttccagcaggttctatgcctataattatgagtgtgcttggtgctgttgttatgccccacaatttgtttttgcactcggagataatacaaagcaggcagtggaatttagaagatgagaaagtcattgtgaaacagcttaattatgagtattttgacactatcttttctatgataataggttgggggataaacagtgctatgattattgttgcggcatcggctttttttaccaataatgtaaccgtaatggagcttaatcaggcacagcagatgttaaaacctcttttgggaaatgcgtcagcagtggtttttgctttggctcttctttttgcaggaatttcttcctctataacagcaggaatggcaggcggaagtatttttgcggggatatatggagaaccatatgatatacacgatgcacatacaaaagttggcgtaggaattacatatatttttgcagtgctaataatattctttgtaaaaagcccctttcaaggactagtttattcgcagatgtttttaagtgtacagcttccaattacaatctttttgctcatttatttgacttcttcaaaaaagatcatgggtaagtttgcaaatacattgctttataaggtattgttgtggactataggaataatagtgacggttttaaatgcgatgcttcttatgagctttgttgggtga

SEQ ID NO: 8688 - protein, 420 aa, Thermoanaerobacter tengcongensis MB4
MITKVKNLFKGEHRPKLMALDFIKYIGPGLLVTVGFIDPGNWASNVAAGSSYGYKLLWMVTLSTIMLIILQHNAAHLGIVTGYCMSEAATKFLKPFTSRLVLISAVFAAILTAMAEILGAAIALQMLFKIPIKIGSLITVVFVSWMLYTNSYKKLEKWIISFVSLIGISFIFELSLIDVKWAEVASSWVKPEFPAGSMPIIMSVLGAVVMPHNLFLHSEIIQSRQWNLEDEKVIVKQLNYEYFDTIFSMIIGWGINSAMIIVAASAFFTNNVTVMELNQAQQMLKPLLGNASAVVFALALLFAGISSSITAGMAGGSIFAGIYGEPYDIHDAHTKVGVGITYIFAVLIIFFVKSPFQGLVYSQMFLSVQLPITIFLLIYLTSSKKIMGKFANTLLYKVLLWTIGIIVTVLNAMLLMSFVG

SEQ ID NO: 8689 - DNA, 1260 bp, Chlorobium tepidum TLS
  CDS (1)..(1260): transl_table=11
atggcagtttcattttcgaaattgatacaatcccgctggcttcctctcaaaaagcttctgggatttctcggaccgggatttctggtgacggttggattcatcgaccctggcaactgggccaccaatatcgaagggggtgcgcggttcggttacgaactgctctgggtgatcacgctcagcacgctgattctgatcgttatccagcacatggccgcgcggcttggcatcgccacgggcaagtcgctggcggttaacattcgagaccattttcccgcgccggtttcatcgcttcttggctttacgattgttgccgcctgcgttgccaccgacgtggccgagctggttggcggtggcatcggcttcagtctcctttttgggatgccgctctgggccggggcgcttctgaccgtggtgctcgaagtgttcctcgtggtcagccagcgctaccatcgcatcgagaccattatcgtcggctttctcggcatcatcgcgctctgctatctcgctgaactctggatcgtccgaccggcctggcacgaagtgctgcccgccacggtcacgccggtgctgggccgtgagagcatctacgtcgccattgccattcttggtgcagtggtcatgccgcacaacgtgtatctgcactccaacgtcattcacagccggaaatgggggatgaccgatgatgagaaaaaagagctgcttcgctacgaaaaagccgatactctttttgccatgacgcttggctgggtggtcaattcagcgatgatcgttgtcgccgccgccgtgtttcaccagcatggcgtgcgggtcgagagcatcgagcaggcatccgcgacgctcagaccgctggccgggccgctggcggggttgctcttcgccgtggcgcttgtgttcgcgggagtcggttcatcgatcacctcctcgatggccgaggccaacgtcatcaccggctttctcggcaagcccgaagacccggagagcctgctctggcgcgtgtcggtgttcctgaccgccatcccttcctttatcatcattctgttcaaggtcgatacctacaaaatcctgattttcagccaggtggtgctgagccttcaactgcccttcacgcttttgccgctcttggtgctctgccggagcgaaaaggtgatgggggtcttccggagccggggcgtcgaattcgttgcggcggtgctgattaccatggtggtcgttgcgctcaatctctatctgctctctaccacagtgaccggagactcatga

SEQ ID NO: 8690 - protein, 419 aa, Chlorobium tepidum TLS
MAVSFSKLIQSRWLPLKKLLGFLGPGFLVTVGFIDPGNWATNIEGGARFGYELLWVITLSTLILIVIQHMAARLGIATGKSLAVNIRDHFPAPVSSLLGFTIVAACVATDVAELVGGGIGFSLLFGMPLWAGALLTVVLEVFLVVSQRYHRIETIIVGFLGIIALCYLAELWIVRPAWHEVLPATVTPVLGRESIYVAIAILGAVVMPHNVYLHSNVIHSRKWGMTDDEKKELLRYEKADTLFAMTLGWVVNSAMIVVAAAVFHQHGVRVESIEQASATLRPLAGPLAGLLFAVALVFAGVGSSITSSMAEANVITGFLGKPEDPESLLWRVSVFLTAIPSFIIILFKVDTYKILIFSQVVLSLQLPFTLLPLLVLCRSEKVMGVFRSRGVEFVAAVLITMVVVALNLYLLSTTVTGDS

SEQ ID NO: 8691 - DNA, 1569 bp, Streptococcus agalactiae 2603V/R
  CDS (1)..(1569): transl_table=11
atgaatctacaaaaaaatgataaaacaaatagttttatccattatgcaaacggtccttccctagaagaaataaatgggacaattgaagttcctaaagatttgagcttttttaaaactttactagcttattctggaccgggtgcacttgttgctgttggttatatggatcctggaaattggtccacttccataactggcggtcaaaattttcaatatttactaatttcaattatcttaatgtctagtttaattgctatgctacttcaatacatgtcagctaagctaggtattgttactcagatggatcttgctcaagctatccgagcaaggaccagtaaacagttgggaattgtcttatggattctcactgagcttgctataatggcaacagatattgctgaagttattggtggggctattgcactttatttactgtttcatattccacttgcgattgctgttttcattacagtatttgatgtattactcttattattgttgacaaaaataggatttcgaaaaattgaagctctagtagttgctttaatattggttattttcttagtttttgcatatcaagtggctctttctcatcctatatggacggatatttttaaaggtttagtacctacatctgaagctttctcaacctctcatacagtaaatggacaaacaccactttcaggtgccttaggcattattggggcaactgttatgccacataatctttatctacattcttcagttgttcaaagtcgaaaactagatcataataacaaaaaagatatcgctagagcaattaggttttcaacttttgattcaaatattcaattaacagtagccttttttgttaattcactattactcattatgggcgttgctgttttcaaaacaggaagtgttactgatccatcattctttggtctatttaaagcactatctaattctactattatgagtaattctattttagctcatatagcaagttcaggtattttatcacttttatttgcaatagctttattagcatctggacagaattcaactattactggaacattaacaggtcaaattattatggaaggatttattcatatgaaagttccaatttggttccgtcgtatcattactcgcctaatttctgttattcctgtaatgatttgtgtcttagtaactagtggtagaagtactgttgaagaacatatagctattaataacttaatgaataactctcaagtcttcttagcatttgcattaccattctcaatgttacctctactaatatttactaatagtaaagttgaaatggatgatgattttaaaaatacttggataattaagattcttggttggctttcagttataggattaatttatctcaatatgaagggattgccaaatcaaattgaaggtttttggggagataacccaactcatcaacaaattattcttgcgcatcaaatagctcatatcatcattattagtgtaatactaactttaatatggactattgttgaattgtataaaggaaataaaaaatacagtacgatgcaacaaagtgcaacttaa

SEQ ID NO: 8692 - protein, 522 aa, Streptococcus agalactiae 2603V/R
MNLQKNDKTNSFIHYANGPSLEEINGTIEVPKDLSFFKTLLAYSGPGALVAVGYMDPGNWSTSITGGQNFQYLLISIILMSSLIAMLLQYMSAKLGIVTQMDLAQAIRARTSKQLGIVLWILTELAIMATDIAEVIGGAIALYLLFHIPLAIAVFITVFDVLLLLLLTKIGFRKIEALVVALILVIFLVFAYQVALSHPIWTDIFKGLVPTSEAFSTSHTVNGQTPLSGALGIIGATVMPHNLYLHSSVVQSRKLDHNNKKDIARAIRFSTFDSNIQLTVAFFVNSLLLIMGVAVFKTGSVTDPSFFGLFKALSNSTIMSNSILAHIASSGILSLLFAIALLASGQNSTITGTLTGQIIMEGFIHMKVPIWFRRIITRLISVIPVMICVLVTSGRSTVEEHIAINNLMNNSQVFLAFALPFSMLPLLIFTNSKVEMDDDFKNTWIIKILGWLSVIGLIYLNMKGLPNQIEGFWGDNPTHQQIILAHQIAHIIIISVILTLIWTIVELYKGNKKYSTMQQSAT

SEQ ID NO: 8693 - DNA, 1368 bp, Bifidobacterium longum NCC2705
  CDS (1)..(1368): transl_table=11
atggcagtaacacacaccgcagcagatgccactgcggcaaccactatgacgaacgccgtggcagacatcgaacaggaaacaccggaaatcgagaaggaacgccagcttgccggagtcggagccggagctggaaccgtggcaaacggcaagaaaaagccgcatgaccatgcgctggccagcatcctcggccccgcgttcgtggcggccgtggcttacgtcgatcctggcaacgtggcggccaacatcacctccggcgcgcgatacggctacctgttggtgtgggtgctggtgctcgccaacgccatgagcgtgctcatccagtatcagtccgcaaaactcggcatcgtgaccaacaaatccctgccggaactgctgggtgaacgtatgagcgatgccggccgcttcatgttcttcatgcaggccgaggtcatcgccattgccaccgatctggccgaggtgatcggcggcgccatcgccctgaacctgctgttcggattgccgctgttcatcggcggtttggtgatcggcgcaatctccacggtgatgctgtggttccaaggtggcaagacgcaaacaacgttcgagcgcatcatcatcgtgatgctgctgattatcacattcggcttcatcgcaggcctgttcgtggacccgccgagccccggcgaagtggtcaagggcatgattccacgcttccaaggcaccgactcggtgttgatggccgcctcgattctgggcgccaccgtgatgccgcacgccatctacctgcactccacgttggtcaacgaccattacgcaggcggcgaaaagccgtcgatcaaaacgcagctgaaaggctcgaaaatcgatgtggtctgggcgctgttgctggccggcaccgtgaatctggcgatgctggtgctcgccgccaactcgctgcatggcatgtctggcacggactccatcgacggcgcacagcgggcgatcacgcaggtgctcggcccggtgatcggcacgatcttctccatcggcctgctggcttcgtcgctgagctccacatcggttggcacgtacgccggctcggaaatcatgcacggtctgctgcacgtcaacgccccgatgtgggcctgccgcgtggtcacgctggtgccggcactgattgtgctgtggttcgccaaggacccgactcaggcgctggtcatcggccaggtggtgctttccatcggcatcccgttcgccgtgattccgctgatgcgatacacgcatgacaaggaactcatgggcaagtgggctgatggaaccgtcaagcacgtgattttcatgatcgtcgtggcgctgattgtggcgctcaacgtgctgctgattgtcctgacgctgatgggcagggcgtaa

SEQ ID NO: 8694 - protein, 455 aa, Bifidobacterium longum NCC2705
MAVTHTAADATAATTMTNAVADIEQETPEIEKERQLAGVGAGAGTVANGKKKPHDHALASILGPAFVAAVAYVDPGNVAANITSGARYGYLLVWVLVLANAMSVLIQYQSAKLGIVTNKSLPELLGERMSDAGRFMFFMQAEVIAIATDLAEVIGGAIALNLLFGLPLFIGGLVIGAISTVMLWFQGGKTQTTFERIIIVMLLIITFGFIAGLFVDPPSPGEVVKGMIPRFQGTDSVLMAASILGATVMPHAIYLHSTLVNDHYAGGEKPSIKTQLKGSKIDVVWALLLAGTVNLAMLVLAANSLHGMSGTDSIDGAQRAITQVLGPVIGTIFSIGLLASSLSSTSVGTYAGSEIMHGLLHVNAPMWACRVVTLVPALIVLWFAKDPTQALVIGQVVLSIGIPFAVIPLMRYTHDKELMGKWADGTVKHVIFMIVVALIVALNVLLIVLTLMGRA

SEQ ID NO: 8695 - DNA, 1239 bp, Shigella flexneri 2a str. 301
  CDS (1)..(1239): transl_table=11
atgacgaactatcgcgttgagagtagcagcggacgggcggcgcgtaagatgaggctcgcattaatgggacctgcgttcattgcggcgattggttatatcgatcccggtaactatgcgaccaatattcaggcgggtgctagcttcggctatcagctactgtgggttgtcgtttgggccaacctgatggcgatgctgattcagatcctctctgccaaactagggattgccaccggtaaaaatctggcggagcagattcgtgatcactatccgcgtcccgtagtgtggttctattgggttcaggcagaaattattgcgatggcaaccgacctggcggaatttattggtgcggcgatcggttttaaactcattcttggtgtttcgttgttgcagggcgcggtgctgacggggatcgcgactttcctgattttaatgctgcaacgtcgcgggcaaaaaccgctggagaaagtgattggcgggttactgttgtttgttgccgcggcttacattgtcgagttgattttctcccagcctaacctggcgcagctgggtaaaggaatggtgatcccgagtttacctacttcggaggcggtcttcctggcagcaggcgtgttaggggcgacgattatgccgcatgtgatttatttgcactcttcgctcactcagcatttacatggcggttcgcgtcaacaacgttattccgccaccaaatgggatgtggctatcgccatgacgattgccggttttgtcaatctggtgatgatggctacagctgcggcggcgttccacttttctggtcatactggtgttgccgatcttgatgaggcttatctgacgctgcaaccgctgttaagccatgctgcggcaacggtctttgggttaagtctggttgctgccggactgtcctcaacggtggtggggacactggcggggcaggtggtgatgcagggattcattcgcttccatatcccgctgtgggtgcgtcgtacagtcaccatgttgccgtcatttattgtcattctgatgggattagatccgacacggattctggttatgagtcaggtgctgttaagttttggtatcgccctggcgctggttccactgctgattttcaccagtgacagcaagttgatgggcgatctggtgaacagcaaacgcgtaaaacagacaggctgggtgattgtagtgctggtcgtggcgctgaatatctggttgttggtggggacggcgctgggattgtag

SEQ ID NO: 8696 - protein, 412 aa, Shigella flexneri 2a str. 301
MTNYRVESSSGRAARKMRLALMGPAFIAAIGYIDPGNYATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLVMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 8697 - DNA, 1341 bp, Streptococcus mutans UA159
  CDS (1)..(1341): transl_table=11
atgaaaactcatccaaaaaagcaatcactcagcgaggtcaatcagagcgttcgtgttcctaaaaatgcctcttttttaacaactttaagagcttttttaggacccggagcactagttgccgttggttatatggatccgggaaattggattaccagcgttgttggcggagcaagttataaatacttgctgttatcagttgttttgctgtcttcacttattgccatgcagctacagcaaatggctggtaaactgggcattgtctcgcgacaagatttagcgcaggcaaccgcctcccatcttcctaagagattgcgttatcttttgtttattgttattgaattggctcttatggcaacagatttagccgaagttattggctcagggattgccttacacctcctgtttggttggcctttgcttttttcgatctttattaccattttagatgttttcttacttctatctattatgaaacttggatttagaaaaattgaggccatcgtttcaacccttattttaaccattctagttatttttgtttacttagttgttatttctcacccgagtttttcaggtattattaagggttatattcctcagtttgctatttttgattcagcacaagcagctactaacagtaggttgaccttagcacttggtatcattggcgcaactgtaatgcctcacaatttatacctgcactcatctatctctcagacacgtcaagttgattataagcaaaaatcttctattgctcaggccgttaaattcatgacttgggattccaatcttcaattaagtctcgcctttattgttaattctctgcttttaattcttggagcctcgcttttttatggacatgccagtgaaatcagtgccttttcacaaatgtataatgctttagccaataatcacattgctggagcagttgccagttcttttctttcaactctttttgccatcgctcttttagctagtggacaaaattcaaccattactggtacattaactggacaaattgttatggaagggttcttacatctcaaaatgcctcaatggctcattcgcttagtaacacgtctcttggccttattacctgttttgatagcagctattctttatggcagtcaggaaaagattttggatcagctgatcgtctattcacaggttttcctgtcagttgctttgccattttctatctttccactggtttattttacatcacaaaagaaaatcatgggagaatttgttaatgctaagtggaatacttatctagcttatggagttgccactgtattaacaatcctcaacttgcaattaatcatcaataccattttttaa

SEQ ID NO: 8698 - protein, 446 aa, Streptococcus mutans UA159
MKTHPKKQSLSEVNQSVRVPKNASFLTTLRAFLGPGALVAVGYMDPGNWITSVVGGASYKYLLLSVVLLSSLIAMQLQQMAGKLGIVSRQDLAQATASHLPKRLRYLLFIVIELALMATDLAEVIGSGIALHLLFGWPLLFSIFITILDVFLLLSIMKLGFRKIEAIVSTLILTILVIFVYLVVISHPSFSGIIKGYIPQFAIFDSAQAATNSRLTLALGIIGATVMPHNLYLHSSISQTRQVDYKQKSSIAQAVKFMTWDSNLQLSLAFIVNSLLLILGASLFYGHASEISAFSQMYNALANNHIAGAVASSFLSTLFAIALLASGQNSTITGTLTGQIVMEGFLHLKMPQWLIRLVTRLLALLPVLIAAILYGSQEKILDQLIVYSQVFLSVALPFSIFPLVYFTSQKKIMGEFVNAKWNTYLAYGVATVLTILNLQLIINTIF

SEQ ID NO: 8699 - DNA, 1341 bp, Streptococcus agalactiae NEM316
  CDS (1)..(1341): transl_table=11
atgaatcaaaatcattccgtcaaaagatccttatccgaagttaatcagagcgttgaggttcctcacaatagctctttttggaacactttaagagcttttcttggacctggagctttggttgcagttggttatatggatccaggtaactggattactagcgttattggtggagctacctatcgttacttactattgtttgttgttttagtatcttctttgatggcgatgcaattacaacaaatggctggcaagcttggcattgttacacgacaggacttagcacaagcaacagcttctcgactcccaaaaccgcttcgttacctgctatttattatcattgagttagcccttatcgctactgatttagcagaagtcattggctctgccattgctcttcacttattatttggctggcccctgttactgtctatcatgattactattttggatgtattcttacttttactcttaatgaagttaggcgtccaaaaaattgaagcctttgtttctgttctcatattgacaattttgataatctttacatatttagttgttttatcacaacctgatttagatgctatgttcaaaggatttttaccacaccatgagctttttaacatatcacatgaagggaaaaatagtcctttaaccctcgctcttggcattatcggcgcaacagtcatgccacataatctttatttacattcttctttatctcagactagacgcgtggattatcataataaatcttcaataaaaaaagctgtacgtttcatgaccttagattctaacattcagctatcacttgcatttgtcgtgaattcgctactattagtcttaggagctagtctattttatgggcatgctaatgatatcagtgccttttctcaaatgtatcttgccctatctgataaaactattactggtgcagtagccagttctttcctttctaccctttttgcagttgccctactagcaagtggtcaaaattcaacgattacaggtactttaacaggacaaatcgttatggaaggtttccttcacttcaaattacctcaatggttaataaggctttgtactagattattaactcttcttccaatttttgttatcgccctactagttggaggcgaagaaaatacgttagatcaactaatcgtctattcacaagtttttctttccttagctttaccattttcaatctttccattgatttatttcacgtcgcaaaaatcaattatgggagagcatgctaatgctaaatggaatacctatttagcataccttgtcgccatcattttaacattactcaatttgaaattaatcatggatttactttaa

SEQ ID NO: 8700 - protein, 446 aa, Streptococcus agalactiae NEM316
MNQNHSVKRSLSEVNQSVEVPHNSSFWNTLRAFLGPGALVAVGYMDPGNWITSVIGGATYRYLLLFVVLVSSLMAMQLQQMAGKLGIVTRQDLAQATASRLPKPLRYLLFIIIELALIATDLAEVIGSAIALHLLFGWPLLLSIMITILDVFLLLLLMKLGVQKIEAFVSVLILTILIIFTYLVVLSQPDLDAMFKGFLPHHELFNISHEGKNSPLTLALGIIGATVMPHNLYLHSSLSQTRRVDYHNKSSIKKAVRFMTLDSNIQLSLAFVVNSLLLVLGASLFYGHANDISAFSQMYLALSDKTITGAVASSFLSTLFAVALLASGQNSTITGTLTGQIVMEGFLHFKLPQWLIRLCTRLLTLLPIFVIALLVGGEENTLDQLIVYSQVFLSLALPFSIFPLIYFTSQKSIMGEHANAKWNTYLAYLVAIILTLLNLKLIMDLL

SEQ ID NO: 8701 - DNA, 1326 bp, Lactobacillus plantarum WCFS1
  CDS (1)..(1326): transl_table=11
atgcaatcacatcgtcatcaaagtcttgaagaaatcaatcagagcgtcgcggttcccgacgttcatcagacggccttttggcgcaaatttttagcctatagtggtcccggtgcactagtggcagtcggctatatggatcccggcaactggttgacatccctagccggtggcggtcagtttcagtaccggcttttagccgtgctcgcattagccatcattgtcgccatgttcatgcaaggcctggcaatcaggctaggcgttgtagcccggcaagacttagcacaagccatcgctagcaagctgccccggcccgtgcgttacgccgcgtggattttaaacgaagtcgcgatgatggcgactgatatgacgggcgtaattggaaccgcaatcgccttaaaaatgttattcggcttaccactacttgcaggaattttactgacgattgcggacgtcttagttgtcttgttgtttttgagatttggcattcggcgtgtcgaagtaatcgtcctcgtcgctattttgaccgtcggcattatttttggtatcgaggtgggacgggcccacgttcaatttggcaacgtgttgctcggcttagttccaacaccattgatcgtcaaaaatcataccgcactagtcctcagtctcggaatcttgggcgcaaccatcatgccacataacttatacttacactcatcgcttgcacaaagccggcgttatgattatcataatccagcccaagtcacagaagcactgcgcttcgccaattgggactcaacagtgcacttgattgcggcttttctcatcaacgcacttttgctcgtccttggtgggacgcttttcttcggtcacaccaacgcgttagcgagtctgcaggccgtcttcgatgggttaaaaagtaccaccgtggttggcgcccttgctagcccggtcatgagctggttatttgcattagccctactaattaccggcctaatttcatccatcactagcaccttagctggtcagatcgtcatggaaggttatttacacatccgcttaccgctatggcaacgccggctgcttactcgcgctgtcacgctaattccgattctgattatcggtatgttagtcggctttagtgacgctgcctttgaaaacttgatcatttacgcgcaagtggcactcagcatcgccctcccctttaccttgttgccactagttgcgctgacaaatgacgccagcctgatgaaggcccacgttaatcgcccggcggtaacgtgggtgggatatggactggccggaattattacggtgttgaatatttatttggtgtatagcttgttttga

SEQ ID NO: 8702 - protein, 441 aa, Lactobacillus plantarum WCFS1
MQSHRHQSLEEINQSVAVPDVHQTAFWRKFLAYSGPGALVAVGYMDPGNWLTSLAGGGQFQYRLLAVLALAIIVAMFMQGLAIRLGVVARQDLAQAIASKLPRPVRYAAWILNEVAMMATDMTGVIGTAIALKMLFGLPLLAGILLTIADVLVVLLFLRFGIRRVEVIVLVAILTVGIIFGIEVGRAHVQFGNVLLGLVPTPLIVKNHTALVLSLGILGATIMPHNLYLHSSLAQSRRYDYHNPAQVTEALRFANWDSTVHLIAAFLINALLLVLGGTLFFGHTNALASLQAVFDGLKSTTVVGALASPVMSWLFALALLITGLISSITSTLAGQIVMEGYLHIRLPLWQRRLLTRAVTLIPILIIGMLVGFSDAAFENLIIYAQVALSIALPFTLLPLVALTNDASLMKAHVNRPAVTWVGYGLAGIITVLNIYLVYSLF

SEQ ID NO: 8703 - DNA, 1593 bp, Lactobacillus plantarum WCFS1
  CDS (1)..(1593): transl_table=11
ttgagcgaaaagacgaacaccccaaaccggaagcataaattgattgaatatgctaacggcccctcactagaggaaattaacggtaccatcgaggttcccaagaatctgaacttctggaaaaccctctttgcgtattcaggtcctggtgccttagttgcggtaggttacatggatcccggtaactggtcaacttccatcaccggtggtcaaaactaccaatacatgctaatgtctgtcatcttgatatcaagtttgattgcgatgctactacaatacatggcggctaaacttggtatcgtgagtcagatggatctggcccaagcgattcgggcgcggacgagtaaatcactcggaatcgtcttgtggattttaaccgaattagccatcatggcgaccgacattgccgaagttatcggtgctgcgattgccctctatttattattcaacattccgttagtcattgcggtgtttattaccgtgcttgacgttttagttttgctattattgaccaaaatcggttttcggaaaatcgaagccatcgtggtttgtttgattttagttatcttattcgtattcgtttatcaagtcgcactgtccaaccctgattggggcggtgtgatcaagggcctagtcccaaccgctgacactttctcgacaagtcgttcagtaaacggtatgacgccactttctggtgctttagggattatcggtgccaccgtcatgccacacaatttgtacttacattcagccatctcacaaacgcggaagattgaccacaacgatgaggaagatgtcgcgcggaccgttaaattcgctgcttgggattccaatatccaactttcattcgctttcgtggttaattcactattattgattatgggcgttgccgtctttaagagtggcgctgttaaagatccttcattcttcggtctttatgaagcattatccaatacatcaatgttaagcaatggtattttaatcagtgttgctaaatctggggcgctctcagccctcttcgccatcgcgttactggcttctgggcaaaactccacaattaccggtacgttaactgggcaagtcatcatggaagggttcgtccacatgcggatgccactctggttacggcggttagtgacccggttgatctccgttattcccgtcctcatttgcgtgctattaactagtggtaagagtgcaatcgacgagcatactgcattgaataatctgatgaataactcacaagtctttctggctttcgcccttccattctccatgttgccactattaatgatgactgacagcgcggcagaaatgggcaaacgattcaaaaactcactttggatcaaaggtttaggttggttatccgtcatcggtttgactttcttaaacttactcggtctaccagattcaatcttaggcttctttggcgataatccttcagctggcgaacagactttttctaaaattctagcctaccttttgattgccgctatcttagccctacttgtctggaccgtcttcgacctacaacgcggtaacaaacgttacgttgaacagcaacttgctgcagcagcaaaggaggccaacaaataa

SEQ ID NO: 8704 - protein, 530 aa, Lactobacillus plantarum WCFS1
MSEKTNTPNRKHKLIEYANGPSLEEINGTIEVPKNLNFWKTLFAYSGPGALVAVGYMDPGNWSTSITGGQNYQYMLMSVILISSLIAMLLQYMAAKLGIVSQMDLAQAIRARTSKSLGIVLWILTELAIMATDIAEVIGAAIALYLLFNIPLVIAVFITVLDVLVLLLLTKIGFRKIEAIVVCLILVILFVFVYQVALSNPDWGGVIKGLVPTADTFSTSRSVNGMTPLSGALGIIGATVMPHNLYLHSAISQTRKIDHNDEEDVARTVKFAAWDSNIQLSFAFVVNSLLLIMGVAVFKSGAVKDPSFFGLYEALSNTSMLSNGILISVAKSGALSALFAIALLASGQNSTITGTLTGQVIMEGFVHMRMPLWLRRLVTRLISVIPVLICVLLTSGKSAIDEHTALNNLMNNSQVFLAFALPFSMLPLLMMTDSAAEMGKRFKNSLWIKGLGWLSVIGLTFLNLLGLPDSILGFFGDNPSAGEQTFSKILAYLLIAAILALLVWTVFDLQRGNKRYVEQQLAAAAKEANK

SEQ ID NO: 8705 - DNA, 1233 bp, Pseudomonas syringae pv. tomato str. DC3000
  CDS (1)..(1233): transl_table=11
ttgctgcgcaaaatgatgttgttcgtcggccccggcctgctggtgtcgatcggctacatggacccgggtaactgggcgacggccattgaagccggctcgcgtttcggctactcgttgctgttcgtggtggtgctggccagcctgtcaggcatggtcttgcaaaacctctgctcgcgtctgggcatcgccaccgggcgcgatctggcgcagttgtctgcggctcgctatagccgcaacgtcgccaagggccagtggttgctggcggaactgtcgatcatcgccaccgatctggccgaagtgctgggcgcggcgttggcgtttcatctgctgctgggggtttccatcaccacaggcgtggcgctgactgccttcgacacgctgatcgtgctggccctgcagggcgccaatttccgccgtctggaagccatcgtactcgggctgatcgtgactatcgccagttgctttgccgtcgaactgatcctcatcaagccgttctggccggatgtggtcgccggtttgcgaccgagctgggatgtacttagcagccaggagccgttgtacatcgccatcggcattttgggtgccactgtcatgccgcataacctttacctgcattcttcggtggtgcagacgcgggtcaacggcatggatgtcgccagcaaggccagcgccattcgttatgcgcgcctggacaccatcggttcgctgagcctggcgctactcattaacgcagcgattctgatcctcgccgccgcagcgtttcacaagaccggccacactgacgtggtagagattcaggacgcctatcacctgctcgacccgctggtcggcggtgcgatcgccagcgtgttgtttggtgtggctttgctggcggctgggcagagctcgacattttccggcaccatcgccgggcaggtggtgctcgagggctttttgcaggcgaaaattccctgctggcagcggcgcttcattactcgagcgctggcgctgatcccggcgttgatcggggtgatctggctgggcgacagttcagtgggcaagatgctggtgctcagtcaggtggtgttgagcctgcaactgccgtttgcgctctggccgctgatccgctttaccagcgatccgcagttgatggggccgttcgtcaacagccggctggtcaagacggccgcctggtgtctgttcggcctgatctcggctgccaacctgacgctgttgtggttctgggtgagctga

SEQ ID NO: 8706 - protein, 410 aa, Pseudomonas syringae pv. tomato str. DC3000
MLRKMMLFVGPGLLVSIGYMDPGNWATAIEAGSRFGYSLLFVVVLASLSGMVLQNLCSRLGIATGRDLAQLSAARYSRNVAKGQWLLAELSIIATDLAEVLGAALAFHLLLGVSITTGVALTAFDTLIVLALQGANFRRLEAIVLGLIVTIASCFAVELILIKPFWPDVVAGLRPSWDVLSSQEPLYIAIGILGATVMPHNLYLHSSVVQTRVNGMDVASKASAIRYARLDTIGSLSLALLINAAILILAAAAFHKTGHTDVVEIQDAYHLLDPLVGGAIASVLFGVALLAAGQSSTFSGTIAGQVVLEGFLQAKIPCWQRRFITRALALIPALIGVIWLGDSSVGKMLVLSQVVLSLQLPFALWPLIRFTSDPQLMGPFVNSRLVKTAAWCLFGLISAANLTLLWFWVS

SEQ ID NO: 8707 - DNA, 1257 bp, Bacteroides thetaiotaomicron VPI-5482
  CDS (1)..(1257): transl_table=11
atgatgaagaatatttttcaagacttgaaacggaaagatcataaacgttatctgggcggactggatgtttttaaatatattggtcccggacttttggtaactgtcggatttattgatccgggcaactgggcatcaaattttgccgcaggttccgagttcggctattcacttctttgggtggtcaccttatccactatcatgttgattgtcctccagcataatgttgctcacttggggattgttacggggctttgcctttcggaagccgctacgaaatatactcctaaatgggtatcccgtcctattttgggtacggcggtattggcgtctatttctacttcattggctgagattctgggaggagccatcgcattggagatgctgtttgatatgcctattatgtggggggcggtgctgaccacactttttgtctccatcatgctctttaccaactcctataaaaagatagaacgttccattattgcttttgtctcggtgatcggtctttcatttatttatgaattgtttctggtagaaatagactggccggctgcgacgatgggttgggtgacgcctgctttcccgaagggtagtatgctgattattatgagtgtgctgggagcggttgtgatgcctcataatctgtttctgcattcggaagtaatacagagtcacgagtataataagaaagacgatgcgtctatcaagaaagtattgaaatacgagttgttcgatacgcttttctcgatgatcgttggctgggcaattaacagtgctatgattctgctggctgctgctactttctttaaaagcggcattcaggtggaagaattgcaacaagccaaatcactgcttgaacctttgttgggaagtaatgcggcaatcgtattcgcattggctctgttgatggcaggtatttcgtccactataacaagcggaatggcggcaggttctatctttgcaggtatctttggagagtcatatcatattaaagacagtcactcgcaggtaggagtaatcctttcgttgggaattgcgctgttgctgattttctttattggcgatccattcaagggattactgatttcgcagatgatattgagtattcagttgcctttcacggtattcctgcaagtagggctgacttcatcccgaaaggtaatggggaattatgtcaatagccgttggagtacttttgtattatatgctattgcagtcattgtttcggtattgaatataatgctgctgttttcataa

SEQ ID NO: 8708 - protein, 418 aa, Bacteroides thetaiotaomicron VPI-5482
MMKNIFQDLKRKDHKRYLGGLDVFKYIGPGLLVTVGFIDPGNWASNFAAGSEFGYSLLWVVTLSTIMLIVLQHNVAHLGIVTGLCLSEAATKYTPKWVSRPILGTAVLASISTSLAEILGGAIALEMLFDMPIMWGAVLTTLFVSIMLFTNSYKKIERSIIAFVSVIGLSFIYELFLVEIDWPAATMGWVTPAFPKGSMLIIMSVLGAVVMPHNLFLHSEVIQSHEYNKKDDASIKKVLKYELFDTLFSMIVGWAINSAMILLAAATFFKSGIQVEELQQAKSLLEPLLGSNAAIVFALALLMAGISSTITSGMAAGSIFAGIFGESYHIKDSHSQVGVILSLGIALLLIFFIGDPFKGLLISQMILSIQLPFTVFLQVGLTSSRKVMGNYVNSRWSTFVLYAIAVIVSVLNIMLLFS

SEQ ID NO: 8709 - DNA, 1599 bp, Enterococcus faecalis V583
  CDS (1)..(1599): transl_table=11
ttgaaaaattcagaagaacatgaaccaaagcaaagacatcatttgattgaatatgcaaatggtccttcgcttgaagaaattaatggcaccatcgacgtgcctaaaaatatgagtttttggaaaacgttatttgcttactcaggtccaggagcattggtagcagtggggtatatggatccaggaaactggtctacttcaattactgggggacaaaattttcaatatttattgatgtcgattattttaatttccagtttgattgcaatgttgctccaatatatggctgctaaattaggcattgtttcacagatggatttagcacaagcgattcgtgctagaactagtaagacgttaggtattgtattatggattttaacagagttagcaattatggctacagatatcgctgaagttatcgggggcgcaattgccttatatttattatttcatattcctttaggtctggctgtcttcattacggtatttgatgttttacttttgttgttattgacaaaaattggttttagaaaaattgaagctattgttgttgctttaattgttgttatttttgtgatttttgcttatcaagtggcattgtcaaatccagtatggggagatgtaattaaagggctggttcctagcgcagaagctttttctacatcacatgcggtgaatgggcaaacgccactgacaggtgcattggggattattggtgcaacagtgatgcctcataatttgtatttacattcttctgttgtgcaaagtcgtaaaattgatcgtaaagataaaaccgatattcaacgcgctttacgcttttcaacttgggattctaatattcaattaacgatggcattttttgttaactctttattattgattatgggtgtggccgtttttaaatccggcagtgtcaaagatccttcattctttggtttgtttgatgctttatcaaatccagcggttatgagtaattctattttagcgcatattgcaggttctggaattttatcaattttatttgcggtagccttattggcatcaggacaaaattcaacaattacaggaacgttaactggtcaaatcattatggaagggtttattcatatgcgcgtaccaatttggttacgtcggatggtcacacgtttgttatctgttattcctgtcttaatctgtgttttaatgaccagcggaaaaagtacagtggaggagcatattgcgattaataatttaatgaacaattcacaagtttttctagcatttgctttgccattttcgatgttgcctttactgatgtttacagatagccgtgttgaaatgggtgaacattttaaaaactcgtggttaattaaattgttaggctgggtttctgtcattggcttaatttacctcaatatgaaaggtttacctgatcaaattgaaggattcttcggtgataatccgacagcgagtcaaattacgttagccgataatattgcctatgtcatcatagcactcgtcatcctcttgttagtttggacggttgtggaattatataaaggcgataaacgatatgcacagcagcttgcagctatggagcaacaagtagaggaggttaaataa

SEQ ID NO: 8710 - protein, 532 aa, Enterococcus faecalis V583
MKNSEEHEPKQRHHLIEYANGPSLEEINGTIDVPKNMSFWKTLFAYSGPGALVAVGYMDPGNWSTSITGGQNFQYLLMSIILISSLIAMLLQYMAAKLGIVSQMDLAQAIRARTSKTLGIVLWILTELAIMATDIAEVIGGAIALYLLFHIPLGLAVFITVFDVLLLLLLTKIGFRKIEAIVVALIVVIFVIFAYQVALSNPVWGDVIKGLVPSAEAFSTSHAVNGQTPLTGALGIIGATVMPHNLYLHSSVVQSRKIDRKDKTDIQRALRFSTWDSNIQLTMAFFVNSLLLIMGVAVFKSGSVKDPSFFGLFDALSNPAVMSNSILAHIAGSGILSILFAVALLASGQNSTITGTLTGQIIMEGFIHMRVPIWLRRMVTRLLSVIPVLICVLMTSGKSTVEEHIAINNLMNNSQVFLAFALPFSMLPLLMFTDSRVEMGEHFKNSWLIKLLGWVSVIGLIYLNMKGLPDQIEGFFGDNPTASQITLADNIAYVIIALVILLLVWTVVELYKGDKRYAQQLAAMEQQVEEVK

SEQ ID NO: 8711 - DNA, 1362 bp, Enterococcus faecalis V583
  CDS (1)..(1362): transl_table=11
atgaaagaaaagaaaacggaaaaaatgcttaattatgcaaatggacctagtttagaagagataaataataccgtcgaggtacctaaaaacgcaagcttttggcgaactttgttagcctatagcggacctggcgctttagtggctgttggttatatggatccaggaaattggattacgtcaattgctggcggagcggaatataagtacacgttacttagtgtgattttgctttctagtttagttgccatgttactacaaagtatggctgcgcgcttaggaatcgtgacaggaatggatttagctcaagcgactagagagcatacaagtaaacgaacgggcgttgccttgtgggtggtgacggagttagccataatggctacagatatcgctgaggtaattggtggtgccgttgctttgcaattattatttggttttccattattaattggtgtgttgataacaacgtttgatgttttattactgttgctactgacaaagttaggctttcgcaaaatcgaagcaattgtttcttgtttaattgcagtcatcttttttgtttttgcttatgaagtggcattagcagatccaaatgttggtgaagtattacgaggttttattccagacacaaaaatagcgacagataaatccatgttatttttagccttggggatcgttggagcgacagtcatgccccataacttatatttgcattcttccattgcgcaagcacggaaatttgatcgtaacgatgatgttgagaaagccaaagcaattcgtttcactacttgggattcaaatattcaattaactgttgctttcgtcgtaaattgtttgttgttaattttaggaggagcattattttatggaaccaacagtgaattaggtaaatttgttgatttatttgatgctctgaaaaatccagatattgttggtaatattgctagcccagtgttaagtattctttttgcaattgctttactggcttcgggtcaaaattcaacgattacaggtacgctgtcaggacaaattgtaatggaaggctttatccatttaaaaatgccgttgtgggcacgacgagtgttaactcgtttgttagcaattgtgccagtcattatctgtgtcattatttatggcggtagcgaaacggctgttgaagacttgttactttatacgcaagttttcctaagtattgctttgccagtgtcgattattcctttaacgatgtatacaagtgataaaaaattaatgggccaatttgcgaatccagcgtgggtgaaatttttagcttggattattgctattgccttgacgttattgaatttatttttaatttatggcacattaactggtttaacgaattaa

SEQ ID NO: 8712 - protein, 453 aa, Enterococcus faecalis V583
MKEKKTEKMLNYANGPSLEEINNTVEVPKNASFWRTLLAYSGPGALVAVGYMDPGNWITSIAGGAEYKYTLLSVILLSSLVAMLLQSMAARLGIVTGMDLAQATREHTSKRTGVALWVVTELAIMATDIAEVIGGAVALQLLFGFPLLIGVLITTFDVLLLLLLTKLGFRKIEAIVSCLIAVIFFVFAYEVALADPNVGEVLRGFIPDTKIATDKSMLFLALGIVGATVMPHNLYLHSSIAQARKFDRNDDVEKAKAIRFTTWDSNIQLTVAFVVNCLLLILGGALFYGTNSELGKFVDLFDALKNPDIVGNIASPVLSILFAIALLASGQNSTITGTLSGQIVMEGFIHLKMPLWARRVLTRLLAIVPVIICVIIYGGSETAVEDLLLYTQVFLSIALPVSIIPLTMYTSDKKLMGQFANPAWVKFLAWIIAIALTLLNLFLIYGTLTGLTN

SEQ ID NO: 8713 - DNA, 1296 bp, Bacillus cereus ATCC 14579
  CDS (1)..(1296): transl_table=11
atgaataaagatataacaaaagatgaacatctcccttctgaaagtacaaccgtacaatcagctcacttagctttaagtggagaaacaaaaggctggaaaagactgttaccatttttaggacccgcttttatcgcgtccgttgcttatattgatcctggcaactttgctacaaatatcgcagctggttcacaatatggatatttactattatgggttatactcgcctctaacttaatggctgtattaatccaaactttatcagctaaattaggaattgctacaggaaacaatttacccgaaatagctcgtgaaaactttccaaagcctgtgtctatcggtttatggatacaaggtgaactagttattatggctacagatttagcggaatttattggagctgcattggggctttacttactatttggaatcccgatgctacctgccgctttaattacagcagccggatcatttattatccttgaatttcaacgtagaggatttcgtccactagaagctattattacaggaatgattttcattgtagtaattgcttttgggattcaagttttttatgcaaaaccagaattaagtccccttctttcaggactatttattccaaaattccaaggtgtagacagtatattacttgcagcagggattttaggtgcgacagttatgccgcatgcaatatacttgcattctgcattaacacaacgccgtgtggtcggaacaactgacgaacaaaagaaaaagatttttcgtttcgaatttatcgatattattattgcaatggttattgctggagcaattaatgcaagtatgttaattgttgctgctgcactattctttaaaaacggcttgcacgttgaagatttagatgttgcttacactcaatttaccaacttagtaggtcctgtatcagctgctttgtttggaattgggctcttatcagcaggactatctagctcttctgtcggtacaatgtcgggtgatattattatgcaaggtttcattcgcatgcatattccgttatacttacgccgatttattacaatgattccaccattagttattatcgctttaggtgtaaatccaacttacgctctagtcatgagccaagtcgtcttatcattcggtattgcatttgcactagtgccacttattatgtttacaagtaacaaaaagattatgggtgcactcgttaaccaccgtataacaacatttatcgcttggataattgcagcactcgttatcgttttaaatatcttcttactgtatcaaacatttgtagggtaa

SEQ ID NO: 8714 - protein, 431 aa, Bacillus cereus ATCC 14579
MNKDITKDEHLPSESTTVQSAHLALSGETKGWKRLLPFLGPAFIASVAYIDPGNFATNIAAGSQYGYLLLWVILASNLMAVLIQTLSAKLGIATGNNLPEIARENFPKPVSIGLWIQGELVIMATDLAEFIGAALGLYLLFGIPMLPAALITAAGSFIILEFQRRGFRPLEAIITGMIFIVVIAFGIQVFYAKPELSPLLSGLFIPKFQGVDSILLAAGILGATVMPHAIYLHSALTQRRVVGTTDEQKKKIFRFEFIDIIIAMVIAGAINASMLIVAAALFFKNGLHVEDLDVAYTQFTNLVGPVSAALFGIGLLSAGLSSSSVGTMSGDIIMQGFIRMHIPLYLRRFITMIPPLVIIALGVNPTYALVMSQVVLSFGIAFALVPLIMFTSNKKIMGALVNHRITTFIAWIIAALVIVLNIFLLYQTFVG

SEQ ID NO: 8715 - DNA, 1239 bp, Shigella flexneri 2a str. 2457T
  CDS (1)..(1239): transl_table=11
atgacgaactatcgcgttgagagtagcagcggacgggcggcgcgtaagatgaggctcgcattaatgggacctgcgttcattgcggcgattggttatatcgatcccggtaactttgcgaccaatattcaggcgggtgctagcttcggctatcagctactgtgggttgtcgtttgggccaacctgatggcgatgctgattcagatcctctctgccaaactagggattgccaccggtaaaaatctggcggagcagattcgtgatcactatccgcgtcccgtagtgtggttctattgggttcaggcagaaattattgcgatggcaaccgacctggcggaatttattggtgcggcgatcggttttaaactcattcttggtgtttcgttgttgcagggcgcggtgctgacggggatcgcgactttcctgattttaatgctgcaacgtcgcgggcaaaaaccgctggagaaagtgattggcgggttactgttgtttgttgccgcggcttacattgtcgagttgattttctcccagcctaacctggcgcagctgggtaaaggaatggtgatcccgagtttacctacttcggaggcggtcttcctggcagcaggcgtgttaggggcgacgattatgccgcatgtgatttatttgcactcttcgctcactcagcatttacatggcggttcgcgtcaacaacgttattccgccaccaaatgggatgtggctatcgccatgacgattgccggttttgtcaatctggtgatgatggctacagctgcggcggcgttccacttttctggtcatactggtgttgccgatcttgatgaggcttatctgacgctgcaaccgctgttaagccatgctgcggcaacggtctttgggttaagtctggttgctgccggactgtcctcaacggtggtggggacactggcggggcaggtggtgatgcagggattcattcgcttccatatcccgctgtgggtgcgtcgtacagtcaccatgttgccgtcatttattgtcattctgatgggattagatccgacacggattctggttatgagtcaggtgctgttaagttttggtatcgccctggcgctggttccactgctgattttcaccagtgacagcaagttgatgggcgatctggtgaacagcaaacgcgtaaaacagacaggctgggtgattgtagtgctggtcgtggcgctgaatatctggttgttggtggggacggcgctgggattgtag

SEQ ID NO: 8716 - protein, 412 aa, Shigella flexneri 2a str. 2457T
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLVMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 8717 - DNA, 1296 bp, Bacillus anthracis str. Ames
  CDS (1)..(1296): transl_table=11
atgaataaagatatatcaaaagatgaacatgtcccttctcaaagtacaactgttcaatcagcgcatttagcattaagcggacaaacgaaaggcttaaaaagactattaccattcttaggtcctgctttcatcgcttcagtcgcttatattgatcctggcaatttcgcgacaaatattgccgctggatcacaatatggatatttattactctgggtaattcttgcttctaatttaatggctgtattaatccaaactttatccgctaaattgggaatcgctacgggcagaaaccttcctgagatcgctcgagaaaacttcccaaaacctgtttccatcggtttatggatacaaggtgaactcgttattatggcgactgatttagctgaatttattggagccgcactcggattgtatttattatttgggattccgatgttacccgcagctttaattacagctgctggatcatttattattcttgaatttcaacgcagaggctttcgtccattagaagcgattataacggggatgatttttatcgttgttatcgcttttggtgtacaagtcttttatgcaaaaccggaattaagtcctttactttcagggcttttcattccgaaattccaaggtgtagacagtatattacttgcagctggaattttaggtgcgacagttatgccgcacgcaatctatttacattccgccttaacacaacgccgcgtagtcggaacaaatgatgaacaaaagaaaaagattttccgcttcgattttattgatatcattatcgcaatgattatcgctggagcaattaatgcaagtatgttaattgttgctgctgcactattctttaaaaacggcttgcatgttgaagatcttgatgttgcttttaaccagtttagtaacttagtcggtcctgtatcagctgctttatttggaattggtctcttatcagcaggactatctagctcttctgtcggtacaatgtcaggtgatattattatgcaaggtttcattcgaatgcacattccgttatacttacgccgatttattacaatgattccaccattagttattatcgctttaggtgtaaatccaacttacgctctagtcatgagccaagtcgtcttatcattcggtattgcctttgcattagtaccacttattatgtttacaagtagtaaaaaaattatgggtacactcgttaatcaccgcataactacctttatcgcttggattattgctgtacttgttatcattttaaatattttcttactgtatcaaacatttgtgggttaa

SEQ ID NO: 8718 - protein, 431 aa, Bacillus anthracis str. Ames
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFDFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGTLVNHRITTFIAWIIAVLVIILNIFLLYQTFVG

SEQ ID NO: 8719 - DNA, 1197 bp, Corynebacterium diphtheriae
  CDS (1)..(1197): transl_table=11
atggagatgcctatgcgtaagaccttaatcagcctcaccggccccgccttcgttgctgcagtggcttacgtcgaccccggcaacgtagccgccaacatcagcgccggctcccactacggctacctcctggtgtgggtactcgtcgtggccaacctcatggccatgttcatccagtaccactccgccaaactgggcctagtcacccaccgctccctgccggaaatcatgggcgagcgtctctcccgccgcgcgcgcctaggcatgtgggcccaggccgagctcatcgccgcggccaccgacctcgccgaagtcatcggcggcgccattgccctgcaactcctcttcaacctccccctgttcgcgggcgcgctcatcatcggcgcggtctccatcattctcctcatcttccagaagaagaaccagtggttcgaggggcttgtcatcggcctgctcctggtcatctgcatcggcttccttgccggcctcgccatcgccccgcccgaccccgccgacgtggccggcggcctcatcccccgcctagagggcaaggacagcatcctgctggccgcctccatgttgggcgccaccgtcatgccgcacgccatttacctacactcctccctgaccaagcagcgctaccccgacctggaaatcccccacgtgctggccggcacccgcgcggacatcgccgtggcgctgtccatcgccgggctcgtcaacgtgggcctgctggtcctggcgggctcggccctctacggcgtggacggcacagagaccatctccggggcccacacggcgattgccagccacctcggcccgctggccggcgttctcttcgccatcggcctgctggccagcggcctcgcctcgacgtcagtgggcgcctacgccggctccgaaatcatggacggcctgcttcacatcaaggtccccctactagtccgccgcctggtcacgctcatcccggcgctggtcatcatcggctgcggggtcgaccccactatggcactggtggtcagccaggcacttctttccctgggcatccccttcgccatcatcccgcttttccgctatgccggctcccgggacgtcatgggtgagttcgccgcgaaaccctggtctatggccgtgggctggacgcttgccgcgctggtcatcgcactcaatctcgccctcgtgctcctgccgctgctctag

SEQ ID NO: 8720 - protein, 398 aa, Corynebacterium diphtheriae
MEMPMRKTLISLTGPAFVAAVAYVDPGNVAANISAGSHYGYLLVWVLVVANLMAMFIQYHSAKLGLVTHRSLPEIMGERLSRRARLGMWAQAELIAAATDLAEVIGGAIALQLLFNLPLFAGALIIGAVSIILLIFQKKNQWFEGLVIGLLLVICIGFLAGLAIAPPDPADVAGGLIPRLEGKDSILLAASMLGATVMPHAIYLHSSLTKQRYPDLEIPHVLAGTRADIAVALSIAGLVNVGLLVLAGSALYGVDGTETISGAHTAIASHLGPLAGVLFAIGLLASGLASTSVGAYAGSEIMDGLLHIKVPLLVRRLVTLIPALVIIGCGVDPTMALVVSQALLSLGIPFAIIPLFRYAGSRDVMGEFAAKPWSMAVGWTLAALVIALNLALVLLPLL

SEQ ID NO: 8721 - DNA, 1341 bp, Wigglesworthia glossinidia endosymbiont of Glossina brevipalpis
  CDS (1)..(1341): transl_table=11
atgaacaaaagtttagaagaaataaacaatactgtgccaatccctgataggaaagatagtaaattaaaaaaattaattgctttttctggtccaggagctttagtagcagttggttatatggatccaggaaattggattacttcaatacaaggtggatcattatatggataccttttgttgtcagttatattgctatctagcttaatagcaatgttgttgcaaagcatgtgcgctaagcttggaatagttacaggaatggatttagctcaatctacaaaaaacttagttggaaaaaaaatttcttttattctatggataatatcagaattagcaattatagcaacagaaatagctgaagtaataggaagcgctattgcattaaatcttttaatgaaaattcctttaataattggagtagcgattacagttttagatgtatttttattattaatattattaaaatatggaataagaactatagaagctttagtttttgttttaatttcaaccatattttgcatttttttatatgaagtagctttagctaatccaaatataaatagtattatatattctttcattcctagtaaggatattttaacagcgcatgtagaacaaggagaatcagctttttttatagctttaggtatagtaggcgctacagttatgcctcacaatttatatttacattcttctattgtgcaatcaagaagatataatcgtaaagataaaaatgcattaaaagaagcaattaaatacgcaaaaatagattctaacatacagttaagtttttctttttttattaattgcttgattcttattttaggttctgctttattttttggaaaaaatccagaagatattggaagatttactcaactatatgacgcattacaagataattctatggtaggaacaattgctagttctagtcttgcgacattatttgcattagcattacttttttccggtcaaaatgctacaataactggtactctaactggacaaatagtaatggaaggattcataaatttaaaattatcaatatggaaacgtagaattattactagattgatagctataacaccagttataatttgcgtatatttctgggatggaaaagaagatttagttgaaaaattattagtatacactcaaatttttttaagcctgtctcttcctgtatcaatggttcctttgctatatttaacatcttctaaaaaaattatgggaaaatttgttaattgtatatccgcttcagcagtaggatggctatctactggtgttttaataattttgaactctcagttaatattagaaacaataaaatcaagcttttga

SEQ ID NO: 8722 - protein, 446 aa, Wigglesworthia glossinidia endosymbiont of Glossina brevipalpis
MNKSLEEINNTVPIPDRKDSKLKKLIAFSGPGALVAVGYMDPGNWITSIQGGSLYGYLLLSVILLSSLIAMLLQSMCAKLGIVTGMDLAQSTKNLVGKKISFILWIISELAIIATEIAEVIGSAIALNLLMKIPLIIGVAITVLDVFLLLILLKYGIRTIEALVFVLISTIFCIFLYEVALANPNINSIIYSFIPSKDILTAHVEQGESAFFIALGIVGATVMPHNLYLHSSIVQSRRYNRKDKNALKEAIKYAKIDSNIQLSFSFFINCLILILGSALFFGKNPEDIGRFTQLYDALQDNSMVGTIASSSLATLFALALLFSGQNATITGTLTGQIVMEGFINLKLSIWKRRIITRLIAITPVIICVYFWDGKEDLVEKLLVYTQIFLSLSLPVSMVPLLYLTSSKKIMGKFVNCISASAVGWLSTGVLIILNSQLILETIKSSF

SEQ ID NO: 8723 - DNA, 1239 bp, Candidatus Blochmannia floridanus
  CDS (1)..(1239): transl_table=11
atgttagagaagcagtctgatgtaattgggaattgtactaatcggaaagttaagtttgcgttacttgggcctgcttttatagcagcaattggatatattgatccagggaattttgcaactaatatacaagctggagctacttttggatatcaattattatgggtggtggtatgggctaatataatggctatgttgattcaattattatctgcaaaattaggaattgctactggtaaaaatttagcagagcatattcgtgatcagtttcctaaatcattagtatggatatattgggtgcaggcggaaattattgctatggcgacagatttggcagaatttattggagctgctattggatttcaaatattattaggaatatctttattgaatggagcgttattgactggagtagctacatttttaattttaactttacaaaattatggaagaaaacctttagaattagttgttggtggtttattgttatttgttgcaattgcatatgttattgaattattttattctaaacctcaattaattgagttaggcatgagtatgttgtgtccgatattgcctaataaggaagctgtatttttatcagcaggagtattgggagcaactattatgcctcatgttatttatttacattcttcattaactcaggattctagtgtaatagcaactaaatctgaacggtattcttctactaaattagatgttgctattgctatgactatagcggggtttgtaaatttgtctatgatggctactgcagcatctgtatttcattttagaggacatactggtgttgctagtttggatgaagcttatttaacattatctcctttattaagtcataccgctgctgtaatttttggattaagtttaactgctgctggattatcttcaacggtagtaggtactttagctggtcaagtggtgatgcaaggttttgttagattttatattccaattgtattacgtcgtattgttactatgtttccatcttttataattattgctttaaaaattgatccgactcatattttaattatgagccaagtattacttagttttggtattgcgttagcattggttccattattgctttttactggtaatgtgaatttgatgcatgagttagttaattctttttggatgaattttttaggatggataattacgatgattgtgatagcattaaatatatatttattgataggtattttttcggaataa

SEQ ID NO: 8724 - protein, 412 aa, Candidatus Blochmannia floridanus
MLEKQSDVIGNCTNRKVKFALLGPAFIAAIGYIDPGNFATNIQAGATFGYQLLWVVVWANIMAMLIQLLSAKLGIATGKNLAEHIRDQFPKSLVWIYWVQAEIIAMATDLAEFIGAAIGFQILLGISLLNGALLTGVATFLILTLQNYGRKPLELVVGGLLLFVAIAYVIELFYSKPQLIELGMSMLCPILPNKEAVFLSAGVLGATIMPHVIYLHSSLTQDSSVIATKSERYSSTKLDVAIAMTIAGFVNLSMMATAASVFHFRGHTGVASLDEAYLTLSPLLSHTAAVIFGLSLTAAGLSSTVVGTLAGQVVMQGFVRFYIPIVLRRIVTMFPSFIIIALKIDPTHILIMSQVLLSFGIALALVPLLLFTGNVNLMHELVNSFWMNFLGWIITMIVIALNIYLLIGIFSE

SEQ ID NO: 8725 - DNA, 1305 bp, Chromobacterium violaceum ATCC 12472
  CDS (1)..(1305): transl_table=11
atgttctcactccccaccaccgccaccgcgccgttctgccccgccgaagtcaacggcagcgtgcgcatagacgccagcgcctccttcggccagcgcctgcgccgcttcgccggccccggcctgctggtcgcggtcggctacatggatccgggcaactgggcgaccgacatcgaggccggctcgcgcttcggctaccagctattgtgggtggtgatgctgtccgggatcgccgccatgatgttgcagatgctggcggcccggctgggactggtcaccggcatggatctggcgcaggccagcgccgcgcgctacggccgtttcggacgtgtttgccactggctgagcgccgaggtgtccatcatcgcctgcgatgtcgccgaagtattgggctgcgcgctggcgttcaagctgctgttcggcgtgccgctggcatggggcgtggcgctgaccgcattcgacacgctgatcgtgctggggttgaagggacggggcttccgccagctggaggccatcgtgctggggctgatcgccaccatcgccctgtgtttcctcgcgcagctggcgctgctggacactcattggccggcggtggcggcgggcctggcgcccagcttgccggcgcagggcatggacaaggccatcgtgctggcgctgggcatcgtcggcgccaccatcatgccgcacaacctctacctgcattcgtcggtggtgcagacgcggcgggtggagggcggagagggggcgttgcggcagacgctgctgctgtgccggatcgacaccataggctcgctgttgctggcgatgctggtcaacggcgccatcctggtgctggcgggcagcgctttccacgccgccgggcatatcgcggtggccgacatcgccgacgcccatgagctgatccgcccgctggccggctcgctggcggcgctgctgttcggcgtcgcgctgctggcggccgggcagagcgccaccttgaccggcaccgtcgccggccaggtgatcatggatggcttcctgcgcatacgcatcccctgctaccagcgccggctgatcacccgcgcgctggccttgctgccggccggggccggcatcgcatggcagggcgagcaggcggtgggcccgctgctggtgtggagccaggtggcgctgagcctgcagctgccgctggcgatgtggccgttgctgcgcatgacgggggacagggcgctgatgggcgcggatgccgcgccgcgctgggcgattgccagcggctggggattgttctggctgatactggccgccaactgcgcgctgcttttgggctga

SEQ ID NO: 8726 - protein, 434 aa, Chromobacterium violaceum ATCC 12472
MFSLPTTATAPFCPAEVNGSVRIDASASFGQRLRRFAGPGLLVAVGYMDPGNWATDIEAGSRFGYQLLWVVMLSGIAAMMLQMLAARLGLVTGMDLAQASAARYGRFGRVCHWLSAEVSIIACDVAEVLGCALAFKLLFGVPLAWGVALTAFDTLIVLGLKGRGFRQLEAIVLGLIATIALCFLAQLALLDTHWPAVAAGLAPSLPAQGMDKAIVLALGIVGATIMPHNLYLHSSVVQTRRVEGGEGALRQTLLLCRIDTIGSLLLAMLVNGAILVLAGSAFHAAGHIAVADIADAHELIRPLAGSLAALLFGVALLAAGQSATLTGTVAGQVIMDGFLRIRIPCYQRRLITRALALLPAGAGIAWQGEQAVGPLLVWSQVALSLQLPLAMWPLLRMTGDRALMGADAAPRWAIASGWGLFWLILAANCALLLG

SEQ ID NO: 8727 - DNA, 1374 bp, Rhodopseudomonas palustris CGA009
  CDS (1)..(1374): transl_table=11
atggatgcaagatcgccgcagatgaccgccgatccctcgccggcaccggagcagaccacggggtggcgtttagcgcgcggcgagccgtcgctcgccgggatgttcggctcggtgccgacccgggccaaggggccgttctggcgcaagctgatcgcattcctcggccccggatatctggtcgctgtcggctacatggaccccggcaactgggcgacctcgctcgccggcggctcgaaatacggctacgcgctgctgacggtcgcgctggtctccaacatcatggccgtggtgctgcagtcgctgtgcacgcggctcggcgtcggtgcgggcagggacctcgcccaagcctgccgcgacgcctatcccaaatgggtgtcgtggccgctctggctgtcggcagagatcgcgatcactgccaccgatcttgccgaagtgatcggcaccgcgatcgggctcaatctgttgtttgggattccgctcgagatcggcgtgttgatcaccgcggccgacgtgttcctcgtgctggcgctgcaggctttcggcttccgctggatcgaggcgtttgtggtcgcgctgctcggcgtgatcgcggcgtgctttgcgattcagatcgcgatggcggatccggattggggcgcggtgatccgcggctttgcccccaccacgcgggtgctgaccgagcccggcatgttgtatctggcgctcggcatcctcggcgccacggtgatgccgcacaatctctacctgcattccggcctggtgcagacgcgtggcttcggccacagcccagccgagaagcacgaagcgatcaaactggcgaccttcgactcgacgatcgcactgaccttcgcgctgaccatcaacgcgtcgatcctgatcctcgccgcggcgaccttccaccatgccggcaagaccgatattgccgaactcgatcaggcgcatgccttcctggcgccgctgctcggctcgacgctggcaccgacgctgttcggcatcgcgctgctggcctgcggcctgaactcgaccatcaccgccacgctcgccggccagatcgtgatggaaggcttcatccagatcaggatcaagccttggctgcggcggatggtgacgcggctgatcgcgatcgtcccggcggtcgcagtcacgatcatcgccggcgaaaagggcaccgggcagctcctgatcctcagtcaggtggtgctcagcctgcagctaccgttcgccgtggtgccgctggtggtgttcaccgccagccgcgcgaagatgggcgagttcgttgcgccgcgctggctcaccgccatcgcatcgctgatcgctgcgatcatcgtcgcgctgaatatcaagctggtgttcgactacgcgaccggcgggtag

SEQ ID NO: 8728 - protein, 457 aa, Rhodopseudomonas palustris CGA009
MDARSPQMTADPSPAPEQTTGWRLARGEPSLAGMFGSVPTRAKGPFWRKLIAFLGPGYLVAVGYMDPGNWATSLAGGSKYGYALLTVALVSNIMAVVLQSLCTRLGVGAGRDLAQACRDAYPKWVSWPLWLSAEIAITATDLAEVIGTAIGLNLLFGIPLEIGVLITAADVFLVLALQAFGFRWIEAFVVALLGVIAACFAIQIAMADPDWGAVIRGFAPTTRVLTEPGMLYLALGILGATVMPHNLYLHSGLVQTRGFGHSPAEKHEAIKLATFDSTIALTFALTINASILILAAATFHHAGKTDIAELDQAHAFLAPLLGSTLAPTLFGIALLACGLNSTITATLAGQIVMEGFIQIRIKPWLRRMVTRLIAIVPAVAVTIIAGEKGTGQLLILSQVVLSLQLPFAVVPLVVFTASRAKMGEFVAPRWLTAIASLIAAIIVALNIKLVFDYATGG

SEQ ID NO: 8729 - DNA, 1245 bp, Gordonia westfalica
  CDS (1)..(1245): transl_table=11
atgcgagaggtcatggcttcggctcgtccgcggctcgcgcgagctcggtctgggtccctactgcttggtccggccttcgtcgcagccatcgcctatgttgatcccggcaatgtcgcgtccaatatcagcgccggcgcccagttcggctacctcctcgtgtgggtgatcgtggttgcgaacgtgatggcggggttggtgcagttcctttctgccaagctcggggtggtcacgggcaggtcattgccggagacggtgcgtctgcgcgcgtcgcggaccgccaggctctcctactgggtgcaggctgagattgtcgctatggcaaccgatctcgccgaagtggtcggcggagctatcgcgctgaatctgctcttcgacctgccgttgctcatcggtggcgtcatcacaggttcggtgtcgatggtcttgcttcttgtccaagaccgcagagggcagcaaccgttcgagcgggtgatcattggcttgctggctgtcattgccatcggttttctgacaagcaccgtggtggcaccacctccccccggggctgtcgtggggggcctcttgccgcggttcgatggcacggaaagcgtgctgatcgcggccgccatgttgggtgcgacggtgatgcctcacgcggtgtatctgcattcaggtctggtgcgggatcgacacggccatcaaccggaggggccgatccggtcgcggctgttgcgtgtgacgaagatcgatgtcggtctggcgatgctgctggcgggcgcggtcaacctgtccatgctgctggtggcagcaaccactttgcgtggccgtgaaggggtcgattcgatcgacggagcgcatgcggcggtcgccgacaccttggggcaagtggtggcgttgctgttcgcgctggggcttcttgcctcggggctggcatcaacctcggtcggggcgtacgccggcgcgatgatcatggacgggctgttgcagcgcaggatcccgctcatactccgacgcctgatcaccctgatacctgccatcacagtgttggccatcggaatcgatcccagccgagctctgattgtctcgcaggtcgttctgtccttcggcatccccttcgcactggttccgttagtgcgtttcaccagcgacaggatgctgatgggcgaggatgtgaacaatcgactcaccacgtcgctggcctggctgactgcagcggtcatcatcgtgctcaacgtcgccttgatctacctgacagtcaccggttaa

SEQ ID NO: 8730 - protein, 414 aa, Gordonia westfalica
MREVMASARPRLARARSGSLLLGPAFVAAIAYVDPGNVASNISAGAQFGYLLVWVIVVANVMAGLVQFLSAKLGVVTGRSLPETVRLRASRTARLSYWVQAEIVAMATDLAEVVGGAIALNLLFDLPLLIGGVITGSVSMVLLLVQDRRGQQPFERVIIGLLAVIAIGFLTSTVVAPPPPGAVVGGLLPRFDGTESVLIAAAMLGATVMPHAVYLHSGLVRDRHGHQPEGPIRSRLLRVTKIDVGLAMLLAGAVNLSMLLVAATTLRGREGVDSIDGAHAAVADTLGQVVALLFALGLLASGLASTSVGAYAGAMIMDGLLQRRIPLILRRLITLIPAITVLAIGIDPSRALIVSQVVLSFGIPFALVPLVRFTSDRMLMGEDVNNRLTTSLAWLTAAVIIVLNVALIYLTVTG

SEQ ID NO: 8731 - DNA, 1278 bp, Mycobacterium avium subsp. paratuberculosis K-10
  CDS (1)..(1278): transl_table=11
atgttcgactaccctcactttcttattcgcctgtgggaatcgaggtcgacgttggcgcagcgcacccagggctcgctcaagggcaactggtacctgctcgggcccgcgttcgtcgccgccatcgcctacgtcgacccgggaaatgtcgcggccaacgtcagcgccggctcgcaatacggctacctgctgctttgggtgatcgtggccgccaacgtcctggccggcctggtgcagtacctgtcggccaagctcgggctggtgaccgggcgctccctgcccgcgaccatcggcaagcggatgagccgtccggcgcggctggtctattgggttcaggccgagctggtggccatcgccaccgacgcggccgaggtggtcggcggggccatcgccttgcacatcctgttcgggttgccgctgctggccggtgggctgatcaccggcgtggtggcgctgctgctgttgggcatccaggaccggcgcggccagatcctcttcgaacgggtcatcaccggcctgctgctggtcatcgcgatcgggttcgcggccagtttcttcgtcaagaccgcgcccccggaggcggtgctgtccgggctgctcccgaggttccgcggcaccgagagcgtgctgctggccgccgccatcctgggcgccaccgtcatgccgcatgcggtgtacatgcattcggggctggtcctggaccggcacgggcaccccgacgaggggccgcaccgccgcctgctgctgcgcgtcacccgctgggacgtggtactggcgatggcggtggccggcaccgtgaacgccgcgatgctgctgatcgccgccaccaacctgcagcaccgcgacgtgagcgcctcgatcgagggcgcgtacgccgcgatccacaacacgctgggcgcgaccatcgcggtgatgttcgccgtggggttgctcgcctccgggctggcatcgtcgtcggtgggtgcctacgccggcgccatgatcatgcaggggctgctgcaccgctcgattccgatggtggtgcgccggttgatcacgctgtgccccgcgctgctgatcctggcggtcggatacgacaccacccgcgccctggtgctgtcccaggtggtgctgtcgttcgggataccgttcgcggtgctgccgttgatcaagctgaccagcgaccgcgagctgatggggtccgacgccaaccaccgcatcacgacgatccttggctggggcgtcggcatcttgattagtctgctgaacatggtgctcatctggctgacggtgaccggctga

SEQ ID NO: 8732 - protein, 425 aa, Mycobacterium avium subsp. paratuberculosis K-10
MFDYPHFLIRLWESRSTLAQRTQGSLKGNWYLLGPAFVAAIAYVDPGNVAANVSAGSQYGYLLLWVIVAANVLAGLVQYLSAKLGLVTGRSLPATIGKRMSRPARLVYWVQAELVAIATDAAEVVGGAIALHILFGLPLLAGGLITGVVALLLLGIQDRRGQILFERVITGLLLVIAIGFAASFFVKTAPPEAVLSGLLPRFRGTESVLLAAAILGATVMPHAVYMHSGLVLDRHGHPDEGPHRRLLLRVTRWDVVLAMAVAGTVNAAMLLIAATNLQHRDVSASIEGAYAAIHNTLGATIAVMFAVGLLASGLASSSVGAYAGAMIMQGLLHRSIPMVVRRLITLCPALLILAVGYDTTRALVLSQVVLSFGIPFAVLPLIKLTSDRELMGSDANHRITTILGWGVGILISLLNMVLIWLTVTG

SEQ ID NO: 8733 - DNA, 1500 bp, Lactobacillus johnsonii NCC 533
  CDS (1)..(1500): transl_table=11
atggaagatcatagttttatttcatacgcaaatggtaaatctttagtagaaattaatagtactattccagttccgagaactcgtaatttcttcaggatgcttttagcatatactggtcctggtgcattagttgctgttggatacatggatccaggaaactgggcagcttcaattaatggtggtcagagttttaattatcttttgatttctactattttaatttctagtttaatggctatgcttttacaatatatggccgcaaaactaggaatcgttactcaaatggatctagcacaagccattcgtgcacgtactagtaaaagattaagttttatcctttggattataattgaactagcaattatggcaactgatgtagcggaagttattggagcggcaattgctttaaatcttttatttaagattcccctagttattgcaacttttatcactgtctttgatgtattactcttattgttattgtcaaaagtgggatttagaaaaatagaagccctggtatcctgcttgattatggtgatactactggtttttacttatcaagtcatgttagctaatcctaactggaaaaatatttttttgtctgcattgccatctccagaattagtagctcagcatcccgtagttaatggattatcacctttaacaggaagtttgggaataattggtgccactgtgatgccgcataatttttatttgcattcatctatttgccaaactagaaaaattaaccatgataatcttgcagatgttcaaaatgcagtccgttttactacgtgggattcaaatattcaattaattattgccttttttgttaatgtacttttattaattatgggagctgctgtttttaaaagtggtgcagtcaaagatagttcattctttggtttgtatgatgctctaagcaatacgactatgttaagcaatccaattttgatctcagtagctaagacaggaattttatcagtcttatttgcagttgcacttcttgcttctggtcaaaattcaacaattactggaactctcactggacaggtagtaatggaaggctttattcacttaaagatgccactatgggcaagacgattatttactagattattatctgtgattccagttattatgtgtgtattgatgacagcaaaagattcaatttctcagcaacattttgccctaaacatgcttttggaaaattctcaagtttttctagcatttgcagtaccattttcaattgtgccacttttaattatgacagatgataggagaatgatgggacaatttaagaatagaaagatttggtcgattctaggatgggccagttcaattattttgattttcttgaatttgtgtaatttaccagctacttttgtttcctttaatatgatgccaaaaagagatgcagtagttttcgcttacacgatcattatgttgattattttattaatgggctggacatgttgggatatgcgaaagaagaaatag

SEQ ID NO: 8734 - protein, 499 aa, Lactobacillus johnsonii NCC 533
MEDHSFISYANGKSLVEINSTIPVPRTRNFFRMLLAYTGPGALVAVGYMDPGNWAASINGGQSFNYLLISTILISSLMAMLLQYMAAKLGIVTQMDLAQAIRARTSKRLSFILWIIIELAIMATDVAEVIGAAIALNLLFKIPLVIATFITVFDVLLLLLLSKVGFRKIEALVSCLIMVILLVFTYQVMLANPNWKNIFLSALPSPELVAQHPVVNGLSPLTGSLGIIGATVMPHNFYLHSSICQTRKINHDNLADVQNAVRFTTWDSNIQLIIAFFVNVLLLIMGAAVFKSGAVKDSSFFGLYDALSNTTMLSNPILISVAKTGILSVLFAVALLASGQNSTITGTLTGQVVMEGFIHLKMPLWARRLFTRLLSVIPVIMCVLMTAKDSISQQHFALNMLLENSQVFLAFAVPFSIVPLLIMTDDRRMMGQFKNRKIWSILGWASSIILIFLNLCNLPATFVSFNMMPKRDAVVFAYTIIMLIILLMGWTCWDMRKKK

SEQ ID NO: 8735 - DNA, 1296 bp, Bacillus cereus ATCC 10987
  CDS (1)..(1296): transl_table=11
atgaataaagatatatcaaaagatgaacatgtcccttctcaaagtacaactgttcaatcagcgcatttagcattaagcggacaaacgaaaggcttaaaaagactattaccattcttaggtcccgctttcatcgcttcagtcgcttatattgaccctggcaatttcgcgacaaatattgccgctggatcacaatatggatatttattactctgggtaattctcgcttctaatttaatggctgtattaatccaaactttatcagctaaattaggaatcgctacaggtagaaaccttcctgaaattgctcgagaaaacttcccaaaacctgtttccatcggcttatggatacaaggtgaactcgttattatggctactgatttagctgaatttatcggggcagcactcggattgtatttattatttggaattccaatgttaccagctgctttaattacagctgctggatcatttattattcttgaatttcaacgcagaggcttccgtccattagaagctattataacaggaatgatttttatcgttgttatcgctttcggtgtacaagtcttttatgcaaaaccggaattaagccctttgctttcaggactatttattccaaaattccaaggtgtagacagtatattacttgcagccggaattttaggggcgacagttatgccgcacgcaatctatttacattccgccttaacgcaacgccgcgtagtcggaacaaatgatgaacaaaagaaaaagattttccgcttcgagtttattgatatcattattgcaatggttatcgctggagcaattaatgcaagtatgttaattgttgctgctgcactattctttaaaaacggcttgcatgtcgaagatcttgatgttgcttttaaccagttcagtactttagtgggccctgtatcagctgctttatttggaattggtctcttatcagcaggactatcaagctcttctgtcggtacaatgtcaggtgatattattatgcaaggtttcattcgaatgcatattccgttatacttacgccgatttattacaatgattccaccactagtgattatcgctttaggcgtaaatccaacttacgctctagtcatgagtcaagttgtcttatcattcggtattgcctttgcattagtaccacttattatgtttacaagtaataaaaaaattatgggtgcgctcgttaaccaccgtataacaaccttgatcgcttggatcattgctatacttgttatcattttaaatattttcttactgtatcaaacgtttgtaggataa

SEQ ID NO: 8736 - protein, 431 aa, Bacillus cereus ATCC 10987
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFEFIDIIIAMVIAGAINASMLIVAAALFFKNGLHVEDLDVAFNQFSTLVGPVSAALFGIGLLSAGLSSSSVGTMSGDIIMQGFIRMHIPLYLRRFITMIPPLVIIALGVNPTYALVMSQVVLSFGIAFALVPLIMFTSNKKIMGALVNHRITTLIAWIIAILVIILNIFLLYQTFVG

SEQ ID NO: 8737 - DNA, 1230 bp, Yersinia pestis biovar Microtus str. 91001
  CDS (1)..(1230): transl_table=11
atgcttaatggccgtgctgtcgatacatctcgtcgcccattaaggaagattaaactctccttgatggggcctgcttttattgctgccattgcttatattgatcccggcaatttcgcaactaatattcaggcgggggccacgtttggctataccttgctatgggttgtcgtgtgggccaacgtcatggcgatgttagtccagttgctgtccgccaagctgggtatcgctaccggtaaaaatttggctgagcatatccgggaccgtttccctcgtccagtggtatgggcctactgggtgcaagccgaaattatcgtgatggcgaccgatttggctgagtttatcggggcggctattggctttaaattgctgtttggtgtgacgctactgcaaggggcggtgctgaccggtattgccacctttcttattcttatgttgcaaaatagggggcaaaagcctcccgaattggtgattggtgggctgctattgtttgtcgccgcggcttatattgttgaactgatcttctctcagccagatattgcggctcttggccgtgggatgctgatcccaaatttacctgatggtaacgccgtatttttagctgcgggggtgttgggggcgactattatgccgcatgtgatttacctgcattcagcattaacacaaaccgggggggaagagtctaaaactgagcgctatgcctcgaccaagtttgatgtagcgattgccatgacgattgcgggctttgttaatttggcgatgatggcaaccgccgctgcggcttttcatttcaatggttatgagaacattgctgaaatcgaagaggcttatataaccttgcagccgctgttgggtaatgctgcggccactgtttttggtttgagcttaatcgccgccgggctttcatcaacggtcgtgggtacgctggcggggcaagtggtcatgcagggttttgtgcggttttatattccaatgtgggtgcgccgtatagtcactatgttgccttcttttattgttattttagctgggatggatgcgacacagatattggtgatgagtcaggttttactgagttttggtattgcactggcactggtgccattattggttttcaccggtaataaagagttgatgggggagctggttgatacaaaaaccacccagattttaggtaaattggtggttctgatcgtggttgggttaaatgcctatttactgattagcctgctttag

SEQ ID NO: 8738 - protein, 409 aa, Yersinia pestis biovar Microtus str. 91001
MLNGRAVDTSRRPLRKIKLSLMGPAFIAAIAYIDPGNFATNIQAGATFGYTLLWVVVWANVMAMLVQLLSAKLGIATGKNLAEHIRDRFPRPVVWAYWVQAEIIVMATDLAEFIGAAIGFKLLFGVTLLQGAVLTGIATFLILMLQNRGQKPPELVIGGLLLFVAAAYIVELIFSQPDIAALGRGMLIPNLPDGNAVFLAAGVLGATIMPHVIYLHSALTQTGGEESKTERYASTKFDVAIAMTIAGFVNLAMMATAAAAFHFNGYENIAEIEEAYITLQPLLGNAAATVFGLSLIAAGLSSTVVGTLAGQVVMQGFVRFYIPMWVRRIVTMLPSFIVILAGMDATQILVMSQVLLSFGIALALVPLLVFTGNKELMGELVDTKTTQILGKLVVLIVVGLNAYLLISLL

SEQ ID NO: 8739 - DNA, 1416 bp, Candida glabrata CBS 138
  CDS (1)..(1416)
atgcttccaaggactatagatatacttaagaagttcgccacgttcgtgggtcccggcatcatggtcagtgtggcctacatggatcccggtaattactctaccagtgtctctggtggtgctcagtacaaatataagctactgttctccatatttgtgtctaatatctttgcagttcttctacaatgcctttgtgttaagttagggactgtgacaggctatgacttagcggagaattgtcgcagaaaccttccaaagaaggtgaactatgtgctatatttctttgctgagatcgctatcattgcaacagatctggccgaagtggtgggtacggctattgctctacagatattgttcaatatacccctaacattaggtgtgatcctgactgtgcttgatgtgctgctaatattgatgttctacagaccagatggccagtccatgaagaaagtaaggatgtttgaattgtttgtgggtgttctggtcatctgcacagtgttatgctttgtacttgagttgttcaaaatcaatatcccaaacaagagagaattattcgagggctttatgccaacatcaataattttcaaagaaaagcaagctttatacatatctctaggtatattaggtgctaccgttatgccacattctctttacttgggatcctccttggttaaaccaagactttacgactacgacatcaagaaatatggtaaagtcggatcttcaccaagtctaagtgctatcaaatactctttgaactactcttacgctgaattaattatttccttgttcctaatagccacatttgttaactcagctattctaattgttgctggtgcaacactagctggtcagcctgaagctgaagatgctgatttattgtctatttataacttgctagtccactacatctcaccagcggcgggcctcatctttgctgctgcaatgttgttctcagggcagtctgcaggtattatctgtactttagccggtcaaattgtttcagaaggtttcttagaatggtctctacccccatgggctacaagactatgtacaagattgatcgctatcatcccttgtttgtttgttacactaacacttggagagcgtggcatatcaaatatcctgaatttctctcaagttgttttgtccctaattctaccaattgtttcagcgccacttatctatttcactgctaataggtcaattatgacagtagaggatcatcacttacatgtggctgatataaatgatgttgacgagagcacacctttaaattccagtgcacaaagaaagaaaaaagattttaccaattctaaattattaactggagcagctgtctttgtttgggctttaattggtggcttgaactgctatttggttggctcttggctgaacggtgcagacgtacacttctaa

SEQ ID NO: 8740 - protein, 471 aa, Candida glabrata CBS 138
MLPRTIDILKKFATFVGPGIMVSVAYMDPGNYSTSVSGGAQYKYKLLFSIFVSNIFAVLLQCLCVKLGTVTGYDLAENCRRNLPKKVNYVLYFFAEIAIIATDLAEVVGTAIALQILFNIPLTLGVILTVLDVLLILMFYRPDGQSMKKVRMFELFVGVLVICTVLCFVLELFKINIPNKRELFEGFMPTSIIFKEKQALYISLGILGATVMPHSLYLGSSLVKPRLYDYDIKKYGKVGSSPSLSAIKYSLNYSYAELIISLFLIATFVNSAILIVAGATLAGQPEAEDADLLSIYNLLVHYISPAAGLIFAAAMLFSGQSAGIICTLAGQIVSEGFLEWSLPPWATRLCTRLIAIIPCLFVTLTLGERGISNILNFSQVVLSLILPIVSAPLIYFTANRSIMTVEDHHLHVADINDVDESTPLNSSAQRKKKDFTNSKLLTGAAVFVWALIGGLNCYLVGSWLNGADVHF

SEQ ID NO: 8741 - DNA, 1641 bp, Candida glabrata CBS 138
  CDS (1)..(1641)
atgagcacttctggagctgaaaatggtgttggtgccagccgggcccggaagtccacttgtacagaagctaacgataccgataaggttggtgtgaagaccataagcgaagtcactgacttacagactattgagagctcaccgtcaacatgcgaggagcctatgagcaataaggatgtcataaaggctgctttcaagaaatatattaaattcatcggaccaggactgctggtcagtgttgcatatatcgatcctggtaactactctactgctacatcagctggtgcagctaaccagttttcattgttatgtgtggtgctactgtccaacttcattgctatcttcttgcaatgcttgtgtataaaattgggttccgttactggtatggacttgagcagggcatgtagaaaacacttgccaagatgggcgaattggactgtatacttctttgctgaatgtgcaattattgctacagatgtcgctgaggttattggtactgccatcgcattgaacattcttatcaaagttcctctcccagccggtgtttgcattacattggtagatgtgctagcaattatggctacttatagaccgggcgcttcttccatgaaagttgtacgtatgtttgaattatttgtggcattgttagtcgttggtgtttgcatctgttttgcagtagagctcgcttatatccctaaaagcacttctgctgctaaggtgttcagaggtttcgtgccatctcgtcaaatgctagaacataatggtgtctacacagctatttctattctcggtgctactgtgatgcctcattcattgttcttgggatctgcattggttcaaccaagactgttggaatatgatgtcaatcatggtaactattctatgctgaaggatgatgaagatgagaaaaacaaagaaacagctgttgatgaaagataccagaactatagaccaaccagatcagccattaaatactgtatgaagttttctatgatagaactaggactgacgctatttacactagcgctatttgttaattgtgctatcctaattgttgctggttcaacattatatggttatcctgatgcagcagatgctgatttatacaccatccatgacctattatcgaaaaccttagctcctattgcaggcactattttcatgctagctttgctactgagtggtcaatccgctggtatcgtctgtaccatggccggccaaatcgtttgtgagggacatatccattggaaattaaagccatggcaaagacggctagtcaccagagccatatccttgattccgtgcttagctatttctatttctattggtaaggaggctctttccaaagccttgaacgcatctcaagttgtactgtctattgttttacccttcttagttgcgccattaatctacttcacctgtaataagaagattatggagactgagattactgtgaaagatgcggaagaggatccttctgacaatgatgacatgcaactggagaatggccagaccagaaagactgtcagtatggcaaataattgggttgtctccataattgcatttgtagtttgggtattcttgtctgccttaaatatttatgccattgttcagctgggtattacacatggagaaatatcctaa

SEQ ID NO: 8742 - protein, 546 aa, Candida glabrata CBS 138
MSTSGAENGVGASRARKSTCTEANDTDKVGVKTISEVTDLQTIESSPSTCEEPMSNKDVIKAAFKKYIKFIGPGLLVSVAYIDPGNYSTATSAGAANQFSLLCVVLLSNFIAIFLQCLCIKLGSVTGMDLSRACRKHLPRWANWTVYFFAECAIIATDVAEVIGTAIALNILIKVPLPAGVCITLVDVLAIMATYRPGASSMKVVRMFELFVALLVVGVCICFAVELAYIPKSTSAAKVFRGFVPSRQMLEHNGVYTAISILGATVMPHSLFLGSALVQPRLLEYDVNHGNYSMLKDDEDEKNKETAVDERYQNYRPTRSAIKYCMKFSMIELGLTLFTLALFVNCAILIVAGSTLYGYPDAADADLYTIHDLLSKTLAPIAGTIFMLALLLSGQSAGIVCTMAGQIVCEGHIHWKLKPWQRRLVTRAISLIPCLAISISIGKEALSKALNASQVVLSIVLPFLVAPLIYFTCNKKIMETEITVKDAEEDPSDNDDMQLENGQTRKTVSMANNWVVSIIAFVVWVFLSALNIYAIVQLGITHGEIS

SEQ ID NO: 8743 - DNA, 1626 bp, Candida glabrata CBS 138
  CDS (1)..(1626)
atgccagtagcacgagaaagttcaagaaattctctatcacagatgtttctgcgagaagagagcgaggaactaccgatgatagctacatcatcaaggatgcaaaatctaattaggatcggtaagaaatatgcgcgatttattgggcctggcctcatggtatcagtctcatatatggatcccggtaattatagtacagcggtagcagccggttctgctcacaagtacaagctactgttttcgatgtttgtttctaacctcatggcgggatttctacaatgtttatgcgcgagattaggcgcagttacgggacttgatttggctcaaaattgtaagaagcatttaccatatggacttaacataacactttatattttagctgagatagcaatcattgcgacagatttagcagaagttgtgggaactgcgatctcactgaatattctattggggattccactacccatcggagttgttttgaccgttattgatgttcttatcgtgttaatggcgtacaagcccaatggggatctaaaacttataagatactttgaactctttgtctcctttttggttatttgtactgttatctgttttgcaattgagcttttttatgtcaaattgggtccagcttcggatattttcaagggatttttaccaagtaaagctgtcattgagggtgatgggttgtatttaagtttagccattttaggtgctactgcaatgcctcattccttgtatctgggttcaggggtggttcagccaagattgagagactatgatatcaagcacggttattactcaccagatgagctcgatattgataataaccatcaggattataagccttctcttgagtcagtacaagagacactacattacacagttgcagaattactagtttccttatttactatagctctttttgtgaactgcgcaatccttattgttagtggtgccactttatttgagactccccaggatgctgatattgctgatttattttctatctatgagttgttgtctaatactttatccaagagtgcaggtactatatttgcgttggctctgctattttcgggacaaagcgcgggtattgtttgtactttaagtggtcaaattgtgagtgagggttttttaaattggaccatagcacctgccttgagaaggtcgttgacaagagctgtagctataacaccttgtttaatattggtcatggtatctgggcgtagtgggctttcgaattctttatatgcttcgcaagttgtgttatcggttttactaccttttgtatcagcaccgctactatattttactagtaataagaacatcatgaggatagaaatgattgatagaaaacttcctgcaacttcaattttttctacaccaggcaatgtcgagcaaaacaagaagaaatacgggaaagtacgtcttgatgaagatgaggaagaggtcattcccttacaggatatggaaactgaaactgaaacagatcaaagtcaacatcaagatcaaaatatcgaatataaggatatgagcaatagcacgtttgtgaatatcctagcagttactgtttggctcctcatttctggcttaaacttgtacatgctaaagaacttagataagtga

SEQ ID NO: 8744 - protein, 541 aa, Candida glabrata CBS 138
MPVARESSRNSLSQMFLREESEELPMIATSSRMQNLIRIGKKYARFIGPGLMVSVSYMDPGNYSTAVAAGSAHKYKLLFSMFVSNLMAGFLQCLCARLGAVTGLDLAQNCKKHLPYGLNITLYILAEIAIIATDLAEVVGTAISLNILLGIPLPIGVVLTVIDVLIVLMAYKPNGDLKLIRYFELFVSFLVICTVICFAIELFYVKLGPASDIFKGFLPSKAVIEGDGLYLSLAILGATAMPHSLYLGSGVVQPRLRDYDIKHGYYSPDELDIDNNHQDYKPSLESVQETLHYTVAELLVSLFTIALFVNCAILIVSGATLFETPQDADIADLFSIYELLSNTLSKSAGTIFALALLFSGQSAGIVCTLSGQIVSEGFLNWTIAPALRRSLTRAVAITPCLILVMVSGRSGLSNSLYASQVVLSVLLPFVSAPLLYFTSNKNIMRIEMIDRKLPATSIFSTPGNVEQNKKKYGKVRLDEDEEEVIPLQDMETETETDQSQHQDQNIEYKDMSNSTFVNILAVTVWLLISGLNLYMLKNLDK

SEQ ID NO: 8745 - DNA, 1740 bp, Kluyveromyces lactis NRRL Y-1140
  CDS (1)..(1740)
atgccggaaaataagtttgaagtgaccgaggagtacttggatcctcaaagtatgcttgagctgtccatgcccggtggtgcctccaaactctctgttcgtcaaaagttgatattgaaatgcagaagggccatgaggatgagggatacggagaaaaaaggatcttcttcaactgacccagttcagagtcaatactcactgtcattgtcttccgccgaagataagaagagagggttttttggctccgtacaagacgtgttgagaaaatacatgagatttgttggaccgggtttgatggtctctgttgcctatatggatccaggtaattacgctactgacgttagtgctggtgcttctaacgagttctctttactttgtattgtgttggtttccaatattattgctatcttcttacaatctctatgtatcaaactaggttctgtgacgggattagatctttcaagggcttgcaagaagcacctgcccaaatggttgaatttgaccatttatgtgtttgcagaatgtgctatcattgcaacagatgttgctgaagttattggtactgcagttgcattgaatatcttgctaagaatcccattaccagcgggtgtggttattacctgtatcgatgtcttattcgttttgatcgcttacaagccaggttcttcatccatgagattcgtcagaatgttcgagtacgctgttgccctacttgtctttggtgttgttatctgcttctgtgttgagttggcttacattccaaaaactccagtgggacatattttcagaggttttgttccttctaaacaaatgtttgaacataacggtatgtacaccgctacctccattctcggtgccactgtcatgcctcattcactcttcttgggttctggtttagttcaaccaagattattagagtatgacgttgaccatggttactacgatttgttggcagaagaagatgaagacaatgtcattgaagaaaccgaagatactcactctgctgtaaaggaaaaggaagatatcgaagtcatcagggaaagaagatacttcaattatcaacccacaaatagtgctatcaagtatgccatgaaatattccatttttgaattggccatcactttgttcacctttgcattatttgttaacagtgctattttgatcgttgcaggtgccactttgtacggctccgaggaggctgtggatgccgacttgtacaccattcactctctactttctaagaatttggctccaattgctggtactgttttcatgttggccttgttatttagtggtcaatctgccggtattgtgtgcaccatcgcaggccaaattgtatgcgaaggtcatttggattggaacttcaaaccgtggaagagaagattgataacaagaggtatctctattattccatgtttgattatctccttaaccataggtaggagtgccctttccaaggctttaaatgcctcccaagttgttttatccattctattgccattcttggtcgctcccttgatcttcttcacttgtaaaaagtctatcatgaaagtcaaagtgaacaacaaagataaactgaacgctccaacggttatcggcgaggaagagcaacctgatgaatatattgacatgtccaacaactggatcactaccatcattgcatttttggtatggattttcatatccttgttgaacgtttacactatcgtgcaattaggtatttctcatggtgatatcagttga

SEQ ID NO: 8746 - protein, 579 aa, Kluyveromyces lactis NRRL Y-1140
MPENKFEVTEEYLDPQSMLELSMPGGASKLSVRQKLILKCRRAMRMRDTEKKGSSSTDPVQSQYSLSLSSAEDKKRGFFGSVQDVLRKYMRFVGPGLMVSVAYMDPGNYATDVSAGASNEFSLLCIVLVSNIIAIFLQSLCIKLGSVTGLDLSRACKKHLPKWLNLTIYVFAECAIIATDVAEVIGTAVALNILLRIPLPAGVVITCIDVLFVLIAYKPGSSSMRFVRMFEYAVALLVFGVVICFCVELAYIPKTPVGHIFRGFVPSKQMFEHNGMYTATSILGATVMPHSLFLGSGLVQPRLLEYDVDHGYYDLLAEEDEDNVIEETEDTHSAVKEKEDIEVIRERRYFNYQPTNSAIKYAMKYSIFELAITLFTFALFVNSAILIVAGATLYGSEEAVDADLYTIHSLLSKNLAPIAGTVFMLALLFSGQSAGIVCTIAGQIVCEGHLDWNFKPWKRRLITRGISIIPCLIISLTIGRSALSKALNASQVVLSILLPFLVAPLIFFTCKKSIMKVKVNNKDKLNAPTVIGEEEQPDEYIDMSNNWITTIIAFLVWIFISLLNVYTIVQLGISHGDIS

SEQ ID NO: 8747 - DNA, 1668 bp, Kluyveromyces lactis NRRL Y-1140
  CDS (1)..(1668)
atgtcttcttctcttcagtttaaaaaggttgcaggtagtgatgggtcttctgcatggaacaccaatgaccagcaatataatgcgttcgttcatgaaggagatactgatactccgacttacgttaaaacattccaaaactgcgttcgtatattgaagaagtatgccaggtttgtgggtcccggattaatggtttccgtttcatacatggacccggggaatttcagtaccgctgtggcagcaggttctgcgcacagatataaacttttattctctgttctggtcaccaatattctagcagcattttggcaatgcttatgtgctaagttaggtgccgtcaccggattagatttggctcaaaattgtaaaaaacatttacctccgaccctcaatttggttctatacgtgctagctgaagtggcgattattgctactgatcttgcggaagtggttggtacagcaatctccttgaacatccttttcaagatcccgttgccactaggtgtcattttaacagtagtggatgtcttggttgtgttattggcatacaagcctaatggatccttgaaacttgtacggtggttcgaagcctttgtttcgttactcgtgtttgcaacagtggtttgtttcgcaatcgagttattctccgtccacatcgactctgtaggtgaagtgtttaagggattcctaccgtcaaaagctgttttcgagagtgatggtttgtatctaagtttggcaattcttggagctacagttatgccccatagcttatacctcggatcaggtgttgttcaaccaagattaagggattacgacatcaaacagggacattacattccatcacaaaatgatgaagataataaccatgataattacaaaccttctatcgatgcaatccacgacacattaaattacacaatggctgaattattggtttcattatttactgttgccctatttgttaactgttcgatcctaattgtagctggtgccactctatacggggtaacttcaaacaatgcgcacgaagcagatcttttctccatctataatctattatcagaaactctttcaaagactgctggtacaatttttgtcttggccttactattctctgggcaatctgcaggtattgtgtgtactctaagtggacaaatggtctcggaaggattcttaaattggactgttgctccagcattaaggcgtgcattgacgcgtgttgttgctataacaccatgtttgattttagtattggtggccggtagaaacggtttatcaggggctctcaatgcctcacaggtggttctctcgttactattaccatttgtgagtgctccattgatttacttcactagtaataaaaacattatgagagttccttgggctatagattgttctcaagaaccgtcaaacttatttgcattacagaatttgtcttccagtaacttagccacagatgatgctaccgttattgctcatgatactgatgatgaggtggacgctcatctaattaattcccctgaacctctatcagatgagtctgttcattacaaagatttcagtaacagcattttcactacggttgttgctgtcattgtatggatcttcatctccggtttgaatttctatttactaatatcttttgctaacggtcaggacgtccatttgtag

SEQ ID NO: 8748 - protein, 555 aa, Kluyveromyces lactis NRRL Y-1140
MSSSLQFKKVAGSDGSSAWNTNDQQYNAFVHEGDTDTPTYVKTFQNCVRILKKYARFVGPGLMVSVSYMDPGNFSTAVAAGSAHRYKLLFSVLVTNILAAFWQCLCAKLGAVTGLDLAQNCKKHLPPTLNLVLYVLAEVAIIATDLAEVVGTAISLNILFKIPLPLGVILTVVDVLVVLLAYKPNGSLKLVRWFEAFVSLLVFATVVCFAIELFSVHIDSVGEVFKGFLPSKAVFESDGLYLSLAILGATVMPHSLYLGSGVVQPRLRDYDIKQGHYIPSQNDEDNNHDNYKPSIDAIHDTLNYTMAELLVSLFTVALFVNCSILIVAGATLYGVTSNNAHEADLFSIYNLLSETLSKTAGTIFVLALLFSGQSAGIVCTLSGQMVSEGFLNWTVAPALRRALTRVVAITPCLILVLVAGRNGLSGALNASQVVLSLLLPFVSAPLIYFTSNKNIMRVPWAIDCSQEPSNLFALQNLSSSNLATDDATVIAHDTDDEVDAHLINSPEPLSDESVHYKDFSNSIFTTVVAVIVWIFISGLNFYLLISFANGQDVHL

SEQ ID NO: 8749 - DNA, 1431 bp, Kluyveromyces lactis NRRL Y-1140
  CDS (1)..(1431)
atgcttatactatctcgtgtattcgagaggaaccatgttgaaattttgaggaagtttatgaagtttgtcggacctgggatcatggtcagtgttgcatacatggaccctgggaactattctactagtgtgtcaggtggtgcacaatttaaatacaaattgttgttcatcacattcatttcaaacatatttgcgattgtcttgcaatgcctctgcatcaagctaggtacaatcactggtttggatttagctgaaaactgccgtcgtcatttttcaaagcgtgttaattatattctatacgggtttgcagaagttgcaattatcgcaacagacttggcggaagtgattggtgctgccgttgcattaaatatcttgtttaacattcccttgttatggggtgtgctgttgaccgtttttgatgtgttgctgatacttctgttttacaggccagatgaacattccatgaaacgggtccgggcgttcgaaacttttgttgggattttagttggagcgacagttatttgtttcgctattgaattgttcaagatatccgtaccaagcaagttagaggtgttcaaaggcttcattccaaatcccatcatcttcaaagaacaacaagcgatgtatatctctttaggtattcttggtgctactgtgatgcctcattccttatttttgggttcctctctcgtaaaaccaagggttttcgattacgacttaaaaaaatacggtaaaattaaggaacaaccttcagtaggtgccattgagtacacgttgcgatattcgtacgctgaattgatagtgtcgttgtttttcatcgccactttcgtcaatgctgccattttaatagtcgctggtgcgactttatatgggcaacccgatgcagaggatgctgatttactctctatttatgaattattgtcccattatgtgtctccagctgctgggctcgtatttgcattggcaatgctctttagtggtcaatcagcaggtgtcatttgtaccatggcaggtcaaattgtatcagaagggtttttagagtggtcacttgaaccttgggtgactcgtctattgacaaggttgatagccatcgtaccctgtttcttagttacggctttcttgggagaaaagggggtatctagtattctaaacttgagtcaagtggttctctcattgattttaccaatcgtttctgctcctttgatttacttcactatgaatcataaaattatgaccgttgtggatgtggattctgcacccgcatctgcagacagtactgaagaaagtagattattatcgaaaggcgttaagtccattgactacaccaatggaagactgttgagcatcagttcatttgttatatggttgacaattggttcattgaattgttatcttgtattttcatacctcatgggagcggacgtgcatttttaa

SEQ ID NO: 8750 - protein, 476 aa, Kluyveromyces lactis NRRL Y-1140
MLILSRVFERNHVEILRKFMKFVGPGIMVSVAYMDPGNYSTSVSGGAQFKYKLLFITFISNIFAIVLQCLCIKLGTITGLDLAENCRRHFSKRVNYILYGFAEVAIIATDLAEVIGAAVALNILFNIPLLWGVLLTVFDVLLILLFYRPDEHSMKRVRAFETFVGILVGATVICFAIELFKISVPSKLEVFKGFIPNPIIFKEQQAMYISLGILGATVMPHSLFLGSSLVKPRVFDYDLKKYGKIKEQPSVGAIEYTLRYSYAELIVSLFFIATFVNAAILIVAGATLYGQPDAEDADLLSIYELLSHYVSPAAGLVFALAMLFSGQSAGVICTMAGQIVSEGFLEWSLEPWVTRLLTRLIAIVPCFLVTAFLGEKGVSSILNLSQVVLSLILPIVSAPLIYFTMNHKIMTVVDVDSAPASADSTEESRLLSKGVKSIDYTNGRLLSISSFVIWLTIGSLNCYLVFSYLMGADVHF

SEQ ID NO: 8751 - DNA, 1986 bp, Debaryomyces hansenii CBS767
  CDS (1)..(1986)
atgaatagtttgacgagaggtggtaacagcattaaaaggctatttggtgatgcatattcgatattgagaaaatactccagattcataggacccgggttaatggtttctgtggcatacatggatccagggaattattctactgctgtggctgctggttcagctttcaagtataaattgcttttcctgatattgctttcgaactgcttggcggtgtttttacagatattgtcagccaagttgggggcggtaacaggattggatttggcggccaattgcaaagccaatttatcgtttagagttaacatattcatttactgcttagcagaactagctatcattgctacagacttagctgaagttgtggggactgcaatttcgttaaatattttgttcgatttaccgttgttagcgggggtaatagtgacagtcgttgatgtattgattgtgttgatggcatataaaccaaatggtccgcttatattcgtgagaatttttgaatcgtttgtttcagttttagtcggagcgacggtagtctgctttgcaattgagttataccaagtgtctcatgaagaaggcattaatttttcaacctgggaagtcataaagggtttcatgccaaatgagaaagtggtggatatgagcgatcgtgatggaggaaatgggttgtatttgagtttggcaattttgggtgcaacggttatgccgcattccttgtatttaggatcaggattagtccaagcgagattaaaggactatgatattaaacatggacattacaagcctttaacagatgaaccatccaactcggaagaaagtgctgatcccgaacataacgacgagtttgaaaggaatgaacatcctgatcaatgcacaactaatccgttcgaaaaggatgaagacgaggatgaaaatgatcattataggccatcgatacactcgattaatgatacaatgacctatactatagttgaattagtgatttcattatttaccgtggccttatttgttaattcggctatattgatagttgctggtgcaacacttaacaataacaaacataaaagagacgacgaccacgacggtaatgacacagatgatagtgacgatgaagatgattaccaaaatgctgatttattcacgatttacaatttattatccacacacttatctccaaccgcaggatttgtatttgctctcgcattgctttgctcaggtcaaagtgcaggtgttgtgtgtacattagcgggtcaaatggtactggaaggcttcttgctgtggagtttgcccccaattacaagaagactaatcaccagaggattagctattattccttgtttagtagttgttaccttagcgggccgtgaagggttgtctaacgttttgaatatgagtcaagtcgtgttggcgatcttgttaccagttgtcagtgctccattgatttggtttacttgttctaaggaaatcatgaaagtacctattttcgtcagggatggggatgaagaggttgatatcatgttagatgacgacatggatagcagtatttcgagaacaatcactaccagcagcgcggccaccttaacaaacggtaaagtaaagagattcaagagtactgagccagcaattagattgcaagatttgagaaattcccacccgtgcgcagggtgggacgacgatgaagcagaagcgtccgaagaacaacaacgattgattaatcacaataacgacagcgatagtgagataactacaagccttggtgcaaacgaattccagtatggccaacatcgtagaaatatttcagcaggaagtgatacttatgccaacactataattgaatcagaagaggacacataccgtgttaagggttacaaggatatgagtaatggaccggttactgcatttacggctgttttagtatggggttttatcacttgtttaaacatatatttattaggaagtttgatattaggatatgatgttccactttga

SEQ ID NO: 8752 - protein, 661 aa, Debaryomyces hansenii CBS767
MNSLTRGGNSIKRLFGDAYSILRKYSRFIGPGLMVSVAYMDPGNYSTAVAAGSAFKYKLLFLILLSNCLAVFLQILSAKLGAVTGLDLAANCKANLSFRVNIFIYCLAELAIIATDLAEVVGTAISLNILFDLPLLAGVIVTVVDVLIVLMAYKPNGPLIFVRIFESFVSVLVGATVVCFAIELYQVSHEEGINFSTWEVIKGFMPNEKVVDMSDRDGGNGLYLSLAILGATVMPHSLYLGSGLVQARLKDYDIKHGHYKPLTDEPSNSEESADPEHNDEFERNEHPDQCTTNPFEKDEDEDENDHYRPSIHSINDTMTYTIVELVISLFTVALFVNSAILIVAGATLNNNKHKRDDDHDGNDTDDSDDEDDYQNADLFTIYNLLSTHLSPTAGFVFALALLCSGQSAGVVCTLAGQMVLEGFLLWSLPPITRRLITRGLAIIPCLVVVTLAGREGLSNVLNMSQVVLAILLPVVSAPLIWFTCSKEIMKVPIFVRDGDEEVDIMLDDDMDSSISRTITTSSAATLTNGKVKRFKSTEPAIRLQDLRNSHPCAGWDDDEAEASEEQQRLINHNNDSDSEITTSLGANEFQYGQHRRNISAGSDTYANTIIESEEDTYRVKGYKDMSNGPVTAFTAVLVWGFITCLNIYLLGSLILGYDVPL

SEQ ID NO: 8753 - DNA, 1557 bp, Debaryomyces hansenii CBS767
  CDS (1)..(1557)
atgattgacaatgatatattccaatcaaaaattcagagaagcggtcaaataataaggaaatatgcatcatttattgggccaggaattatggtttctgttgcatacatggacccaggaaactattctaccgcggtttcatcaggagcaatgtatgagtataagttgttgttcataatatttatgtcgaatttgtttgcagtggttttgcaatgtttgtgtgtgaaattgggaacagtaacgggtcttgatttagcggaaatgtgtcgtatgaacttgccatatgcattgaatttgtcgttgtacgcttgtgcagaattggctattatagctaccgatttggcggaggtggtaggaacagccattgctttagaaatattgttcaatattccattggtgtatggtgttcttattacggtaattgacgtattgattgtgttaatggcgtatcataaagatggtaccatgagacaaacaaggctttttgaaattatggtgacagtgttagtgttggcaacctgtatgtgttttattctagaattattcaaatgtgattttgaggaaggtgctgtgggttctataatcaaaggatttttgccaatgaatatggaaatatttagagaaaagaatgcacttttcttgagttgtggaatagtcggaagtacagttatgcctcattcattattcttgggctctgccttggttcaatcaaggctcaaagaatacgatattcaaaatggaattctcattgaacaagacgaagtcgatggagaattgatagatgtacagcctgaactccctgctacgacgagcaaatttagaagcatttcggatggtagtagtttggctggtaaatataggccgtcatatcgtgctatccaatattgcttgaactattcctacatagaattggttttatcgctctttttgattgccgttttcgtcaattctgccatcttgattgttgctggcagtaccttgtatggcaagcctgatgcggaagatgcagatttgttatccatatatgagatgttgtcgtattatatatcaccagcagcgggcttaatatttgcattgtctatgttgtttgcaggtcagagtgcaggtattgtctgtactatggcaggccagattgtttctgaaggttttatcaactggacaattaaaccttggattagacgtataattacacgtatcctagctataattcctgtgttggttgttattattatattaggtcgtgaagggatctccaagataatgaactcgtcacaagttgttttgagctttattctaccagttgttagtgcacctttaatttggtttacttgtaaaaaggaatttatggttgtttatgacacgagtgatctgaaccagcttgctaatgagaatacggctcttttaaatactgatgaatcatacccacaatctgtacatgttagaaagataacgtttgaaaatggtcatttcttgactatagctgcaggcttaacatggttaattatctcgtttttgaacctttacttgatttatgcatttgcaaacggtgcagatatatag

SEQ ID NO: 8754 - protein, 518 aa, Debaryomyces hansenii CBS767
MIDNDIFQSKIQRSGQIIRKYASFIGPGIMVSVAYMDPGNYSTAVSSGAMYEYKLLFIIFMSNLFAVVLQCLCVKLGTVTGLDLAEMCRMNLPYALNLSLYACAELAIIATDLAEVVGTAIALEILFNIPLVYGVLITVIDVLIVLMAYHKDGTMRQTRLFEIMVTVLVLATCMCFILELFKCDFEEGAVGSIIKGFLPMNMEIFREKNALFLSCGIVGSTVMPHSLFLGSALVQSRLKEYDIQNGILIEQDEVDGELIDVQPELPATTSKFRSISDGSSLAGKYRPSYRAIQYCLNYSYIELVLSLFLIAVFVNSAILIVAGSTLYGKPDAEDADLLSIYEMLSYYISPAAGLIFALSMLFAGQSAGIVCTMAGQIVSEGFINWTIKPWIRRIITRILAIIPVLVVIIILGREGISKIMNSSQVVLSFILPVVSAPLIWFTCKKEFMVVYDTSDLNQLANENTALLNTDESYPQSVHVRKITFENGHFLTIAAGLTWLIISFLNLYLIYAFANGADI

SEQ ID NO: 8755 - DNA, 1710 bp, Yarrowia lipolytica CLIB122
  CDS (1)..(1710)
atgaattgtccgaccaaagacaccgacaagacctgggctcggcccgggtacaaccagaacccccgacgattcgactccaatctcatttctaacgtgtttttcagctctggtaacgtgcccaaacctgcgacaggttgcgatgacgaagacggagggaaagggatacccttggacgcgattgaggaacgcagtgtcaatgagaacggcagtggaggatctgaggggcccaaggaccaagtgattaatcacgcgtgtccttccgctcctccccctcccccccttgctcctactgtgcttcagaccatccagatggcgtttctgaaatacgtgcgtttcctgggtccaggtctcatggtttctgtggcgtacatggatcctggaaactattccacggccgttgctggtggtgccaaccatcaattcgccctactctttgtcatcttgctgtcttctatcattgctcttgtgctccagtctctggccatcaagctgggatccgtcaccggtatggacctggcaagatgttgccgagaatacctacccaaatggatgtcaataactctttacatttttgcagagattgccattgttgctactgatatcgctgaggtcattggtactgccattgctctagatatcctgcttcacattcccctgatcgcaggggtctgtatgaccattgttgatgttctgatcgtgttgtttgcctacagacctggtggaggaatgcgagtggtccggttctttgagtatgctgttgctgctctcgttctgggtgtctccatctgctttattatccttctctgtcgaatcccccaccagtcagtccgaaagatcttccgcgggtttgctcccagtcgagcactgattcaaggaacgggtattgttgactcagcaggtattttgggagctacagtcatgcctcattctctgttccttggctcaggactcgtccagcctcgccttcgagaatgggacgtggctaacggaactgcccctgctccagacagctcaaaggactccgaagaagagtactttgcctataagccaacaatcggggccattaagtactgtctaaagtactccatcatcgagctggtaaccactctgttcaccctggctctgtttgtcaactcggctatcctcattgtgagtggagccactctgtacggaaacagtgatgcttccacagccgatctgtacggaatccactcacttctcagacagtacatttccaagggcgcaggcaccattttcatgttggctctccttttgtctggtcagtcagcaggcatcgtgtgcaccattgctggccaaatggtgtctgagggctttctgagatggacaattcgaccttggctaagacgaataatcactagatccatcgcggtcgttccctgtgtggttgtagctgctgctgtcggcaaggagggtctcaattcagccctcaactactcccaggtggctctgaccctgctgctcccattcctcaccttccctctcatctactttacaaactccaaaaagctcatgaaggtcgccagagatcccagtgtgacagccgacgacgcttccgagaccacagttctagcccaatggctcgactactccaaccactgggtgttggccattgtgtgctgggctctttggctcttcattgccattctcaacgtctacctgattgtccagctgggtatgggtaattactag

SEQ ID NO: 8756 - protein, 569 aa, Yarrowia lipolytica CLIB122
MNCPTKDTDKTWARPGYNQNPRRFDSNLISNVFFSSGNVPKPATGCDDEDGGKGIPLDAIEERSVNENGSGGSEGPKDQVINHACPSAPPPPPLAPTVLQTIQMAFLKYVRFLGPGLMVSVAYMDPGNYSTAVAGGANHQFALLFVILLSSIIALVLQSLAIKLGSVTGMDLARCCREYLPKWMSITLYIFAEIAIVATDIAEVIGTAIALDILLHIPLIAGVCMTIVDVLIVLFAYRPGGGMRVVRFFEYAVAALVLGVSICFIILLCRIPHQSVRKIFRGFAPSRALIQGTGIVDSAGILGATVMPHSLFLGSGLVQPRLREWDVANGTAPAPDSSKDSEEEYFAYKPTIGAIKYCLKYSIIELVTTLFTLALFVNSAILIVSGATLYGNSDASTADLYGIHSLLRQYISKGAGTIFMLALLLSGQSAGIVCTIAGQMVSEGFLRWTIRPWLRRIITRSIAVVPCVVVAAAVGKEGLNSALNYSQVALTLLLPFLTFPLIYFTNSKKLMKVARDPSVTADDASETTVLAQWLDYSNHWVLAIVCWALWLFIAILNVYLIVQLGMGNY

SEQ ID NO: 8757 - DNA, 1914 bp, Yarrowia lipolytica CLIB122
  CDS (1)..(1914)
atgaactgcccaactcgtgatcccgaccctaagggcgtgcctggcttcaaccagcagccgccacagttcgacaacgagctcaacaacaacaaatcgttcaacaagaacaactccggagccgagtccggcaagaagctgagcgccaagggcctcgcaaacgccatgggagactccgacctagccggaggccaaaatacgcgctcggcttcacgcccctccaggcgctcccgcccgggtcaccagaataggggcctgagtgagagctcgctcggcattcagttgagacgatccacctcgtctctcaacaacatgtctgacaacagctctaactctgacgactccaacgagtcgactcccctcaccgcatccggatcagccgaccccaacaaaaagcccctgtcaacctggggcaatatgatgcggattctgtccaagtacggcaagtttgtgggaccaggaatcatggtctccgtggcgtacatggaccccggtaactactccacggccgtgtccgccggagctatgtaccaatataagctgctgttcatcatttttgtcagcaacctctttgccgtcttcctgcaggtgctgtgtgtgaagctcggatctgtcactggtcttgatttggctgaaaactgcagacagcaccttcctccttggctctctgtctccatttacgtcatggctgaaattgcgattatcgccactgatctcgctgaagtcgttggtactgccatttccctcaacattctctttggtctccctctcttcatgggtgttctggtcaccgtggttgatgtcctcattgtgctcatggcctaccgacccaacggccccatgcgcattgtgcggtactttgagtacggcgtggctggtcttgtcgccgtggtagttgtctgttttgcctttgagctcgctgcgctcgacaacctcgacattcctctcgtgcttgaaggcttcctcccatccaaggagttgctcgaaaccaacggcctatacctctcctgtggtattctcggagccactgtcatgccccactctctgtacctgggttctggtcttgttcagcctcgtctccgtgaatatgacgaggacaacggatacgccattcccgaagatgctcgatttggagacgatgacgaggacctgaagtacaagccctctatccacgcaatcaagtacgcgatgaagtactctattgccgagctggtaatctctctcttcacagttgccatcttcatcaactccgccattcttattgtggctggttccaccctgaacgggtctcccgacgcctacgacgctgacctcttctccatctacgacatgctacgaacaattctgtcgcctgctgctggtacagtgtttgctctggctcttctggcctctggacagtctgctggtattgtctgcactctttctggccagatggtgtctgagggtttcctgcgatggtctttcaagccctggattcgacggctcatcacccgatccatcgcaattgttccctgtctgtttgtgaccttatttgtcggccgaaaaggtctggcggacgtgctgaacgcctcccaggttgttctctccctgctgctgcccatggtatctgctcctctaatctacttcaccggttcgaagaagatcatgaaggtagctgccaacgctgctgtcgtccacacccgacctcgaagcaactccaacggtactctcactcctgctgaccgatccagcaatggatacggcatggtcgaagacgaggcctctactgacgacgagtccatctgcattcccgagtacgtcgacatgagcaactcagccaccactcagttcatcgcctacctagtgtttggtatggtctctgctcttaacttgtttttgatcatctctattgccatgggtgctgacgttcctctataa

SEQ ID NO: 8758 - protein, 637 aa, Yarrowia lipolytica CLIB122
MNCPTRDPDPKGVPGFNQQPPQFDNELNNNKSFNKNNSGAESGKKLSAKGLANAMGDSDLAGGQNTRSASRPSRRSRPGHQNRGLSESSLGIQLRRSTSSLNNMSDNSSNSDDSNESTPLTASGSADPNKKPLSTWGNMMRILSKYGKFVGPGIMVSVAYMDPGNYSTAVSAGAMYQYKLLFIIFVSNLFAVFLQVLCVKLGSVTGLDLAENCRQHLPPWLSVSIYVMAEIAIIATDLAEVVGTAISLNILFGLPLFMGVLVTVVDVLIVLMAYRPNGPMRIVRYFEYGVAGLVAVVVVCFAFELAALDNLDIPLVLEGFLPSKELLETNGLYLSCGILGATVMPHSLYLGSGLVQPRLREYDEDNGYAIPEDARFGDDDEDLKYKPSIHAIKYAMKYSIAELVISLFTVAIFINSAILIVAGSTLNGSPDAYDADLFSIYDMLRTILSPAAGTVFALALLASGQSAGIVCTLSGQMVSEGFLRWSFKPWIRRLITRSIAIVPCLFVTLFVGRKGLADVLNASQVVLSLLLPMVSAPLIYFTGSKKIMKVAANAAVVHTRPRSNSNGTLTPADRSSNGYGMVEDEASTDDESICIPEYVDMSNSATTQFIAYLVFGMVSALNLFLIISIAMGADVPL

SEQ ID NO: 8759 - DNA, 1794 bp, Aspergillus nidulans FGSC A4
  CDS (1)..(1794)
atgaactgcccctcgcgaaccgacgacaccctggggcatccaggctggaaccagaacccgccgcctctgaacgccgacgcaacaacccgggaggacttcaatggaatggccaattccaaggtccgcagaggacatatatccggcctgggcgaaggaggcggcatctcagtgctagaaagcccggtcccagtccccaatagtagggacgagtcggccctcaaggcgggcgcagccggcggggcggtctctgcatactccaggcaccagcctgagagaaacagtgattcgcctcgccgttcttttccagcctttccgcatatctcttccattccagctcgcgtctcccagagcctcctcaagttcgcccgtttcgtcgggccaggttttcttgttgctgtcgcctatatcgacccaggaaactatgccaccgatgttgcagccggtgcggactttcgatacgcgctcctctttatcgtcctcctgtcgaacctgttcgcgatcttcctgcagtcgctatgtataaagcttgggacagtgacagggttgaacctcgcggagaattgcagggagcatcttcccaaatggttgacgatcatcctgtatatcttcgctgaggcagctattgttgcaacggatatagcagaggtcgtgggctctgcaatctccctcaacctcctccttaatatcccacttgttgcgggctgcgccatcaccctggcagatgttctctttatcctgatcttctacagaccgaatggctcaatgtggggtctgcggctgtttgagttctttgtcatggccttggtgctgggagtagtcatatgcttctgcatccagctatctctcatcaaagagcagtcgatcggagacgtgttccgcggctacctcccgtccccggccgtagttcaatctaatgggttataccaaagctgcggcatcctcggcgcaactgtcatgccccactccatgttcttaggcagtggtattgtacaggcccgcctcaaagaattcgacgtcatctccggctacgccgacccaaccgtctgcattggcagtacaaacggtgaagtcgagtaccgcccatctctccgtgcaattcgcggctgcatgaaatactcaatcattgagctcgctctgtccctattcaccttcgcactctttgtgaatagctccatcctcattgttgctggtgcttccctctacaacaccccctctgcaacagacgacgcagacctcttcggtatctacaaccttttatcgtcttccatctccaaagcggcggggacggtcttcgcactggcccttctcctttccggtctttctgccggcattgtctgcaccatggccggacaaatggtgtccgaggggatgctcaactggagtattcgcccttggctccgtaggctcatcacccgttctatcagcatcatccccagtattgtgattgctggggcggtggggaaggaaggccttaataagacgcttacagctagccaggtcgtgctcagcgttatactaccctttgtcagcgcgccgcttgtttattttacttgccgcaaccggtacatgactgtgcccatggagcgggtacatgatgcagatgcagatatagatacagacgagcagacccagcctcagaacgccgcagaaggtgacgacaacggtggcagtgctaccgacggcgtcaaaatgggcaatggacttcttgtttctgctatagccgtcttggtctgggtcattatcgcggtcatgaatgtggccttgcttgtccttgtagggatgggcaaggcttaa

SEQ ID NO: 8760 - protein, 597 aa, Aspergillus nidulans FGSC A4
MNCPSRTDDTLGHPGWNQNPPPLNADATTREDFNGMANSKVRRGHISGLGEGGGISVLESPVPVPNSRDESALKAGAAGGAVSAYSRHQPERNSDSPRRSFPAFPHISSIPARVSQSLLKFARFVGPGFLVAVAYIDPGNYATDVAAGADFRYALLFIVLLSNLFAIFLQSLCIKLGTVTGLNLAENCREHLPKWLTIILYIFAEAAIVATDIAEVVGSAISLNLLLNIPLVAGCAITLADVLFILIFYRPNGSMWGLRLFEFFVMALVLGVVICFCIQLSLIKEQSIGDVFRGYLPSPAVVQSNGLYQSCGILGATVMPHSMFLGSGIVQARLKEFDVISGYADPTVCIGSTNGEVEYRPSLRAIRGCMKYSIIELALSLFTFALFVNSSILIVAGASLYNTPSATDDADLFGIYNLLSSSISKAAGTVFALALLLSGLSAGIVCTMAGQMVSEGMLNWSIRPWLRRLITRSISIIPSIVIAGAVGKEGLNKTLTASQVVLSVILPFVSAPLVYFTCRNRYMTVPMERVHDADADIDTDEQTQPQNAAEGDDNGGSATDGVKMGNGLLVSAIAVLVWVIIAVMNVALLVLVGMGKA

SEQ ID NO: 8761 - DNA, 1755 bp, Candida albicans SC5314
  CDS (1)..(1755): transl_table=12
atgacaactacttcttcctcaacaaacgagtctataagaccgaaaaataaccatacaaccatttccacaactggagtttctacaacattagatcaaactactactactcgttttagaaataattatgacgacaataacaacaatagcgttattagtaaagacagctccacatttgcatatgtcgtgaacagatccaagagtgtacttaaaaaatacggatcatttgttggtccaggaatgttgatcagtgttgcctatatggatcctggtaattatgcaacagggattactgcaggggcatcaaatgaatattctttattgttcattgtgtttttatctaatgttattgccatatttttacaaagtctctgtataaaattaggttcagtaacaggttatgatttggctcgttgttgtcgagaatatttacctaaacaactaaactgggtcttgtggtttttagctgaatgtgccatcattgctactgatgtagctgaagtcattgggtcggccattgctttgaacattttgttgaagattccgttacctgccggggtagtaatcactattattgatgtgttgtttgttcttatggcatatcgtgctgatacttcgctgatgaagtttgttaaaatttttgaatatgccgtgggtgcattggttatggttgttgttgtttgttttgccgttgaattatcacaaattcatgctagtgcaagagatattttccgtggatttgttccttcgaaacaaatgtttgatggtaatgggatgaccattgcaacttctatcattgggtctacagtgatgatccattcgttgtttttgggttcaggattagttcaaccccgtttacgtgactttgacgttaaacatggatatgtgaatttggatgatattctcaacaaaaatgaccaaccacaatttccagttattgaatcatcaacaactacaccatctgagaaaaaagatgacgcaaagaataatgtcaaagtatcaatgtatgaaaaagaagctgattatttttatcattattataaaccatcctatcaatcaattaaatattccttaaagtattccatagtggaattaactatcactttgatcacattagcccttttcgtcaattcagcaattttaatagtctcagggtcaacattatacggtaccgaagaagccatagatgccgatttatacactattcatgatttattgagtcgttcattagcaccagcagtcggtactattttcatggtagcattattggccagtggtcaaagtgctggtatagtatgcactattgctggacaaattgttagtgaaggacatatcaattggactttaaaaccatggcttagaagattggtgacaagaagtatatctattattccttgtttgattatatctgtttgtattggaagaaatggattgggtatagctttaaatatttctcaagtggtgatatccattttattacctccattgactgctcctttgatttatttcacttgttcgaaaaaaatcatgaaagtggaattgaatgaaaatgatgaagctattggtgtcacaggacaagaagaagaagtagaagacgaagagtcgaatgatcaagacacaaatggctctagaaagaaatataaatatatgaccaataattggattacttcaattgttgctgttattatttggtttttcgtttccacattgaatgtttatgccatttacgaaatggcaaagaacggtgtatctggataa

SEQ ID NO: 8762 - protein, 584 aa, Candida albicans SC5314
MTTTSSSTNESIRPKNNHTTISTTGVSTTLDQTTTTRFRNNYDDNNNNSVISKDSSTFAYVVNRSKSVLKKYGSFVGPGMLISVAYMDPGNYATGITAGASNEYSLLFIVFLSNVIAIFLQSLCIKLGSVTGYDLARCCREYLPKQLNWVLWFLAECAIIATDVAEVIGSAIALNILLKIPLPAGVVITIIDVLFVLMAYRADTSSMKFVKIFEYAVGALVMVVVVCFAVELSQIHASARDIFRGFVPSKQMFDGNGMTIATSIIGSTVMIHSLFLGSGLVQPRLRDFDVKHGYVNLDDILNKNDQPQFPVIESSTTTPSEKKDDAKNNVKVSMYEKEADYFYHYYKPSYQSIKYSLKYSIVELTITLITLALFVNSAILIVSGSTLYGTEEAIDADLYTIHDLLSRSLAPAVGTIFMVALLASGQSAGIVCTIAGQIVSEGHINWTLKPWLRRLVTRSISIIPCLIISVCIGRNGLGIALNISQVVISILLPPLTAPLIYFTCSKKIMKVELNENDEAIGVTGQEEEVEDEESNDQDTNGSRKKYKYMTNNWITSIVAVIIWFFVSTLNVYAIYEMAKNGVSG

SEQ ID NO: 8763 - DNA, 1545 bp, Candida albicans SC5314
  CDS (1)..(1545): transl_table=12
atgaatcaacaacaacaacaaccactactaaaacgagttgctcattctgtgaaaaaatatgccacgtttataggcccaggtttagtggtcagtgtgagttatatggatccaggaaactatctgacatcagtatcatcaggatcgatgtaccaatataaattatgtttcattattttcatggccaatttgtttgctatcattttgcaagccttgtgtgtcaaattggggaccatcacaggtttagatttagcagaaatgtgccgattacatttaaacccaaagttgaaccttttcatgtatttctgtgctgaaatcgccattatagccaccgatttggccgaggttgttggaaccgcgatttcgttggagattttatttgggattcctttattatatggggttgtaattaccgttttggatgttttaattattttaatggcatatcacaaggatggaagcatgaaacagaccaaattctttgaaatattggtatcaatattggtggctgccacgtgtgtttgctttattttagaactttttaaatgtaactttgagccgggatctggctggaaaatatttaaaggatttttaccggtcaataaagaaatattcaaggagtcgatggcgttgtttttgagttgtgcgattgttggtctgacagtcatgcctcattccttgtttttaggctccgcattggttcaaccaagattgaaggaatatgatgagacacatggcaccaaagcaaatgttttgcccgttgaaaatgaagacaccacgagattggtgccacctcatcaaccagtagaagggtcgagattacgcagaatctccgatgggtcattattgacaaacaagtataaaccctcgtatgcagcaatcaagtattgtttgaattactcgtatgttgaattggttctgtcgttgtttattgttgctgtgtttgtgaactcggcaattttgattgttgccgggtctactttgtatggcaaaccagatgcagccgatgccgacttgttgtcaatttatgaaatgttgtcctattatatctcacccgctgctgggttggtttttgcattgtcaatgttgttttcgggacaaagtgctggtattgtatgcactatggcagggcaaattatcagtgaagggtttatcaattggacattagaaccttggaagagaagaatcataaccagagtattggcaattgttccagttatagtggttgttggaatcttgggtagagagggtgtttcaaaagtaatgaactcttcccaagttgtattgagtttcattttaccaattgtcagtgcaccattaatttatttcacttccaaaaaagaattcatgacggtgatagatacatctctgacagacgagtctaccccacttttagaagaaaatgatcttgatgaacaaattccagtgaaaaaaatcagttttgaaaacggtagtctacttcgtaatgctagtattctcacctgggttatcattacaggtttgaatgtctatttaattattgcatttgccaatggggctgatatttaa

SEQ ID NO: 8764 - protein, 514 aa, Candida albicans SC5314
MNQQQQQPLLKRVAHSVKKYATFIGPGLVVSVSYMDPGNYSTSVSSGSMYQYKLCFIIFMANLFAIILQALCVKLGTITGLDLAEMCRLHLNPKLNLFMYFCAEIAIIATDLAEVVGTAISLEILFGIPLLYGVVITVLDVLIILMAYHKDGSMKQTKFFEILVSILVAATCVCFILELFKCNFEPGSGWKIFKGFLPVNKEIFKESMALFLSCAIVGSTVMPHSLFLGSALVQPRLKEYDETHGTKANVLPVENEDTTRLVPPHQPVEGSRLRRISDGSLLTNKYKPSYAAIKYCLNYSYVELVSSLFIVAVFVNSAILIVAGSTLYGKPDAADADLLSIYEMLSYYISPAAGLVFALSMLFSGQSAGIVCTMAGQIISEGFINWTLEPWKRRIITRVLAIVPVIVVVGILGREGVSKVMNSSQVVLSFILPIVSAPLIYFTSKKEFMTVIDTSSTDESTPLLEENDLDEQIPVKKISFENGSLLRNASILTWVIITGLNVYLIIAFANGADI

SEQ ID NO: 8765 - DNA, 2016 bp, Candida albicans SC5314
  CDS (1)..(2016): transl_table=12
atgggtttcctaacgaatttcacaaacttcaagaccatcgtggcaagtataaaaaaatacatgcgatttattggaccggggctaatggtgagtgtggcatatatggatcccgggaattattcaactgccgtagcagctggctctgcttataagtacaatttattatttctgattctattgtccaactgtttagctattttcctacaaatattagctgccaaattgggtgctgtgacggggttggatttagcagcaaattgtaaagctcattttggttataaaacaaacttgatactttatgcccttactgaaatagctatcatagcaacagatttagccgaagtggtggggacggctattgcattaaatattttatttcatttaccgttatttgtcggtgtgatagtcacagttattgatgtgctcattgtactaatggcataccgtccaagaggtccacttttgttcatacggatctttgaatcatttgtatcggtattggtagcagctaccgttgtatgctttgggattgaattgtatcaagtgagtcatgattcatcaatacatttttctgtagcagaggttatgaaaggtttcttaccaaatgaagatgtagttgatatgtctgatagagaaggcggtaatggtttatttttaagtttggccattttgggtgcaacagtgatgccacattcgttgtatcttggttctgggttagttcaagcaagattgaaagattatgatataaaaaatggattccacaagccgtggggtaagcactctatagaagaacctatacaagaagatattacagttcatgaagaggatgataatttaacaccgatagcgacacctttaatacaacaccaggaacaaccaggttttgaaaaagatgatgaaagcacatttgatggagatgatgaagaagacgatcattacaggccctcaatccatgccatcaaggatactatgagttacaccattgttgaattggtgatatcattattcacagtagccctttttgttaatgctgctattttgattgttgccggtgccacattaagaagtggcgattcaaaatttgctcgagatgatgacaacggacacgagtcagattctgattccgatgacgattatcaaaatgccgacttattcactatttatcatttattgtccaagcatttgtcaccaactgctggatttgtatttgcattagcattattgtgttctggtcaaagtgcaggggttgtttgtactttagctggtcaaatggtgtctgaagggtttttatcatggagtttaccaccagttaccagaagattgattacaagagctttagctattgctccttgtcttcttgttgttagtttttctggtagagaaggattggctaagattttgaatgctagtcaggtggtgttgtcaattttattaccagtggtaagtgctccacttatttggttcacttgcaacaaacataccatgagagttcctatttttgtcagagatggcgatgaagagattgatatggaatatgatggagaacagtcgaccctggttgccacctcaaggttcaaaagttcagagccagcaataaggttacaaaatttacgtaattcacatccttgtgctaattgggaagacgacgacgatgaacaattacaacaactccatttgcaaaatgaagagaatagattgttgattggtgaaaataccactaatttggtttattcactgccaccaacatcgaatttaatgtctcgctcaaactcggtttctgccactaatggtgtaccagatagtctgtcgtcgtcttcttccactaccattgctgcacaacttccattagaagtatatgaagatcttaatcaagatatttttcgaatcaagggatataaagacttcagcaatagtttggctacgtcttttgtggcggtattggtttgggtatttgttgcctctttgaatttatacttgatcggaagcatgcttcttggttatgatgtaccattatag

SEQ ID NO: 8766 - protein, 671 aa, Candida albicans SC5314
MGFLTNFTNFKTIVASIKKYMRFIGPGLMVSVAYMDPGNYSTAVAAGSAYKYNLLFSILLSNCLAIFLQILAAKLGAVTGLDLAANCKAHFGYKTNLILYALTEIAIIATDLAEVVGTAIALNILFHLPLFVGVIVTVIDVLIVLMAYRPRGPLLFIRIFESFVSVLVAATVVCFGIELYQVSHDSSIHFSVAEVMKGFLPNEDVVDMSDREGGNGLFLSLAILGATVMPHSLYLGSGLVQARLKDYDIKNGFHKPWGKHSIEEPIQEDITVHEEDDNLTPIATPLIQHQEQPGFEKDDESTFDGDDEEDDHYRPSIHAIKDTMSYTIVELVISLFTVALFVNAAILIVAGATLRSGDSKFARDDDNGHESDSDSDDDYQNADLFTIYHLLSKHLSPTAGFVFALALLCSGQSAGVVCTLAGQMVSEGFLSWSLPPVTRRLITRALAIAPCLLVVSFSGREGLAKILNASQVVLSILLPVVSAPLIWFTCNKHTMRVPIFVRDGDEEIDMEYDGEQSTSVATSRFKSSEPAIRLQNLRNSHPCANWEDDDDEQLQQLHLQNEENRLLIGENTTNLVYSSPPTSNLMSRSNSVSATNGVPDSSSSSSSTTIAAQLPLEVYEDLNQDIFRIKGYKDFSNSLATSFVAVLVWVFVASLNLYLIGSMLLGYDVPL

SEQ ID NO: 8767 - DNA, 1734 bp, Candida albicans SC5314
  CDS (1)..(1734): transl_table=12
atggagaataaagtatcagaaatatcagaaatgacaaccgatttaaattcgaattctgaaactaaatttgatcatttcacaactacaactaaaactacaactgatcaaattcaaaaaaaatcaactgaaacaacaactactactcaatcaatcagtataaacagtaaagatgaaaaaaaagctggctctaagctttcaagagttgttaaagtttcaagacgagcacttacaacttatgcatcattcattggtccaggtttattagttagtgttgcttatatggatcctgggaattatgccacgggtataactgctggtgcatccaatagatattctttattatttattgtgttattagccgatataattgcaatttttttgcaagtactttgtataaaattaggttgtgttacaggttatgatttagctcgatgttgtcgtgaatatttacctaaaaaattgaattggattttatggatattagctgaatgtgccattatatctactgatgttgctgaagttattggttccgctacagcattaaatatcttattaaaaattccattaccggcaggggtggttattactattgttgatgttatatttgtacttattgcttatcgtacggatacttcactgttgaaatttgttaaaatatttgaatatgccgttgggtgtttagttatgattgttgttatatgttttgccgttgaattatcacaaattactgctaatgtgggtcaagttttccgaggatttgttccttctaaagaaatgtttgatgggaatggtatgacggtggctacttcagttattggttctacagttatgattcattcattgtttttgggttcgggtttagtacaacctagaatgcgtgactatgatgttaaacatggatatgtcaatttatacgaaattgccaaagaagagaaagtacaagaggaagaggaagaagaccaaactgagatttcaccagttgcatcaaatcctattcaaaacaatattgctcctacatatgaacaagaggcaaaatttttccgaaccaaatataaaccatcttataaatcaatttgttattgtttaaaatattccaaaattgaattaattgtaacattagcaacaattgccctttttgtgaatgctgctattgttattattgctggggcaacattatatggtacatcagaagccatgaatgctgatctttataccattcatagtttattaagcaaaagtttatcacctgctgttggtactatctttatggtggcattattatcgagtggtcaaagtgctggtgtggtgtgtactattgctggacaaatggtgggtgaaggtcatatcaattggactttaaaaccatggatgagaagaatattgactcgagctatatctattattccttgtttgacaatttcggtatttattgggaaaaatggattaggagtggcattaaatatatctcaaattattatatcaattttattaccaccattaacggcacctttgatatattttacttgttgtaaaaaaatcatgaaagttgaattaggtgaagaagatgaagttgaaggaattgaagaagatgatggggattctggtaaaagatataaatatatgactaatagttggttaactacaattattgttgttataatttggcttttagtggcaattttgaatgtttatgctatttatcaaatggcagtaagtggtgtaacaggatcataa

SEQ ID NO: 8768 - protein, 577 aa, Candida albicans SC5314
MENKVSEISEMTTDLNSNSETKFDHFTTTTKTTTDQIQKKSTETTTTTQSISINSKDEKKAGSKLSRVVKVSRRALTTYASFIGPGLLVSVAYMDPGNYATGITAGASNRYSLLFIVLLADIIAIFLQVLCIKLGCVTGYDLARCCREYLPKKLNWILWILAECAIISTDVAEVIGSATALNILLKIPLPAGVVITIVDVIFVLIAYRTDTSSLKFVKIFEYAVGCLVMIVVICFAVELSQITANVGQVFRGFVPSKEMFDGNGMTVATSVIGSTVMIHSLFLGSGLVQPRMRDYDVKHGYVNLYEIAKEEKVQEEEEEDQTEISPVASNPIQNNIAPTYEQEAKFFRTKYKPSYKSICYCLKYSKIELIVTLATIALFVNAAIVIIAGATLYGTSEAMNADLYTIHSLLSKSLSPAVGTIFMVALLSSGQSAGVVCTIAGQMVGEGHINWTLKPWMRRILTRAISIIPCLTISVFIGKNGLGVALNISQIIISILLPPLTAPLIYFTCCKKIMKVELGEEDEVEGIEEDDGDSGKRYKYMTNSWLTTIIVVIIWLLVAILNVYAIYQMAVSGVTGS

SEQ ID NO: 8769 - DNA, 1728 bp, Candida albicans SC5314
  CDS (1)..(1728): transl_table=12
atggagaataaagtatcagaaatatcagaaatgacaaccgatttaaattcgaattctgaaactaaatttgatcatttcacaactacaactaaaactacaactgatcaaattcaaaaaaaatcaactgaaacaacaactactactcaatcaatcagtataaacagtaaagatgaaaaaaaagctggctctaagctttcaagagttgttaaagtttcaagacgagcacttacaacttatgcatcattcattggtcctggtttattagttagtgttgcttatatggatcctgggaattatgccacgggtataactgctggtgcatccaataaatattctttattatttattgtcttattagctgatataattgcaatttttttacaagtactttgtataaaattaggttgtgttacaggttatgatttagctcgatgttgtcgtgaatatttacctaaaaaattgaattggattttatggatattagctgaatgtgctattatatctactgatgttgctgaagttatcggttccgctacagcattaaatatcttattaaaaattccattaccggcaggggtggttattactattgttgatgttatatttgtacttattgcttatcgtacggatacttcactgttgaaatttgttaaaatatttgaatatgccgttgggtgtttagttatgattgttgttatatgttttgccgttgaattatcacaaattactgctaatgtgggtcaagttttccgaggatttgttccttctaaagaaatgtttgatgggaatggtatgacggtggctacttcagttattggttctacagttatgattcattcattgtttttgggttcgggtttagtacaacctagaatgcgtgactatgatgttaaacatggatatgtcaatttatacgaaattgccaaagaagagaaagtacaagaggaagaggaagaagaccaaactgagatttcaccagttgcatcaaatcctattcaaaacaatattgctcctacatatgaacaagaggcaaaatttttccgaatcaaatataaaccatcttataaatcaatttgttattgtttaaaatattccaaaattgaattaattgtaacattagcaacaattgccctttttgtgaatgctgctattgttattattgctggggcaacattatatggtacatcagaagccatgaatgctgatctttataccattcatagtttattaagcaaaagtttatcacctgctgttggtactatctttatggtggcattattatcgagtggtcaaagtgctggtgtggtgtgtactattgctggacaaatggtgggtgaaggtcatatcaattggactttaaaaccatggatgagaagaatattgactcgagctatatctattattccttgtttgacaatttcggtatttattgggaaaaatggattaggagtggcattaaatatatctcaaattattatatcaattttattaccaccattaacggcacctttgatatattttacttgttgtaaaaaaattatgaaagttgaattaggtgaagaagatgaagttgaaggaattgaagatgaaggttctggtaaaagatataaatatatgactaatagttggttaactacaattattgttgttataatttggcttttagtggcaattttgaatgtttatgctatttatcaaatggcagtaagtggtgtaacaggatcataa

SEQ ID NO: 8770 - protein, 575 aa, Candida albicans SC5314
MENKVSEISEMTTDLNSNSETKFDHFTTTTKTTTDQIQKKSTETTTTTQSISINSKDEKKAGSKLSRVVKVSRRALTTYASFIGPGLLVSVAYMDPGNYATGITAGASNKYSLLFIVLLADIIAIFLQVLCIKLGCVTGYDLARCCREYLPKKLNWILWILAECAIISTDVAEVIGSATALNILLKIPLPAGVVITIVDVIFVLIAYRTDTSSLKFVKIFEYAVGCLVMIVVICFAVELSQITANVGQVFRGFVPSKEMFDGNGMTVATSVIGSTVMIHSLFLGSGLVQPRMRDYDVKHGYVNLYEIAKEEKVQEEEEEDQTEISPVASNPIQNNIAPTYEQEAKFFRIKYKPSYKSICYCLKYSKIELIVTLATIALFVNAAIVIIAGATLYGTSEAMNADLYTIHSLLSKSLSPAVGTIFMVALLSSGQSAGVVCTIAGQMVGEGHINWTLKPWMRRILTRAISIIPCLTISVFIGKNGLGVALNISQIIISILLPPLTAPLIYFTCCKKIMKVELGEEDEVEGIEDEGSGKRYKYMTNSWLTTIIVVIIWLLVAILNVYAIYQMAVSGVTGS

SEQ ID NO: 8771 - DNA, 1227 bp, Mycobacterium sp. JLS
  CDS (1)..(1227): transl_table=11
gtgctgccggacaccgaccgtcggaccagatcgacgtggctgctcctgggcccggcgttcgtcgccgcgatcgcctacgtcgatccgggcaacgtcgcggccaacgtcagcgccggcgcccagttcggcttcctgctcgtctgggtcatcgtgctggccaacgtgatggccggattggtgcagtacctgtcggcgaagctgggtctggtcaccggccgatcgctgcccgaatccgtcgcgggccgcacccgcacgccgacccgcatcgcctactggctacaggccgaattggtcgccatggcaacggatctcgcggaggtggtgggcggcgcgatcgcgctgtacctgttgttcgacctgccgctgctgatcggcggcgtgatcacgggcgcggtgtcgctggccctgctggcggtgcagaaccgccgcggtcaacggcacttcgagcgggtgatcagcggtctgctgctgatcatcgccatcggcttcctgacgagcgtgttcgtcgaaccgccgcccgtcgccgacgtcgccggcggcctcatcccgctcttcgaaggcaccgacagcgtcctgctggcgaccgcgatgctgggcgcgaccgtgatgccgcacgcggtctatctgcactccgggctggcccgcgaccgccacggccacgccgaacccggcgcccggcggcgcctgctgctcaaggccacccgcatcgatgtgggcctggcgatgctgatcgccggggcggtgaacatgtcgatgctgctggtcgccgccaccaacctgcagggaatgtccgataccgacaccctcgagggcgcgcatgccgcggtgcagcagacgctcggcccggccgtggcactgtgcttcgcgatcggcctgctggcatccggtctggcgtcgacgtcggtgggcgcctacgccggcgcgatgatcatgggcggactgctgcgccgcacctacccgctgctggtgcgccgcctcgtcacgctggtgcctgccctggcgatcctcgcgatcggcgtggaccccacccgtgccctggtgctgtcgcaggtggtgctgtcgttcgggatcccgttcgcgctgatcccgctcatccggctgaccagcgatcgggccgtgatgggtgacgacgtcaaccaccgcatcaccaccacactgggctgggttgtcgcgggtttgattagtcttttgaacgtggtgctcatctatctgaccgtgacaggctga

SEQ ID NO: 8772 - protein, 408 aa, Mycobacterium sp. JLS
MLPDTDRRTRSTWLLLGPAFVAAIAYVDPGNVAANVSAGAQFGFLLVWVIVLANVMAGLVQYLSAKLGLVTGRSLPESVAGRTRTPTRIAYWLQAELVAMATDLAEVVGGAIALYLLFDLPLLIGGVITGAVSLALLAVQNRRGQRHFERVISGLLLIIAIGFLTSVFVEPPPVADVAGGLIPLFEGTDSVLLATAMLGATVMPHAVYLHSGLARDRHGHAEPGARRRLLLKATRIDVGLAMLIAGAVNMSMLLVAATNLQGMSDTDTLEGAHAAVQQTLGPAVALCFAIGLLASGLASTSVGAYAGAMIMGGLLRRTYPLLVRRLVTLVPALAILAIGVDPTRALVLSQVVLSFGIPFALIPLIRLTSDRAVMGDDVNHRITTTLGWVVAGLISLLNVVLIYLTVTG

SEQ ID NO: 8773 - DNA, 1350 bp, Burkholderia vietnamiensis G4
  CDS (1)..(1350): transl_table=11
atggccggattgcccatccgatcgcccgtgtccatgcccttgcttcccaccaccgccaccgccccgttctgtccgtcggaagtaaagggcagcatcacgatcgacgcgcgcgcgtcgcgctggatgaagttcaagcgcttcttcggcccgggcctgctggtggcgatcggctacatggaccccggcaactgggccaccgacatccaggccggctcgcagttcggctattcgctgctgtgggtcgtcgcgttctcgagtctcgccgcgatcttcctgcagatgctggccgcgcggctcggtctggtcgccggcaaggatctcgcgcaggcgagctacgaccgttatggccgcgtcggccgcctcgtgcagtgggttaccgccgaggtgtcgatcatcgcgtgcgacatcgccgaagtgctcggctgcgcgctcgcgttcaagctgctgctcggcgtgccgctcgcgtgggggatcgtgctgaccgcgctcgacacgatgatcgtcctcgggctgcagggcaagggcgtgcgccagatcgaggcgatcgtgctcgggctcatctcgacgatggcgttctgcttcgtcgcgcaggtcgccatcacgccgcccgactggcatgcggtcgcgaaggggctggtgccgagcaaccccggccacgacagcaaggatgcgatcgtgctcgcgctcggcatcgtcggcgcgacgatcatgccgcacaacctctatctgcattcgtcggtcgtgcagacgcgccacgtggtcggcggcgcgcgcgggctgatccgcgacacgctcgcgctggtgcgcatcgacacctgcgtgtcgctgttcgtcgcgatgctcgtcaacgcggcgatcctgatcgtcgcgggcgcggcgttccatgcgaccggccagcacaacgtgaccgacatcgagcaggcctaccggctgatcacgccgatcgcgggcggcgcggccgcgctgctgttcggcatcgcgctgctggcatccgggcaaagctcgacgctcaccggcacgatcgccggccaggtcatcatggacggcttcctgcacacgaagatcccgtgctaccagcggcgtctgatcacccgcgggctcgcgctggtgcccgcgttgatcggcgtgctgtggctcggcgacgggtcggtcgggcagctgctcgtatggagccaggtcgtgctgagcctccagttgccgttcgcgatgtggccgctgatccgctcggtcagcgatcgcggcacgatgggcgagcatgcgatcggccgcgggatgcaggcgctcgcgtgggcgctgttcgccgtcatcggcggcacgaatctgctgctgatcaccggcgtcgcaagctga

SEQ ID NO: 8774 - protein, 449 aa, Burkholderia vietnamiensis G4
MAGLPIRSPVSMPLLPTTATAPFCPSEVKGSITIDARASRWMKFKRFFGPGLLVAIGYMDPGNWATDIQAGSQFGYSLLWVVAFSSLAAIFLQMLAARLGLVAGKDLAQASYDRYGRVGRLVQWVTAEVSIIACDIAEVLGCALAFKLLLGVPLAWGIVLTALDTMIVLGLQGKGVRQIEAIVLGLISTMAFCFVAQVAITPPDWHAVAKGLVPSNPGHDSKDAIVLALGIVGATIMPHNLYLHSSVVQTRHVVGGARGLIRDTLALVRIDTCVSLFVAMLVNAAILIVAGAAFHATGQHNVTDIEQAYRLITPIAGGAAALLFGIALLASGQSSTLTGTIAGQVIMDGFLHTKIPCYQRRLITRGLALVPALIGVLWLGDGSVGQLLVWSQVVLSLQLPFAMWPLIRSVSDRGTMGEHAIGRGMQALAWALFAVIGGTNLLLITGVAS

SEQ ID NO: 8775 - DNA, 1308 bp, Burkholderia vietnamiensis G4
  CDS (1)..(1308): transl_table=11
atgattcctgtcccgagcaaaaccgccggcggcttcgcgctgaacggccggtccgcccagcccagcgacggcgcggcgcgcgccgcgctggaagggcgccgcaccggcgtcgccgcgctgctgccgttcgtcggcccggccgtgatcgcgtcgatcggctacatggaccctggcaacttcgcgaccaacatccaggccggcgccgcgtacggctaccggctgctctgggtcgtgctggccgcgaacgcgatcgcgatgctgttccaggcgatgtcggccaagctcggcatcgtgaccggccgcaatctcgccgagctgtgtcgcgagcgcttcccggcgcccgtcgtgtggggcatgtggatcgcgtcggagatcgccgcgatggcgaccgatctcgccgaattcctcggcggcgcgctcgcgttcgggctgttgtgccacctgtcgctgttcgcggggatgatcgcgaccgcgttcgcaacctgcgcgatcctggcgctcgaaaaacgcggcttccggccgctggaggccgcgatcgcgacgctggtcggcgtgatcggcgcgtgctatctcggcgaactgctgatcgcgccgcaggactggcaggcagccgcgttccatctggtggtcccgcagattccggaccatgcggcgctgacgatcgcagtcggcatcatcggcgcgacgatcatgccgcacacgctgtatctgcattcggggctcacgcaggatcgcgcagcgccgcgcaacgacgcagagcggcggcggctcgtgcgcttctcgaaccgcgaggtcgtgatcgcgctggggctcgccgggttcgtgaatctcgcgatggtgatgatggcgtcgtcggcgtttcacgcgaccgcgccgggcatgaccgacatcggcgacgcctatcacacgctgatcccggtgctcgggccggcggccggcgcgctgtttctcgtcgcgctgctgacctccggtgtgtcgagctcggtggtcggcacgatggccgggcaggtcgtgatgcagggcttcatccgccgccgcatgtcgatctggctgcggcgcgcggtgacgatcgcccccgcgttcctggtggtcgcgctcggctgcgacgtcacgcgggcgatggtggtcagtcaggtcgtactgagcttcgtgctgccgatgccgatgatcgcgctgctgatgctgtcggcgcgcaccgacgtgatgggcgcttacgcgatgcggatgccgctgcggatcgtcgccggcgcggcgacggtcgtgatcgtcgggctgaacgcgtacctggtaggggcggcattcaattga

SEQ ID NO: 8776 - protein, 435 aa, Burkholderia vietnamiensis G4
MIPVPSKTAGGFALNGRSAQPSDGAARAALEGRRTGVAALLPFVGPAVIASIGYMDPGNFATNIQAGAAYGYRLLWVVLAANAIAMLFQAMSAKLGIVTGRNLAELCRERFPAPVVWGMWIASEIAAMATDLAEFLGGALAFGLLCHLSLFAGMIATAFATCAILALEKRGFRPLEAAIATLVGVIGACYLGELLIAPQDWQAAAFHLVVPQIPDHAALTIAVGIIGATIMPHTLYLHSGLTQDRAAPRNDAERRRLVRFSNREVVIALGLAGFVNLAMVMMASSAFHATAPGMTDIGDAYHTLIPVLGPAAGALFLVALLTSGVSSSVVGTMAGQVVMQGFIRRRMSIWLRRAVTIAPAFLVVALGCDVTRAMVVSQVVLSFVLPMPMIALLMLSARTDVMGAYAMRMPLRIVAGAATVVIVGLNAYLVGAAFN

SEQ ID NO: 8777 - DNA, 1296 bp, Bacillus thuringiensis serovar konkukian str. 97-27
  CDS (1)..(1296): transl_table=11
atgaataaagatatatcaaaagatgaacatgtcccttctcaaagtacaactgttcaatcagcgcatttagcattaagcggacaaacgaaaggcttaaaaagactattaccattcttaggtcctgctttcatcgcttcagtcgcttatattgatcctggcaatttcgcgacaaatattgccgctggatcacaatatggatatttattactctgggtaattcttgcttctaatttaatggctgtattaatccaaactttatccgctaaattgggaatcgctacgggcagaaaccttcctgagatcgctcgagaaaacttcccaaaacctgtttccatcggtttatggatacaaggtgaactcgttattatggcgactgatttagctgaatttattggagccgcactcggattgtatttattatttgggattccgatgttacccgcagctttaattacagctgctggatcatttattattcttgaatttcaacgcagaggctttcgtccattagaagcgattataacggggatgatttttatcgttgttatcgcttttggtgtacaagtcttttatgcaaaaccggaattaagtcctttactttcagggcttttcattccgaaattccaaggtgtagacagtatattacttgcagctggaattttaggtgcgacagttatgccgcacgcaatctatttacattccgccttaacacaacgccgcgtagtcggaacaaatgatgaacaaaagaaaaagattttccacttcgagtttattgatatcattatcgcaatgattatcgctggagcaattaatgcaagtatgttaattgttgctgctgcactattctttaaaaacggcttgcatgtcgaagatcttgatgttgcttttaaccagtttagtaacttagtcggtcctgtatcagctgctttatttggaatcggtctcttatcagcaggactatctagctcttctgtcggtacaatgtcaggtgatattattatgcaaggtttcattcgaatgcatattccgttatacttacgccgctttattacaatgattccaccattagttattatcgctttaggtgtaaatccaacttacgctctagtcatgagccaagttgtcttatcattcggtattgcctttgcattagtaccacttattatgtttacaagtagtaaaaaaattatgggtgcactcgttaatcaccgcataactacctttatcgcttggatcattgctgtacttgttatcattttaaatattttcttactttatcaaacatttgtgggttaa

SEQ ID NO: 8778 - protein, 431 aa, Bacillus thuringiensis serovar konkukian str. 97-27
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFHFEFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAVLVIILNIFLLYQTFVG

SEQ ID NO: 8779 - DNA, 1233 bp, Erwinia carotovora subsp. atroseptica SCRI1043
  CDS (1)..(1233): transl_table=11
atgccgggtgttattgagtcaacaagccgtacatcaaggaaggtaaaactttctctgatgggcccggcgtttatcgcggcgattggttatatcgatccgggtaactttgccacgaacatccagtctggcgcggcctatggctacacgctgctgtgggttgtggtgtgggcgaacctgatggcgatgctgatccagctattgtcggccaaattaggcatcgcaacgggtaagaatctggcggaacatatccgcgatcgctttccgcgtcctgctgtttgggcgtactgggtacaggccgaaattattgcgatggcgaccgatctggccgagtttatcggtgcagcgattggtttcaaactgctattgggcgtgtcgctgctggaaggcgcgatcctcaccgcgattgccactttcctgattctcatgctgcaacagcgtggtcagaagccgctggagatggtcatcggcggcctgctgctgtttgttgcggcggcgtatattgtcgaactggtattttctcagcctgagctgtccgctttagccaaaggcatggcaatccctagtttgccgacttccgatgccgtgttgctggccgcaggcgtgttgggggcgacaattatgccgcatgtgatttacctgcattcttccctgacgcagcatgaaggcggtcattcccgtgccgagcgctattctgcaacgaaagttgatgtcgcgattgcgatgacgattgccggattcgtcaatctggcgatgatggcaacggcggcggcggcattccatttcagcggtaaccaggatattgccgatctggataaagcctacctcacgctggagccgctgttaggtaaagccgccgcggtgattttcggtctgagtctggtggcggcaggcctttcttccaccgttgtcggtacgctggcgggtcaggtagtgatgcaagggttcgtgcgcttccatatcccgctctgggttcgccgagccgtgacgatgctgccatcgtttatcgtaattttgtccggtatggatccgacgcgagtgttggtgttgagtcaagtagtgctgagcttcgggattgcgctggcgctggttcctttgctgtccttcactggcaatcgtgaactgatggggtcgatggttaacggaaaatgggtacagcgcatcggacaacttattgtcgtgctagtggtttccctgaatatgtatctgctgattgatacgatcatagggatataa

SEQ ID NO: 8780 - protein, 410 aa, Erwinia carotovora subsp. atroseptica SCRI1043
MPGVIESTSRTSRKVKLSLMGPAFIAAIGYIDPGNFATNIQSGAAYGYTLLWVVVWANLMAMLIQLLSAKLGIATGKNLAEHIRDRFPRPAVWAYWVQAEIIAMATDLAEFIGAAIGFKLLLGVSLLEGAILTAIATFLILMLQQRGQKPLEMVIGGLLLFVAAAYIVELVFSQPELSALAKGMAIPSLPTSDAVLLAAGVLGATIMPHVIYLHSSLTQHEGGHSRAERYSATKVDVAIAMTIAGFVNLAMMATAAAAFHFSGNQDIADLDKAYLTLEPLLGKAAAVIFGLSLVAAGLSSTVVGTLAGQVVMQGFVRFHIPLWVRRAVTMLPSFIVILSGMDPTRVLVLSQVVLSFGIALALVPLLSFTGNRELMGSMVNGKWVQRIGQLIVVLVVSLNMYLLIDTIIGI

SEQ ID NO: 8781 - DNA, 1212 bp, Propionibacterium acnes KPA171202
  CDS (1)..(1212): transl_table=11
gtgagcaaccgagtgatacgccttatggggccagctttcgtcgccgccgtggcgtacgtcgacccgggaaacgtcgccgcgaacctggcagccggagccggctacggctacttgctggtatgggtgctcgtcgtcgccaacgtcgtagcgatgttggtgcagtatttgtccgccaagctcggattggttaccggacattccttgcccgaacttgtcggaggggcactgccgcgtcgtggtagtcgtctggcctattggtttcaggccgagcttgtcgctgccgccactgatctggcagaggtcatcggtggggcggtggccctgcagcttctgttcgggctcccactgatcgtaggtggacttatgaccggggcgttgtcgctggcgattttggcgatcccgtcgcgtcatggccagcgcaccttcgagatcgtcattatcgggatgctcgtcgtcatcgccatcgggttcaccgccggtcttgctttttccccgctgtcatggggtggggtcgcgtcaggcctagtgccccggtttgaaggtactgaaaccgtcatgctcgccacgtcgatgctgggcgctacagtcatgcctcacgcggtatacatgcactcttccctggtgcgtgatcgccacgggaccgacgacaggccaaaacggatcaccacgctgttgcgagcaacccgatgggatgtcgcggtctctctggtgctggcaggatcggtgaatattgcgatgctgctgttggctgcggcgagcctgcaaggtgttaagggtatcgacggcatagctgaggctcatgcagccatgagtaactcaatggggccggtagtggggcttattttcgcggtggggctgttcgcgtcaggtctggcttcaacctccgttggcgcgtatgccggagctgagatcatggccgggcttctccatatgagggtgccgatgctggtccggcgacttgtgacgatcatcccggcgctaatcattctggcatccggagccaatccgactcaggccctcgtctggagccaggtgctgttgagcatggggttgccgctcgtgttggtgccgttggctcggttcaccggcgatcggcggctgatgggccaatggacgaatgggcgtgtcatggccgccatcgcgtggatcgtcgtggcagcagtctcggctctcaacgtggttctcgtcgtcgagacggtcatgggtgcatga

SEQ ID NO: 8782 - protein, 403 aa, Propionibacterium acnes KPA171202
MSNRVIRLMGPAFVAAVAYVDPGNVAANLAAGAGYGYLLVWVLVVANVVAMLVQYLSAKLGLVTGHSLPELVGGALPRRGSRLAYWFQAELVAAATDLAEVIGGAVALQLLFGLPLIVGGLMTGALSLAILAIPSRHGQRTFEIVIIGMLVVIAIGFTAGLAFSPLSWGGVASGLVPRFEGTETVMLATSMLGATVMPHAVYMHSSLVRDRHGTDDRPKRITTLLRATRWDVAVSLVLAGSVNIAMLLLAAASLQGVKGIDGIAEAHAAMSNSMGPVVGLIFAVGLFASGLASTSVGAYAGAEIMAGLLHMRVPMLVRRLVTIIPALIILASGANPTQALVWSQVLLSMGLPLVLVPLARFTGDRRLMGQWTNGRVMAAIAWIVVAAVSALNVVLVVETVMGA

SEQ ID NO: 8783 - DNA, 1272 bp, Leifsonia xyli subsp. xyli str. CTCB07
  CDS (1)..(1272): transl_table=11
atgagcacaggaggcgacgtcgccatcaccgcgggcgagcgcgcgacggagtcaggggcgggccggctgggtgccggacggctcctgctgctgggccccgcgttcgtcgcggcgatcgcctatgtcgatccggggaacgtcgcggccaacctcacggcgggagcgagctacgggtacctgctcgtgtgggtgctcgtcgccgccaacgcgatcgcggtgttcgtgcagtaccagtcggcgaagctcggcatcttgaccggccggagcctcccggagcttctcggtgaacggctgggcgcgggcgcccggcgcggctactgggcccaggcggaggtggtggccgccgcgaccgacatcgccgaagtcatcggcggcgcgatcgccctgagcctgctgttcgggctgccgctgtcgctcggcgggctcatcgtgggcgtggtctccatcggcatcctcgcccttcaaacgtgccacggccagcggacgttcgagctggtcatcgtcgggttcctcgccgtcatctccgtcgggttcctcgccgggctggtcgtgagcccggtggagtggggcgcggccgcgggcgggctgctcccgcgtttcgacgggacgcccacggtgctgctcgccgcgagcatgctcggagcgaccgtgatgccgcacgcgatctacctgcactccgccctcgcgcgcgaccggcacggcgtgaccggcgaccccggccgcatccgcacgctgctgagcgccacccggctggatgtcgttctcgcgctcatcgtcgccggcgccgtcaacatcgctatgctcctgctcgcggccgcgtccctcccgggcgttcccgggaccgacacgatcgagggcgctcacgcagcgatcaccgcggcgctcggtccggccatcggagtgatcttcgggatcggcctgctggcctccggtctcgcctccacctcggtgggcagctacgccggggccgccatcatgagcgggctcctcacggtgcgggtgcctctgcttgcgcgccgagtcgtcacgcttgtcccggccgtcgtcatcctgtcgctcggcgtggacccgacctgggcgctcgtgctgtcgcaggtcgtcctcagtcttggcatcccgttcgcgatgatcccgctgctgcgcctcaccggctcccgggccctgatgggcgaccgggccgacgcgctctgggtgcgtgccgcaggcggcgctgtcgcggcgctggtggtgctgctcaaccttgccctggtcgtcctgacgctgctggggtga

SEQ ID NO: 8784 - protein, 423 aa, Leifsonia xyli subsp. xyli str. CTCB07
MSTGGDVAITAGERATESGAGRLGAGRLLLLGPAFVAAIAYVDPGNVAANLTAGASYGYLLVWVLVAANAIAVFVQYQSAKLGILTGRSLPELLGERLGAGARRGYWAQAEVVAAATDIAEVIGGAIALSLLFGLPLSLGGLIVGVVSIGILALQTCHGQRTFELVIVGFLAVISVGFLAGLVVSPVEWGAAAGGLLPRFDGTPTVLLAASMLGATVMPHAIYLHSALARDRHGVTGDPGRIRTLLSATRLDVVLALIVAGAVNIAMLLLAAASLPGVPGTDTIEGAHAAITAALGPAIGVIFGIGLLASGLASTSVGSYAGAAIMSGLLTVRVPLLARRVVTLVPAVVILSLGVDPTWALVLSQVVLSLGIPFAMIPLLRLTGSRALMGDRADALWVRAAGGAVAALVVLLNLALVVLTLLG

SEQ ID NO: 8785 - DNA, 1296 bp, Bacillus cereus E33L
  CDS (1)..(1296): transl_table=11
atgaataaagatatatcaaaagatgaacatgtcccttctcaaagtacaactgttcaatcagcgcatttagcattaagcggacaaacgaaaggcttaaaaagactattaccattcttaggtcctgctttcatcgcttcagtcgcttatattgatcctggcaatttcgcgacaaatattgccgctggatcacaatatggatatttattactctgggtaattcttgcttctaatttaatggctgtattaatccaaactttatccgctaaattgggaatcgctacgggcagaaaccttcctgagatcgctcgagaaaacttcccaaaacctgtttccatcggtttatggatacaaggtgaactcgttattatggcgactgatttagctgaatttattggagccgcactcggattgtatttattatttgggattccgatgttacccgcagctttaattacagctgctggatcatttattattcttgaatttcaacgcagaggctttcgtccattagaagcgattataacagggatgatttttattgttgttatcgcttttggtgtacaagtcttttatgcaaaaccggaattaagtcctctactttcaggacttttcattccgcaattccaaggtgtagacagtatattacttgcagctggaattttaggtgcgacagttatgccgcacgcaatctatttacattccgccttaacacaacgccgcgtagtcggaacaaatgatgaacaaaagaaaaagattttccgcttcgagtttattgatatcattatcgcaatgattatcgctggagcaattaatgcaagtatgttaattgttgctgctgcactattctttaaaaacggcttgcatgttgaagatcttgatgttgcttttaaccagtttagtaacttagtcggtcctgtatcagctgctttatttggaattggtctcttatcagcaggactatctagctcttctgtcggtacaatgtcaggtgatattattatgcaaggtttcattcgaatgcatattccgttatacttacgccgctttattacaatgattccaccattagttattatcgctttaggtgtaaatccaacttacgctctagtcatgagccaagttgtcttatcattcggtattgcctttgcattagtaccacttattatgtttacaagtagtaaaaaaattatgggtgcactcgttaatcaccgcataactacctttatcgcttggatcattgctgtacttgttatcattttaaatattttcttactgtatcaaacatttgtagggtaa

SEQ ID NO: 8786 - protein, 431 aa, Bacillus cereus E33L
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPQFQGVDSILLAAGILGATVMPHAIYLHSALTQRRVVGTNDEQKKKIFRFEFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAVLVIILNIFLLYQTFVG

SEQ ID NO: 8787 - DNA, 1281 bp, Bacillus licheniformis ATCC 14580
  CDS (1)..(1281): transl_table=11
atggtcagtcacgatttgtccaaacactcgcaaatatcaaaagaagcccaagatgcactggatggaaaaagcaaaggcttcaaaaggctgctcccttttttgggtccggcgtttatcgcggctatagcctatattgatccaggcaatttcgccacaaatatcgcggctggttcgaaatacggctacttgcttttatgggtaatccttttttcaaatattatggctttgctgattcagtcattgtcagccaaactgggaattgcaacgggtaaaaacctgcccgaagtcgcccgggaagaattccccaaaccggtctccatcggcttgtggattcagggagagcttgtcgtgatcgcgacggacttggccgaatttatcggagctgctctcgggctctacttgctgttcggcataccgatgcttgaagcatcgattattgctgccgccggatctttcgccattttggaactgcaaaggcgcggcgtcagaccgcttgaagcggcgataacaggaatgcttttcatcgtcgtgatcgcatttgcctttcaaacgttttttgcaaaacctgatatcggatcggttttggagggcatgtttgtcccccgcttcgatggtgctgacagcatcctgctggcggcgggaatcttgggagcgacggtgatgccgcatgccatctatcttcattccgctctcacacagcgaagagtggtcggaaaaacggaagcggaaaagaaaaagatattccgctttgagttcatcgacattttgatcgccatgctgattgccggagcaatcaatgcgagcatgctgatcgtagccgctgcactgttttataagaacggcattttcgtcgaagaccttgatgtggccttcagccacttcagcagcatggtcagtccgctttccgccgtattgttcggcgtcggcctgttaacagccggtttatcaagttcgtctgtcggaacgctttcaggagatattatcatgcagggcttcattaatttcaggattccgctttatttaagacggttcattacgattttgccgccgatcgctattattgcttcaggggtgaatccgacaaccgctcttgtcttgagccaggtcgtcctgtcattcggcatcgcctttgcccttatcccgcttatcttatttacgagcaataaacgcattatggggagcctgaaaaatgcaaagtggataacagccgtctcatggctgatcgctgccttaatcgtcgccctcaatattttcctgatttacgatacattttctggttaa

SEQ ID NO: 8788 - protein, 426 aa, Bacillus licheniformis ATCC 14580
MVSHDLSKHSQISKEAQDALDGKSKGFKRLLPFLGPAFIAAIAYIDPGNFATNIAAGSKYGYLLLWVILFSNIMALLIQSLSAKLGIATGKNLPEVAREEFPKPVSIGLWIQGELVVIATDLAEFIGAALGLYLLFGIPMLEASIIAAAGSFAILELQRRGVRPLEAAITGMLFIVVIAFAFQTFFAKPDIGSVLEGMFVPRFDGADSILLAAGILGATVMPHAIYLHSALTQRRVVGKTEAEKKKIFRFEFIDILIAMLIAGAINASMLIVAAALFYKNGIFVEDLDVAFSHFSSMVSPLSAVLFGVGLLTAGLSSSSVGTLSGDIIMQGFINFRIPLYLRRFITILPPIAIIASGVNPTTALVLSQVVLSFGIAFALIPLILFTSNKRIMGSLKNAKWITAVSWLIAALIVALNIFLIYDTFSG

SEQ ID NO: 8789 - DNA, 1296 bp, Burkholderia mallei ATCC 23344
  CDS (1)..(1296): transl_table=11
atgagccgatccgccggcgatttcgcgacggcgggagacgcgagctcgcgcaccgtccgcgccgcgcgcgacgcgctcgaagggcgccgcaagggcgtcgcggccgcgctgccgttcgtcgggccggccgtgatcgcgtcgatcggctacatggaccccggcaacttcgcgaccaacatccaggcgggcgccgcgtacggctacgagctgctgtgggtcgtgctcgccgcgaacgtgatcgcgatggtgtttcaggcgatgtcggcgaagctcggcatcgtgacgggccgcaacctcgccgagctgtgccgcgagcattttccgcggcccgtcgtctgggggatgtgggcgacgtccgagatcgccgcgatggcgaccgatctcgccgaattcctgggcggggcgctcgcgttcggcctgctgctgcatctgccgctcatcgccgggatggccgcgacggcggtgctgacctgcgcgatcctcacgctggaaaagcgcggcttccggccgctcgaggccgcgatcgcggcgctggtcggcgtgatcggcgcgagctacctcggcgaattgctgatcgcgccgcaggactggcacgcggccgcataccatctcgtcgtgccgcagttgcgcgacggcacggcgctcacgctcgcggtgggcatcatcggcgcgacgatcatgccgcacacgctctatctgcactccggcctcacgcagcggcgcacgacgccgcgcgacgcgcgcgagcgccggctgctgctgcgcttctcgaaccgcgaggtcgcggtcgcgctcggcgtcgccggcttcgtgaacatcgcgatggtgatgatggcgtcgtccgcgttccaccggacggcgccgggcatggccgatatcggcgacgcgtatcacacgctgattccgctgctcggcccggcggcgggcgcgctctttctcgtcgcgctgttcgcgtccggcgtgtcgagttcggtcgtcggcacgctcgcggggcaggtcgtgatgcagggcttcctgcgtcgccgggtgccgatctgggtgcggcggctcgtgacgatcgcgcccgcgttcgcgatcgtcgcgctcggctgcgacgtcacgcgcgcgatggtgctgagccaggtcgtgctgagcctcgtgctgccgctgccgatggccgcgctgctgctgctgtcgagccggcgcgcgctgctcggcgagcatgcgctgcgcgcgccgacgctcgtcgcggcgagcgcggcggcggcggcgatcgtcgcgttgaacgtgtatctgatctgggcggcgttcaattga

SEQ ID NO: 8790 - protein, 431 aa, Burkholderia mallei ATCC 23344
MSRSAGDFATAGDASSRTVRAARDALEGRRKGVAAALPFVGPAVIASIGYMDPGNFATNIQAGAAYGYELLWVVLAANVIAMVFQAMSAKLGIVTGRNLAELCREHFPRPVVWGMWATSEIAAMATDLAEFLGGALAFGLLLHLPLIAGMAATAVLTCAILTLEKRGFRPLEAAIAALVGVIGASYLGELLIAPQDWHAAAYHLVVPQLRDGTALTLAVGIIGATIMPHTLYLHSGLTQRRTTPRDARERRLLLRFSNREVAVALGVAGFVNIAMVMMASSAFHRTAPGMADIGDAYHTLIPLLGPAAGALFLVALFASGVSSSVVGTLAGQVVMQGFLRRRVPIWVRRLVTIAPAFAIVALGCDVTRAMVLSQVVLSLVLPLPMAALLLLSSRRALLGEHALRAPTLVAASAAAAAIVALNVYLIWAAFN

SEQ ID NO: 8791 - DNA, 1308 bp, Burkholderia pseudomallei K96243
  CDS (1)..(1308): transl_table=11
atgaacagtcgcccgcttgccgcccgcagcccgtcgtcgcgccgcccgtccgcttccggcgggccgggcggcggccgccgctgggccgcgttcgtcggcgcgggcgtgctcgtcgcggtcggctacatggaccccggcaactgggcgaccgcgctcgcgggcggcgcgggctacggctacgcgctcctcggcgtcgtgatcgccgcgagcctgatggcgatgctgctgcaatggctcgccgcgcggatcggcgtcgtgtccgggcgcgacctcgcgcaactgtgccgcgagcgcttcgacccgcgcgcgaccgtgctgctgtggattgccgccgaaatcgcgatcgtcgcgtgcgacgtcgccgaagtcgtcggcgcggcggtcgcgctgcagatgctgctcggcgtgtcgctgagcacgggcgtgctcgtgtcggcggtgggcacgctcgcgatgctcgcgctcgagcggcacggccggcgcacgctcgaggcggcgatcgcatcgctgatcttcttcgtcggcctgtgcttcgtgatcgaggtcgcgctcgcgcggcccgactggcacgcggcgctcgccggcgccgcgccgtcgccgcggctgctgcgcgagcccggcatgctgtggctcgcggccggcatcctcggcgcgaccgtgatgccgcacaacctctacttgcactcgatgctggtcaagcatcacgcgagcgcgcgcgacgagccgtcgatccgccgcgcgctgttcggcgtcaatctcgacacgttcgtgtcactcggattcgcgttcgtgatcaacgcggcgcttctcatcgtcgcggcggcagtgttccacgcgagcggccacgacgacgtcaccgatctcgccgacgcgcaccggctgatcgcgccgctcgtcggcaatcgctgggcgggcccgctgttcgcggccgccttgctcgcatgcgggctgtcggcaacggtgacgggcacgctcgccggccaggcgatcatggaagggttcctgaagctgacgctgccgcgctggcagcgcgcgctcctcacccgcgcgctcgcgatcggccccgcgctcgccgcggtcggcctgttcgggcagcacggatcgaatcaactgctcgtcgcgagccaggtcgtgctgagcctgcaattgccgctcgcgatggtgccgctcgtcgtgttcgcgtcgagccgcgcgctgatggggcgctggcgggtccgcggcctgccgctcgcggccgcatggatgtgtgccgcggcgatcgtggcgctgaacggcgcgctcgtctggcaggtggttgcggcggggtga

SEQ ID NO: 8792 - protein, 435 aa, Burkholderia pseudomallei K96243
MNSRPLAARSPSSRRPSASGGPGGGRRWAAFVGAGVLVAVGYMDPGNWATALAGGAGYGYALLGVVIAASLMAMLLQWLAARIGVVSGRDLAQLCRERFDPRATVLLWIAAEIAIVACDVAEVVGAAVALQMLLGVSLSTGVLVSAVGTLAMLALERHGRRTLEAAIASLIFFVGLCFVIEVALARPDWHAALAGAAPSPRLLREPGMLWLAAGILGATVMPHNLYLHSMLVKHHASARDEPSIRRALFGVNLDTFVSLGFAFVINAALLIVAAAVFHASGHDDVTDLADAHRLIAPLVGNRWAGPLFAAALLACGLSATVTGTLAGQAIMEGFLKLTLPRWQRALLTRALAIGPALAAVGLFGQHGSNQLLVASQVVLSLQLPLAMVPLVVFASSRALMGRWRVRGLPLAAAWMCAAAIVALNGALVWQVVAAG

SEQ ID NO: 8793 - DNA, 1296 bp, Burkholderia pseudomallei K96243
  CDS (1)..(1296): transl_table=11
atgagccgatccgccggcgatttcgcgacggcgggagacgcgagctcgcgcaccgtccgcgccgcgcgcgacgcgctcgaagggcgccgcaagggcgtcgcggccgcgctgccgttcgtcgggccggccgtgatcgcgtcgatcggctacatggaccccggcaacttcgcgaccaacatccaggcgggcgccgcgtacggctacgagctgctgtgggtcgtgctcgccgcgaacgtgatcgcgatggtgtttcaggcgatgtcggcgaagctcggcatcgtgacgggccgcaacctcgccgagctgtgccgcgagcattttccgcggcccgtcgtctgggggatgtgggcgacgtccgagatcgccgcgatggcgaccgatctcgccgaattcctgggtggggcgctcgcgttcggcctgctgctgcatctgccgctcatcgccgggatggcagcgacggcggtgctgacctgcgcgatcctcacgctggaaaagcgcggcttccggccgctcgaggccgcgatcgcggcgctggtcggcgtgatcggcgcgagctacctcggcgaattgctgatcgcgccgcaggactggcacgcggccgcataccatctcgtcgtgccgcagttgcgcgacggcacggcgctcacgctcgcggtgggcatcatcggcgcgacgatcatgccgcacacgctctatctgcactccggcctcacgcagcggcgcacgacgccgcgcgacgcgcgcgagcgccggctgctgctgcgcttctcgaaccgcgaggtcgcggtcgcgctcggcgtcgccggcttcgtgaacatcgcgatggtgatgatggcgtcgtccgcgttccaccgggcggcgccgggcatggccgatatcggcgacgcgtatcacacgctgattccgctgctcggcccggcggcgggcgcgctctttctcgtcgcgctgttcgcgtccggcgtgtcgagttcggtcgtcggcacgctcgcggggcaggtcgtgatgcagggcttcctgcgtcgccgggtgccgatctggatgcggcggctcgtgacgatcgcgcccgcgttcgcgatcgtcgcgctcggctgcgacgtcacgcgcgcgatggtgctgagccaggtcgtgctgagcctcgtgctgccgctgccgatggccgcgctgctgctgctgtcgagccggcgcgcgctgctcggcgagcatgcgctgcgcgcgccgacgctcgtcgcggcgagcgcggcggcggcggcgatcgtcgcgttgaacgtgtatctgatctgggcggcgttcaattga

SEQ ID NO: 8794 - protein, 431 aa, Burkholderia pseudomallei K96243
MSRSAGDFATAGDASSRTVRAARDALEGRRKGVAAALPFVGPAVIASIGYMDPGNFATNIQAGAAYGYELLWVVLAANVIAMVFQAMSAKLGIVTGRNLAELCREHFPRPVVWGMWATSEIAAMATDLAEFLGGALAFGLLLHLPLIAGMAATAVLTCAILTLEKRGFRPLEAAIAALVGVIGASYLGELLIAPQDWHAAAYHLVVPQLRDGTALTLAVGIIGATIMPHTLYLHSGLTQRRTTPRDARERRLLLRFSNREVAVALGVAGFVNIAMVMMASSAFHRAAPGMADIGDAYHTLIPLLGPAAGALFLVALFASGVSSSVVGTLAGQVVMQGFLRRRVPIWMRRLVTIAPAFAIVALGCDVTRAMVLSQVVLSLVLPLPMAALLLLSSRRALLGEHALRAPTLVAASAAAAAIVALNVYLIWAAFN

SEQ ID NO: 8795 - DNA, 1320 bp, Pseudomonas syringae pv. syringae B728a
  CDS (1)..(1320): transl_table=11
gtgacgtacaaactgcccactactgccaccgctcctttctgcccctcggcgaccacggacagtgtggccattccgccgaacgcgtccttgctgcgcaagatgacgctgtttgtcgggcctggcctgctggtttccatcggctatatggatcctggcaactgggcgaccgccatcgaggccgggtcgcgcttcggctattcgctgctgttcgtggtggtcctggccagcctctcgggcatggtcttgcagaacctttgttcgcggctgggcatcgcgaccggccgtgacctggcgcaactgtccgccgcacgctacagccgcaaggtcgccaagggccagtggttgctggcagaactgtcgatcattgccaccgatctggcggaagtgctgggcgctgcgctggcgtttcatctgttgctcggcgtttccatcaccaccggtgtggcgctgaccgctttcgatacgctgattgtgctggccttgcagggcgccaattttcgtcgtctggaagccattgtactggggctgattgcaaccatcgccagttgctttgccgtcgagttgtttctgatcaagccattctggccggatgtcgtcgcgggtctgaagccgagctgggatgtgttgagcagccaggagccgctgtacatcgccatcggcattctgggcgccaccgtcatgccgcataacctttatctgcattcgtctgtggtgcagacgcgggtcaacggttcggaccaggccagcaaggccagcgccattcgctacgcgcggctggacaccatcggttcgctgagcctggcgctgctgatcaatgcggcgattctgatcctcgctgctgcagcgtttcacaagaccgggcataccgaggtggtcgagattcaggacgcctatcacctgcttgatccgctggtgggtggtgcgatcgccagcgtgctgttcggtattgccttgctggcggcggggcagagctcgaccttcaccggcaccattgccgggcaagtggtgctcgaaggttttctgcaggcaaagattccgtgctggcagcggcgcttgatcacccgtgcactggcactgattccggcgctgattggcgtgatctggctgggtgacagctcggtggggcagatgctggtgctcagtcaggtcgtactgagcctgcaactgcctttcgcgctctggccgttgattcgttttaccagcgacccacaactgatggggccgttcgtcaacagccggctggtgaaaacggcggcctgggggctgttcggactgatctcggcggccaatctgacgttactgtggttctggatcagctga

SEQ ID NO: 8796 - protein, 439 aa, Pseudomonas syringae pv. syringae B728a
MTYKLPTTATAPFCPSATTDSVAIPPNASLLRKMTLFVGPGLLVSIGYMDPGNWATAIEAGSRFGYSLLFVVVLASLSGMVLQNLCSRLGIATGRDLAQLSAARYSRKVAKGQWLLAELSIIATDLAEVLGAALAFHLLLGVSITTGVALTAFDTLIVLALQGANFRRLEAIVLGLIATIASCFAVELFLIKPFWPDVVAGLKPSWDVLSSQEPLYIAIGILGATVMPHNLYLHSSVVQTRVNGSDQASKASAIRYARLDTIGSLSLALLINAAILILAAAAFHKTGHTEVVEIQDAYHLLDPLVGGAIASVLFGIALLAAGQSSTFTGTIAGQVVLEGFLQAKIPCWQRRLITRALALIPALIGVIWLGDSSVGQMLVLSQVVLSLQLPFALWPLIRFTSDPQLMGPFVNSRLVKTAAWGLFGLISAANLTLLWFWIS

SEQ ID NO: 8797 - DNA, 1320 bp, Pseudomonas fluorescens Pf-5
  CDS (1)..(1320): transl_table=11
gtgaaattcagcttgccgaaaatcgccaccgcgcccttttgcccgccggaggtggcgggttccgtcgccgtcgaccccggcgcttccctgtggcgccgcctgctgcgctttgccggccccgggctgctgatttccatcggctacatggaccccggcaactgggccacggccatcgaggccggctcgcgctacggctacaacctgctgttcgtggtgctgctggcgagcctggcggggatggcggtgcagtgcctgtgttcccgcctggggatcgccaccgggcgcgacctggcccagctctgccgcgagcgctacagcacccgttcggcgcgcacccagtggctgctggcagaggtttcgatcatcgccaccgacctggccgaagtgctgggctgcgctctggcgttccacctgctgctgggggtgtccctgagcaccgggatcgtcatcaccgccttcgacaccctgctggtgctggccctgcagaaccgcggcttccgccggctggaggcgatcatgctggcgctggtggcgaccattggcgtgtgcttcttcatcgagctgctgctgatcaagccctactggccggacgtggcccggggctttgtaccctcgctctcggccatcggcgacgccgcgccgctgtacctggccatcggcatcctcggcgccacggtcatgccccacaacctctacctgcacacctccgtcgtgcaaacccggctggtgggcaacgaccgcgccagccgcgccgacgccatcaagctggcgcggatcgacaccatcggctcgctggccctggcgctgctggtgaacgcggcgatcctgatcctcgccgccgcggccttccacaacaccggccacagcgatgtggtggagatccaggacgcctaccacctgctcgacccgctggtgggcggggccctggccagcgtgctgttcggcgtggcgctgctggcttcggggcagagctcgaccttcaccgggaccattgccgggcaagtgatcatggagggttacctgaacctgcggattccctgctggcagcggcgcctgatcacccgtgggctggccctgatcccggcgttcatcggcgtctggctgctgggtgacggcgccgtgggccagttgctggtgctgagccaggtggtgctcagcctgcaactgccgttcgccctgtacccgctgatccgcatgaccaacgaccggcgcctgatgggcgagttcgtcaaccgctggccgacccggatcctcgcctggagcctgttcgccatcatcggcgcggccaatgcctggctgatcctgcaaatggccctgtag

SEQ ID NO: 8798 - protein, 439 aa, Pseudomonas fluorescens Pf-5
MKFSLPKIATAPFCPPEVAGSVAVDPGASLWRRLLRFAGPGLLISIGYMDPGNWATAIEAGSRYGYNLLFVVLLASLAGMAVQCLCSRLGIATGRDLAQLCRERYSTRSARTQWLLAEVSIIATDLAEVLGCALAFHLLLGVSLSTGIVITAFDTLLVLALQNRGFRRLEAIMLALVATIGVCFFIELLLIKPYWPDVARGFVPSLSAIGDAAPLYLAIGILGATVMPHNLYLHTSVVQTRLVGNDRASRADAIKLARIDTIGSLALALLVNAAILILAAAAFHNTGHSDVVEIQDAYHLLDPLVGGALASVLFGVALLASGQSSTFTGTIAGQVIMEGYLNLRIPCWQRRLITRGLALIPAFIGVWLLGDGAVGQLLVLSQVVLSLQLPFALYPLIRMTNDRRLMGEFVNRWPTRILAWSLFAIIGAANAWLILQMAL

SEQ ID NO: 8799 - DNA, 1320 bp, Pseudomonas syringae pv. phaseolicola 1448A
  CDS (1)..(1320): transl_table=11
gtgacgtacaaactgcccaccactgcaacagcccctttctgcccatcggcgaccaccgacagcgtgagcatcccgtcgaacgcatcattgctgcgaaagatgatgctgttcgtggggccaggcctgctggtttccatcggttacatggaccccggcaactgggcgacggctatcgaggccggttcacgctttggttattcattgttgtttgtggtggtgctcgccagtctgtcgggaatggtcttgcaaaacctttgttcccgccttggcatcgccaccgggcgtgatctggcgcagctgtctgctgcccgctacagccgtaatgtcgccaaaggccagtggctgctggcagagctgtcgatcatcgccaccgatctggcagaggtgctgggggcggcgttggcgtttcatctgttgctgggcgtgtcgataaccaccggtgtagcgctgaccgctttcgataccctgatcgtgctggccttgcagggcgccaatttccggcgtctggaagctatcgtgctggggttgattgcaaccattgccagttgttttgccatcgagctgtttctgatcaagccattctggccggatgtggtggcgggcctgaaaccgagctgggatgtactgagcagccaggagccgctgtatatcgccatcggtattctgggtgccacggtcatgccgcataacctttatctgcattcgtcggtggtgcagacccgggtcaatggtgctgacctggccagcaaggccactgccattcgctacgcccggctggacactatcggttcgctgagccttgcgctgcttatcaatgcggcgattctgatcctcgcggctgcggcgtttcacaagaccgggcataccgaagtggtcgagattcaggacgcttatcacctgcttgatccattggtcggcggtgccattgccagcgtgctgttcggcgtcgccttgctggcggcagggcaaagttcgacgttcacgggaaccatcgccgggcaggtggtgctcgaaggctttctgcaggccaaaattccttgctggcagcggcgcttgattactcgcgcactggcactgattccggcgctgatcggcgtgatctggctgggtgacagttcggtcggcaagatgctggtgctcagccaggtggtgctgagcctgcaactgccgtttgcgctctggccgctgattcgctttaccagtgatccgcagttgatggggccgttcgtcaacagtcggttggtcaagattgctgcctgggggctgttcggtctgatctcggcggccaatctgacgctgctgtggttctgggtgagctga

SEQ ID NO: 8800 - protein, 439 aa, Pseudomonas syringae pv. phaseolicola 1448A
MTYKLPTTATAPFCPSATTDSVSIPSNASLLRKMMLFVGPGLLVSIGYMDPGNWATAIEAGSRFGYSLLFVVVLASLSGMVLQNLCSRLGIATGRDLAQLSAARYSRNVAKGQWLLAELSIIATDLAEVLGAALAFHLLLGVSITTGVALTAFDTLIVLALQGANFRRLEAIVLGLIATIASCFAIELFLIKPFWPDVVAGLKPSWDVLSSQEPLYIAIGILGATVMPHNLYLHSSVVQTRVNGADLASKATAIRYARLDTIGSLSLALLINAAILILAAAAFHKTGHTEVVEIQDAYHLLDPLVGGAIASVLFGVALLAAGQSSTFTGTIAGQVVLEGFLQAKIPCWQRRLITRALALIPALIGVIWLGDSSVGKMLVLSQVVLSLQLPFALWPLIRFTSDPQLMGPFVNSRLVKIAAWGLFGLISAANLTLLWFWVS

SEQ ID NO: 8801 - DNA, 1308 bp, Ralstonia eutropha JMP134
  CDS (1)..(1308): transl_table=11
atgccgccgccggaacactgcgcgccggcaatagcccgggcctgcacgtctcctgacggctggcggggcatgctgcgctttgccggcccggggtacctcgttgccgtcggctacatggatccgggaaactgggccaccgacctggccggcggttcagcctatgggtatcgcctgttgtgggtcatcgccatgtcgagctgcatggcggtgctgctgcagatactcgcgagccggctcggcctggtggcgggcatggacctcgcgcaagcgtgcaggcaccgtagtccgcggctgtcggccctggcgcagtgggtgctgtgcgagatcgcgatctgcgccgccgacctcgccgaagtgctcggcacggccatagcgctgaacctgctgttcgggctgccgctggcgtggggggtcgcgctgacggtgttcgacgtgcttctggtgctggtgctgcaacagcgcggctatcgccgcctggaagcgttcgtcatcagcatggtggcgctggtgctgtgctgcttcatcctgatgctgctgatctcgcgccccgcatggcccgacgtggcggccggcctggtgccgtacgggccgacgatgcgcgatccgtccgcgctttatatcgccatcggcatcatcggcgcgaccgtgatgccgcacaacctctacctccattcggcggcggtgcgcacgcgtgcgctggacggaagcccccaggatctgcggcgggccctgcgtttcatcgccatcgataccgtgattgcactgtcgctcgcgttcgtcatcaacgctgccatcctgattacggctgccggcgtgtttttcaaggccggccgtaccgacgtggcggaaatccaggaagcctaccggctgctcagcccgctgaccggcgcggcctgggcgagcgtggtgtttggcgtggccctgctggcctcgggacaatgttcggcggtcactgccacgctggccgggcaggtcgtgatggagggtttcctgcgtacgcggctgccgccgtggctgcggcggcttgcgacccgctgcgtcgctatcgttccggcattggtggtcgcgatcctgtacgcggaacgcggcatcgctcagctcctgctggcaagccaggtgatcctgagcctgcagttgccgttcgccgccattcccctggtgcgcagcacaagcagctgcgcgctgatgcgcgagcacgtgaatccgcgctggctcgcggtcctggcctggatcgcagtcgccgtcatcgtgtcgatgaacgcgaccatgctctggatgctggcgggctctcccgctgcaggcggttga

SEQ ID NO: 8802 - protein, 435 aa, Ralstonia eutropha JMP134
MPPPEHCAPAIARACTSPDGWRGMLRFAGPGYLVAVGYMDPGNWATDLAGGSAYGYRLLWVIAMSSCMAVLLQILASRLGLVAGMDLAQACRHRSPRLSALAQWVLCEIAICAADLAEVLGTAIALNLLFGLPLAWGVALTVFDVLLVLVLQQRGYRRLEAFVISMVALVLCCFILMLLISRPAWPDVAAGLVPYGPTMRDPSALYIAIGIIGATVMPHNLYLHSAAVRTRALDGSPQDLRRALRFIAIDTVIALSLAFVINAAILITAAGVFFKAGRTDVAEIQEAYRLLSPLTGAAWASVVFGVALLASGQCSAVTATLAGQVVMEGFLRTRLPPWLRRLATRCVAIVPALVVAILYAERGIAQLLLASQVILSLQLPFAAIPLVRSTSSCALMREHVNPRWLAVLAWIAVAVIVSMNATMLWMLAGSPAAGG

SEQ ID NO: 8803 - DNA, 1338 bp, Pseudomonas fluorescens PfO-1
  CDS (1)..(1338): transl_table=11
ttgtttctggatgtgttcgtgaaattcagtttgcccaaaatcgccactgcgccgttctgcccgccggaagtggccggcagtgtcccggtcgatcccaacgcctcgttcttcaaacgcgtgctgcgctttgccggccccggtttgctggtgtcgatcggctacatggatccgggcaactgggccactgccatcgaggccggttcgcgcttcggttacagcctgttgttcgtggtattgctggccagcctggcgggcatggttgtgcaatgcctgtgctcgcggctgggcatcgccaccgggcgcgatctggcgcagctgtcccgcgaacgctacagcaccccgacggcgcggctgcaatgggtgctggcggaaatctcgatcatcgccaccgaccttgcggaagtgctcggctgcgcgctggcgtttcacctgttactgggttgttcgctgacgttcggcatcgccctgaccgcattcgatacgttgctggtgctggccctgcaaaaccgcggtttccgccggctggaggcgatcatgctggtgctggtgggcaccatcggcgcgtgcttctttgtcgagttgctgctgatcaaaccgtactggccggatgtcgctcaaggcttcacaccgtcgctgtcggcgatcagcgatgctgcgccgttgtacctggctatcggcatcctcggtgccacggtgatgccacacaacctgtacctgcacacctcgatcgtgcagacgcggctgatcggcaaggatctggccagcaagcaggatgcggtgaaactggcgcgcatcgacaccatcggttcgctggcgctggcgttgctggtcaacgcggcgatcctgatactcgcggcggccgcttttcatcagtccgggcacaccgacgtggtcgacatccaggacgcctatcacttgctcgatccactggtgggcggcgcgctggccagtgtgctgttcggcgtggcgctgctggcgtcggggcagagctcaaccttcaccggcaccatcgccgggcaagtgatcatggaaggctatctgaatctgcggattccctgctggcaacgacgcctgatcacccgtgggctggcgctgatcccggcattcatcggcgtgtggctgatgggcgacggcgcggtgggcaagttgctggtgctgagccaggtggtgttgagcctgcaattgccgtttgcgctgtatccgctgattcgcatgaccaacgacaaacaactgatggggccgtttgtgaatcggttaccgacgcaggtgctggcgtggggattgtttgtgctgatcagcggggcgaatgcctggttgattctgcagctggcggcctag

SEQ ID NO: 8804 - protein, 445 aa, Pseudomonas fluorescens PfO-1
MFLDVFVKFSLPKIATAPFCPPEVAGSVPVDPNASFFKRVLRFAGPGLLVSIGYMDPGNWATAIEAGSRFGYSLLFVVLLASLAGMVVQCLCSRLGIATGRDLAQLSRERYSTPTARLQWVLAEISIIATDLAEVLGCALAFHLLLGCSLTFGIALTAFDTLLVLALQNRGFRRLEAIMLVLVGTIGACFFVELLLIKPYWPDVAQGFTPSLSAISDAAPLYLAIGILGATVMPHNLYLHTSIVQTRLIGKDLASKQDAVKLARIDTIGSLALALLVNAAILILAAAAFHQSGHTDVVDIQDAYHLLDPLVGGALASVLFGVALLASGQSSTFTGTIAGQVIMEGYLNLRIPCWQRRLITRGLALIPAFIGVWLMGDGAVGKLLVLSQVVLSLQLPFALYPLIRMTNDKQLMGPFVNRLPTQVLAWGLFVLISGANAWLILQLAA

SEQ ID NO: 8805 - DNA, 1197 bp, Carboxydothermus hydrogenoformans Z-2901
  CDS (1)..(1197): transl_table=11
atggtcttggagataaaagcccggagtaggtttttttacaagtttaccgcttttatgggaccggcttttttagtttccattggttatattgatccgggaaactgggcggcaaactttgctggaggttcgcgttatggttcgatcatgttaataacggtgctgttatgcaattttttagctattttgtttcaatcgttggttgcctatttaactttaaagaccggaaaaagcctggcggaaaatattgtggaaaaattaccgaaacctctggtcgctttctacggagtgttggcggtaaccggagcaatggctaccgatgtggcggagttcgtaggagcagccctgggatttagtttaattctggggttggatcttttaaaaagcgttataatcgccgtggtatttgttgtttgtggttatttttttgaaaggcaggggaatcgcaaagtcgagtttttaattatgggttttttagctgctataggttttacttatcttatggagctgttaattttaaaacccaagatttataaccttattaatttaggtgtcaagctggatggtgattttctttttgtagtgttgagtatgcttggggctaccgttatgcctcataatctttttttgcacagtgatttgatagcggaaaaactaaagcagagaataataactactaaagatttcccagtggtttttttagaaaatttaattgcgttaaatctggcgtttttggttaattcggcgatgattgttgtggccaaagatatgttctatgattgtggagtagcggtggattccctgaggcttgcctatcatacccttgaaccggtgttaaacggttgggcagcactgatctttggattggccctggtgctatgcggccttagttcatccctcacgggtacgatagcgggacaaaatcttttagaaaagtttttacccgtaaatctttcggcactttcgagaaaaatgataatcataaccccggcgctgtatttctttttaaaaggcctgggtgaaatagagcttttgcttttaagtcaggtggttttgagctttgttttgccgtttgttttaatcgtgctcctctggtttttaaataatattgccaataaatatctgttaattttgggatggtttttaacggcaataattggaagctgcaatgtaattttgctttggacagcaattttttaa

SEQ ID NO: 8806 - protein, 398 aa, Carboxydothermus hydrogenoformans Z-2901
MVLEIKARSRFFYKFTAFMGPAFLVSIGYIDPGNWAANFAGGSRYGSIMLITVLLCNFLAILFQSLVAYLTLKTGKSLAENIVEKLPKPLVAFYGVLAVTGAMATDVAEFVGAALGFSLILGLDLLKSVIIAVVFVVCGYFFERQGNRKVEFLIMGFLAAIGFTYLMELLILKPKIYNLINLGVKLDGDFLFVVLSMLGATVMPHNLFLHSDLIAEKLKQRIITTKDFPVVFLENLIALNLAFLVNSAMIVVAKDMFYDCGVAVDSLRLAYHTLEPVLNGWAALIFGLALVLCGLSSSLTGTIAGQNLLEKFLPVNLSALSRKMIIITPALYFFLKGLGEIELLLLSQVVLSFVLPFVLIVLLWFLNNIANKYLLILGWFLTAIIGSCNVILLWTAIF

SEQ ID NO: 8807 - DNA, 1299 bp, Burkholderia sp. 383
  CDS (1)..(1299): transl_table=11
atgaacgaagcgatgatccaggcagtcgtgcccaagacgctgaccgagcaaacctgctccgacattcgcgaaacgctggcgggacgccggcgcggcgcaagaacggtgttgtcgtttgcggggcccgcagtggtcgcgtcgattgcctatatggatcccggaaactttgcgaccaacattcaggctggcgcaggctatggctatacgctgctgtgggtggtggcacttgcgaacgtcgtcgcgatgttgtttcagtcgctctcggcaaagctcgggctggtcacgggccgcaatctcgcggagctgtgccgcgattcattgccacggcgctgggtgatagcaatgtggggaatgagcgaggtcgccgcaatggcgaccgatctggccgagttcgtgggcggagcgataggcgtgtcgttgctgctgcatctgccgatgatcccgagcatgctgattacggccgctgtgacctacggcctgctgcaattcgagaagctcggtttccggcctttggaactcgcgatcgcggcactgattggcgtgatcggtttgtcgtatcttgcagaactgctgattgcgcccgtgcactggccatcggtggccctgcactcggttacgccgagcataccggatagcaatgcattgacgatctccgtgggcatcattggcgcgacggtcatgccgcatgtgttgttcctgcattccggactgacgcagaaccgagtgaggccgcgcaacgatcgagaatgctcgcagctgcttgcattctcgaatgtcgaggtggtggtggcgctcggcatcgccgggttgatcaacatggcgatggtgatcatggcatcgagcgcgtttcatctggggcacgcggacatcgcgagcatcgagaccgcgtggcgcacgttgacgccactgctcggcggtgcagccgcagggctttttctcaccgcgctgattgcatcgggaatttcgagttcggtcgtcggcacgatggcaggccagatgatcatgcaaggcttcgtcgggttccgtatcccggtgtgggtgcgacggcttgttacgatggcgccagcttttatcgtggtggcaagcggagtcgacgcgacccgcgcgcttgtactgagccaagtcatgctgagtatcgcgctaccggtgccgatgatcgcgttggtgtggtttacgtcgcgccgcgatttgatggggcgacacatgaaccgtcgggtgacgacagtcagtgcggtgctcgggacgctcctcgtactcgcgctcaatggcgttttactggtgcaactggcgttggggtga

SEQ ID NO: 8808 - protein, 432 aa, Burkholderia sp. 383
MNEAMIQAVVPKTLTEQTCSDIRETLAGRRRGARTVLSFAGPAVVASIAYMDPGNFATNIQAGAGYGYTLLWVVALANVVAMLFQSLSAKLGLVTGRNLAELCRDSLPRRWVIAMWGMSEVAAMATDLAEFVGGAIGVSLLLHLPMIPSMLITAAVTYGLLQFEKLGFRPLELAIAALIGVIGLSYLAELLIAPVHWPSVALHSVTPSIPDSNALTISVGIIGATVMPHVLFLHSGLTQNRVRPRNDRECSQLLAFSNVEVVVALGIAGLINMAMVIMASSAFHLGHADIASIETAWRTLTPLLGGAAAGLFLTALIASGISSSVVGTMAGQMIMQGFVGFRIPVWVRRLVTMAPAFIVVASGVDATRALVLSQVMLSIALPVPMIALVWFTSRRDLMGRHMNRRVTTVSAVLGTLLVLALNGVLLVQLALG

SEQ ID NO: 8809 - DNA, 1308 bp, Burkholderia sp. 383
  CDS (1)..(1308): transl_table=11
atgattcccgtcacgagcaaacctgccggcggcttcgcgctgccgggcctgtccaccgcgcacaccgacggtgccgcgcgcgccgcactggaagggcgccgcaccggcgtcgccgcgctgctgccgttcgtcggcccggccgtgatcgcgtcgatcggctacatggaccccggcaacttcgcgaccaacatccaggccggtgccgcgtacggctaccggctgctgtgggtcgtgctggccgcgaacacgatcgcgatgctgttccaggcgatgtcggcgaagctcggcatcgtgaccggccgcaatctcgcggagctgtgccgcgaccgctttcccgcgccggtcgtatggggcatgtgggtcgcgtccgaaatcgccgcgatggcgaccgacctcgccgaattcctcggtggcgcgctcgccttcgggctgttgtgccacctgtcgctgttcacggggatgatcgcgacagcgctcgcgacctgcgcgatcctcgcgctcgaaaagcgcgggttccggccgctggaggccgcgatcgcggcgctggtcggcgtgatcggcgcgtgctatctcggcgaactgctgatcgcgccgcaggactggcacgcggccgcgttccacctggtcgtcccgcagattccggatcacacggcgctgacgatcgcggtcgggatcattggcgcgacgatcatgccgcacacactgtacctgcattcggggctcacgcaggatcgcaccgcgccgcgcgacgacgcggagcggcggcggctcgtgcgtttctcgaaccgcgaggtcgtcgtcgcgctcgggctggccgggttcgtgaatctcgcgatggtgatgatggcgtcgtcggcgtttcacgcgagcgcgccgggcctgaccgacatcggcgacgcgtatcacacgctgatcccggtgctcgggccggcggccggcgcgctgtttctcgtcgcgctgctgacgtcgggcgtgtcgagttcggtggtcggcacgatggccgggcaggtcgtgatgcagggcttcatccaccgtcgcatgccggtctgggtgcggcgcgcggtgacgatcgtgcctgcgttcgcggtggttgcgttcggctgcgacgtcacgcgtgcgatggtcgcgagccaggtcgtgctgagcttcgtgctgccgctgccgatggttgcgctgctgatgctgtcggcgcgcgcggacgtgatgggtgcctacgcgatgcggctgccgctgcggatcgtcgccggggcggcgacggtcgtgatcgtcgggttgaatgcgtacctggtgtgggcggccttcaattga

SEQ ID NO: 8810 - protein, 435 aa, Burkholderia sp. 383
MIPVTSKPAGGFALPGLSTAHTDGAARAALEGRRTGVAALLPFVGPAVIASIGYMDPGNFATNIQAGAAYGYRLLWVVLAANTIAMLFQAMSAKLGIVTGRNLAELCRDRFPAPVVWGMWVASEIAAMATDLAEFLGGALAFGLLCHLSLFTGMIATALATCAILALEKRGFRPLEAAIAALVGVIGACYLGELLIAPQDWHAAAFHLVVPQIPDHTALTIAVGIIGATIMPHTLYLHSGLTQDRTAPRDDAERRRLVRFSNREVVVALGLAGFVNLAMVMMASSAFHASAPGLTDIGDAYHTLIPVLGPAAGALFLVALLTSGVSSSVVGTMAGQVVMQGFIHRRMPVWVRRAVTIVPAFAVVAFGCDVTRAMVASQVVLSFVLPLPMVALLMLSARADVMGAYAMRLPLRIVAGAATVVIVGLNAYLVWAAFN

SEQ ID NO: 8811 - DNA, 1317 bp, Burkholderia sp. 383
  CDS (1)..(1317): transl_table=11
atgtccctcctccccactaccgccaccgccccgttctgcccgtcggaagtaaagggcagcatcacgatcgatgccggtgcgccgcgctggctgaagctcaagcgcttcttcggccccggcctgctggtcgcgatcggctacatggatcccggtaactgggcgaccgacatccaggccggctcgcagttcggctattcgctgctgtgggtcgtcgcgttctcgagcctcgcggcgatcttcctgcagatgctcgcggcgcggctcggcctcgtcgccggcagggacctcgcgcaggccagctacgaccgctacggccggttcggccgcatcgtgcaatgggtgaccgccgaagtgtcgatcatcgcgtgcgacatcgcggaagtcctcggctgcgcgctcgcattcaagctgctgctcggcgtgccgctcgcgtgggggatcgtgctgaccgcgctcgacacggtgatcgtgctcggcctgcagggcaaggggttccggcagatcgaggcgatcgtgctcgcgctgatcgcgacgatggcgttctgcttcgtcgcgcaggtcgcgatcacgccgcccgactggcacgcggtggtcggcgggctggtgccgggcgatccgggccacgaccgcaaggacgcgatcgtgctcgcgctcggcatcgtcggcgcgacgatcatgccgcacaacctgtacctgcattcgtcggtcgtgcagacgcggcgcgtggtcggcggggcgcgcgggatgatccgcgacacactggcgctggtgcgcatcgataccttcgtgtcgctgttcgtcgcgatgctggtcaacgcggcgatcctggttgtcgcgggcgcggcgttccacgcgacgggccagcacaacgtgaccgacatcgagcaggcctacaagctgattacgccgatcgcgggcggcgcggccgcgctgctgttcggcatcgcgctgctcgcgtcggggcagagctcgacgctgaccggcacgatcgccggccaggtgatcatggacggcttcctgcatacgaagatcccgtgctaccagcgccggctgatcacgcgcgggctcgcgctcgtgccggcgctgatcggcgtgctgtggctcggcgacggctcggtcgggcaactgctggtgtggagccaggtgctgctgagcctgcagctcccgttcgcgatgtggccgctgatccgctcggtcagcgatcgcaacacgatgggcgagcacacgatcgggcgcgggatgcaaatcgccgcgtgggcgctgttcgccgtcatcaccggcacgaacctgttgctgattaccggtgtcgcgggctga

SEQ ID NO: 8812 - protein, 438 aa, Burkholderia sp. 383
MSLLPTTATAPFCPSEVKGSITIDAGAPRWLKLKRFFGPGLLVAIGYMDPGNWATDIQAGSQFGYSLLWVVAFSSLAAIFLQMLAARLGLVAGRDLAQASYDRYGRFGRIVQWVTAEVSIIACDIAEVLGCALAFKLLLGVPLAWGIVLTALDTVIVLGLQGKGFRQIEAIVLALIATMAFCFVAQVAITPPDWHAVVGGLVPGDPGHDRKDAIVLALGIVGATIMPHNLYLHSSVVQTRRVVGGARGMIRDTLALVRIDTFVSLFVAMLVNAAILVVAGAAFHATGQHNVTDIEQAYKLITPIAGGAAALLFGIALLASGQSSTLTGTIAGQVIMDGFLHTKIPCYQRRLITRGLALVPALIGVLWLGDGSVGQLLVWSQVLLSLQLPFAMWPLIRSVSDRNTMGEHTIGRGMQIAAWALFAVITGTNLLLITGVAG

SEQ ID NO: 8813 - DNA, 1350 bp, Burkholderia thailandensis E264
  CDS (1)..(1350): transl_table=11
atgtcgaatcattcagcactcgaacggatacccatcatgctttcctcaaccacgatgagccaatccgccggcgatttcgcgccggcgggcgacgtgacctcgcgcacgatccgcgcggcgcgcgacgcgctcgaagggcgccgcaagggcgtcgcggccgcgctgccgttcgtcgggccggccgtgatcgcgtcgatcggctatatggaccccggcaactttgcgaccaacatccaggcgggcgccgcatacggctacgagctgctgtgggtcgtgctcgccgcgaacgtgatcgcgatgatgtttcaggcgatgtcggcgaagctcggcatcgtgacgggccgcaatcttgccgagctgtgccgcgagcatttcccgcagcccgtcgtctggggcatgtgggtcgcatcggagatcgccgcgatggcgaccgacctcgccgaattcctgggcggcgcgctcgcgttcggcttgctgttccatctgccgctcatcgtcggaatgggcgcgacggccgtgctgacctgcgcgatcctcacgctggaaaagcgcggcttccggccgctcgaggccgcgatcgcggccttggtcggcgtgatcggcgcgagctatctcggcgagctgctgatcgcgccgcaggactggcatgcggccgcctatcatctcgtcgcgccgcagttgcgggacggcgcggcgctcacgctcgcggtcggcatcatcggcgcgacgatcatgccgcacacgctctatctgcactccggcctcacgcagcggcgcacggcgccgcgcgacgagcgcgagcgcaggctgctgctgcgcttctcgaaccgcgaggtggcggtcgcgctcggcgtcgccggcttcgtgaacatcgcaatggtgatgatggcgtcgtccgcgttccacgagacgatgccgggcatggccgacatcggcgacgcctatcacacgctgattccgctgctcgggccggcggcgggcgcgctctttctcgtcgcgctgttcgcgtccggcgtgtcgagctccgtcgtcggcacgctcgcggggcaggtcgtgatgcagggcttcctgcggcgccaggtgccgatctgggtgcggcggctcgcgacgatcgcgcccgcgttcgcgatcgtcgcgctcggctgtgacgtcacgcgcgcgatggtgctgagccaggtcgcgttgagtctcgtgctgccgctgccgatggccgcgctgctgctgctgtcgagccggcgcgcggtgctcggcgaccatgcgctgcgcatgccgatgcgggtcgtggcaagcgcggcggccgcggcgatcgtcgcgctgaacgggtatctgatctgggcggcgttccattga

SEQ ID NO: 8814 - protein, 449 aa, Burkholderia thailandensis E264
MSNHSALERIPIMLSSTTMSQSAGDFAPAGDVTSRTIRAARDALEGRRKGVAAALPFVGPAVIASIGYMDPGNFATNIQAGAAYGYELLWVVLAANVIAMMFQAMSAKLGIVTGRNLAELCREHFPQPVVWGMWVASEIAAMATDLAEFLGGALAFGLLFHLPLIVGMGATAVLTCAILTLEKRGFRPLEAAIAALVGVIGASYLGELLIAPQDWHAAAYHLVAPQLRDGAALTLAVGIIGATIMPHTLYLHSGLTQRRTAPRDERERRLLLRFSNREVAVALGVAGFVNIAMVMMASSAFHETMPGMADIGDAYHTLIPLLGPAAGALFLVALFASGVSSSVVGTLAGQVVMQGFLRRQVPIWVRRLATIAPAFAIVALGCDVTRAMVLSQVALSLVLPLPMAALLLLSSRRAVLGDHALRMPMRVVASAAAAAIVALNGYLIWAAFH

SEQ ID NO: 8815 - DNA, 1563 bp, Burkholderia thailandensis E264
  CDS (1)..(1563): transl_table=11
ttgtcgcacaaacggaacacatttgcacttttcgattgcacggcggggcgccgcgacgcggcaggtgggcgcaattttatcgggttatcggcgcgtgtccatcctgaaaaaaggcccgcgcaggccgaacggatcacctaccctaaattcaggcggcgcccgttcgtcgtttcggataggaggacgcgcgccccgcccgtccgaacgccgcgcccgccgcccggccgcgtgcgtcaaaccgttcgccggaccgccatcatgaacagtcgcccgcttgccgtccgccgtgcatcgcgccgcccgtccgcctccggcgggccgggcggcggcggccgctgggccgcgttcgtcggcgcgggcgtgctcgtcgccgtcggctacatggaccccggcaactgggcgaccgcgctcgcaggcggcgcaggctacggctacgcacttctcggcgtcgtgatcgccgcgagcctgatggcgatgctgctgcaatggctcgccgcgcggatcggcgtcgtgtccgggcgcgacctcgcgcaactgtgccgcgaacgcttcgacccgcgcgcgacggtgccgctgtggatcgccgccgaaatcgcgatcgtcgcctgcgacgtcgccgaggtcgtcggcgcggcggtcgcgctgcaaatgctgctcggcgtatcgctgacggcgggcgtgctcatatcggcgatcgcaacgctcgcgatgctcgcgctcgagcggcatggccggcgcacgctcgaggcggcgatcgcgtcgctcatccttttcgtcggcctctgcttcgtgatcgaggtcgcgcttgcgcggcccgactggcacgcggcgctcgcgggcgccgcgccgtcgccgcggctgctgcgcgagcccggcatgctgtggctcgcggccggcatcctcggcgcgaccgtgatgccgcacaacctctatctgcactcgatgctcgtcaagcaccacgcaagcgaacgcgacgagcagtcgatccggcgcgcgctgttcggcgtcaatctcgatacgttcgtgtcgctcggcttcgcgttcgtgatcaacgcggcgcttctcatcgtcgcggcggcggtgttccatgcgagcggccacgacgaggtcaccgatctcgccgatgcgcaccggctcatcgcaccgctcgtcggcaaccactgggcaggcctgctgttcgcggccgcgctgctcgcgtgcggactgtcggcgacggtgacgggcacgcttgccgggcaagcgatcatggaagggttcctgaagctctcgctgccgcgctggcagcgcgcgctcctcacccgcgcgctcgcgatcggcccggcgctcgccgcggtcggcctgttcgggcagcacggatcgaatcagttgctcgtcgcgagccaggtcgtgctgagcctgcaattgccgctcgcaatggttccgctcatcgtgttcgcgtcgagccgcgcgctaatgggaaactggcgtgtccgcggcttgccgctcgccgccgcatgggcgtgcgccgccgtgattctgctgctgaacggggcgctcgtctggcagatcgccgcggcgcagtga

SEQ ID NO: 8816 - protein, 520 aa, Burkholderia thailandensis E264
MSHKRNTFALFDCTAGRRDAAGGRNFIGLSARVHPEKRPAQAERITYPKFRRRPFVVSDRRTRAPPVRTPRPPPGRVRQTVRRTAIMNSRPLAVRRASRRPSASGGPGGGGRWAAFVGAGVLVAVGYMDPGNWATALAGGAGYGYALLGVVIAASLMAMLLQWLAARIGVVSGRDLAQLCRERFDPRATVPLWIAAEIAIVACDVAEVVGAAVALQMLLGVSLTAGVLISAIATLAMLALERHGRRTLEAAIASLILFVGLCFVIEVALARPDWHAALAGAAPSPRLLREPGMLWLAAGILGATVMPHNLYLHSMLVKHHASERDEQSIRRALFGVNLDTFVSLGFAFVINAALLIVAAAVFHASGHDEVTDLADAHRLIAPLVGNHWAGLLFAAALLACGLSATVTGTLAGQAIMEGFLKLSLPRWQRALLTRALAIGPALAAVGLFGQHGSNQLLVASQVVLSLQLPLAMVPLIVFASSRALMGNWRVRGLPLAAAWACAAVILLLNGALVWQIAAAQ

SEQ ID NO: 8817 - DNA, 1359 bp, Burkholderia thailandensis E264
  CDS (1)..(1359): transl_table=11
atgcgtaaaatgaccgccacgcacacaggccctcgaacatctcccatgccgctccccaccgtccccacggcgccgttttgccccgcagaagtcaaaggcagcatcacgatcgacgccggcgtctccggtctcgccaaactgcgccgcttcgccggcccgggcctgctcgtggcgatcggttacatggaccccggcaattgggcgaccgacattcaggccggctcgcagttcggctacgcgctgttgtgggtcgtcgtgttttcgagcgtcgccgcgatcttcctgcagatgctcgctgcgcggctcgggctcgtcgccggtcgcgatctcgcgcaggcgagctacgagcgttacgggccgttcggccggatcgtgcagtgggtcacggccgaggtatcgatcatcgcgtgcgacatcgccgaggtgctcggctgcgcgctggcgttcaagctgctgctcggcgtgccgctcgcgtggggcatcgttctcaccgcgctcgacacgatgatcgtcctcggtttgcagggcaaggggttcaggcaggtcgaggcgatcgtgctcgggctgatcggcacgatggcgttctgcttcgtcgcgcaggtcgcgatggtgccgcccgattggcgtgccgtgctgcatggccttgcgcccggcttgccgggccacgaccgcaaggatgcggtcgtgctcgcgctgggcatcgtcggtgcgaccatcatgccgcacaacctgtatctgcattcgtctgtcgtgcagacgcggcgcgtcgtcggcggcgtgggcgacgtaatcaaggaaacgctcgcgatggttcgcatcgacacgtggatatcgctcgccgtcgcgatgctcgtcaacgcggcgatcttgatcttggccggcgcggcgttccatgcaagcggtcagactggcgtcgtcgacatcgagcaggcctacaagctgatcacgccgatcgtcggcggcgcggccgcgtggctgctcggcatcgcgctcctcgcgtcgggccagagctcgacgctgaccggcacgatcgccgggcaggtcatcatggatggcttcctgcgcatgaagatcccgtgttaccaacgcaggctgatcacgcgcgggctcgcgctcatgccggcgctcgtcggcgtgctgtggctcggcgacggcgcggtcgggcggctgctggtctggagccaggtgctgttgagcctgcaattgccgtttgcgatgtggccgctgatccggtcagtcggtgatcgatcggtcatgcgcgattacacgatcgggcgcggagcgaagatcatcgcatgggcgcttttcgtgttgattagcggaacgaatctgttgctggtcgcgggtttcgccggttga

SEQ ID NO: 8818 - protein, 452 aa, Burkholderia thailandensis E264
MRKMTATHTGPRTSPMPLPTVPTAPFCPAEVKGSITIDAGVSGLAKLRRFAGPGLLVAIGYMDPGNWATDIQAGSQFGYALLWVVVFSSVAAIFLQMLAARLGLVAGRDLAQASYERYGPFGRIVQWVTAEVSIIACDIAEVLGCALAFKLLLGVPLAWGIVLTALDTMIVLGLQGKGFRQVEAIVLGLIGTMAFCFVAQVAMVPPDWRAVLHGLAPGLPGHDRKDAVVLALGIVGATIMPHNLYLHSSVVQTRRVVGGVGDVIKETLAMVRIDTWISLAVAMLVNAAILILAGAAFHASGQTGVVDIEQAYKLITPIVGGAAAWLLGIALLASGQSSTLTGTIAGQVIMDGFLRMKIPCYQRRLITRGLALMPALVGVLWLGDGAVGRLLVWSQVLLSLQLPFAMWPLIRSVGDRSVMRDYTIGRGAKIIAWALFVLISGTNLLLVAGFAG

SEQ ID NO: 8819 - DNA, 1365 bp, Burkholderia xenovorans LB400
  CDS (1)..(1365): transl_table=11
atgcgccgtgtttatccccttcaagagactcccggattgcagttcaaactaccgactacggcaacggcaccgttttgcccatccgaggtgcaaggctcggtggccgtcacgcaaggcgcgcctttctggaagaggattctgcaattcgcggggcccggcctgctggtctcgatcggctatatggacccgggcaactgggcgaccgacatcgaagcgggctcgcgctatgggtacagcctgctgttcgtcgtcatgctgtcgagtctcgcggcgatggcgctgcaatgtctgagcatgcgcctcggcattgctaccgggcgcgacctcgccgaattgtcgagaacacgctattcaccggccgtggcgcgctttcagtggctgttggcggaactctcgatcgtggcctgcgatctggccgaagtgctcggcggcgcactcgctttccatctgctcttcaaatgctcgctgaccaccggcgtgctgctgaccgcgttcgatacgctgatcgtgctcggcctgaagggcaagaatttccgcgacctcgaagcgatcatgctcgggctgatcgcgaccatcggcgtcgggtacatcatcgaactggcgctggtgcagccgcactggccatcggtcgcgcaggggctgattccgtcgtggcaggctttgagttcgcgcgagcccatgtatctggcaatcggcattctcggcgcgacggtcatgccgcataacctctatctgcattcgtcgatcgtgcagacgcgcgcggtgaagcgcgatcccgccagcatcaggtcggcgatcggcatgtcgcgcatcgacacgatcgtgtcgctcgtgctcgcgctgctgatcaacatggcgatcctgattctggccgccgccgcgttccatgccaccggccacaatcaggtcaccgaaatcgaggacgcctacaagctgctcgcgcccatcgtcggcaccggtttcgcagcggtgctgttcgccgtgaccttgctcgcctcgggacaaagctcgacctttaccggcacggtggcggggcaggtcatcatggaaggtttcctgaaactgaagattccgtgctggcaacggcgcttcatcacgcgggctctggcgttgattcccgcgctcatcggcgtgcagatgatgggcaacggcgctgtcggcaagctgctggtcgcaagccaggtcgtgctgagcctgcagttgccgttcgcgctttatccgctgatccgcatgaccaacgaccgttcgctgatgggcgaattcgccaatacgctgctgacgcggtgcgtcgcgtggacgctgttcgtggtgatcagcgcggcgaacctctggctggtggtgcaaacggccggattggccggatga

SEQ ID NO: 8820 - protein, 454 aa, Burkholderia xenovorans LB400
MRRVYPLQETPGLQFKLPTTATAPFCPSEVQGSVAVTQGAPFWKRILQFAGPGLLVSIGYMDPGNWATDIEAGSRYGYSLLFVVMLSSLAAMALQCLSMRLGIATGRDLAELSRTRYSPAVARFQWLLAELSIVACDLAEVLGGALAFHLLFKCSLTTGVLLTAFDTLIVLGLKGKNFRDLEAIMLGLIATIGVGYIIELALVQPHWPSVAQGLIPSWQALSSREPMYLAIGILGATVMPHNLYLHSSIVQTRAVKRDPASIRSAIGMSRIDTIVSLVLALLINMAILILAAAAFHATGHNQVTEIEDAYKLLAPIVGTGFAAVLFAVTLLASGQSSTFTGTVAGQVIMEGFLKLKIPCWQRRFITRALALIPALIGVQMMGNGAVGKLLVASQVVLSLQLPFALYPLIRMTNDRSLMGEFANTLLTRCVAWTLFVVISAANLWLVVQTAGLAG

SEQ ID NO: 8821 - DNA, 1347 bp, Burkholderia xenovorans LB400
  CDS (1)..(1347): transl_table=11
atgcggcttgcaagaggatgcagtcttgaacctcaggcactgatgaacaccaatccgtccgcattgcgacccaaccgacgccgacgcctgccggccagtggaccggcacgtccgccgcactggttctcgttcgtcggcgcgggcgcactgatcgcggtcggctatatcgatccgggcaactgggcgacggcgctcggcgccggggccggctacggctaccgcctgctcagcatggtattgctggcgagcctgatggcgatgctgctgcaatggctgtcgtcgcgcctcggcgtggtgaccggccgcgacctcgcgcagatctgccgcgagcgcacgagccgccgcggcaccctgttcctgtggctgacgagcgaggtcgcgatcatcgcgtgcgacgtcgccgaggtggtcggcagcgccgtcgcgttgcaattgctacttggcgtgtcgctcacggtaggcgtgttgatgtcggccgtctgcacgttcgcgctgctcgcgctccagcagaaaggcggccgcaagctcgaagcggtgatcgcggcgctgatcggctttgtcggcctgtgcttcgtggtccagctcgcgctcgcgcggccggactggcatgcagcgcttgccggcaccgtgccgagcgtcgaactgctgcgcaatgcgggcatggtgtggcttgcggcgggcatcgtgggcgcgaccgtgatgccgcacaacctctatctgcactcggcgctcgtcaagcaccacgcgccggagggcagcgacgcgcagatcaaggccgcgctgcacgtggtcaatctcgacaccttcggctcgctctcgtttgcgttcgtgatcaatgcggcgctgctgatcgtggccgccgccgtgttctacgtgagcgggcatcgtgacgtgaccgatctcgcggatgcccaccggctgatcgcgccgctcgtcggcacgcactgggccggcatcctgttcgcggccgcgctgctcgcctgtgggttgagcgcgacggttaccggcacgctggccggccaggcggtcatggaaggctttctgcgcatccgcctgccgcgctggcagcgcgccctgctgacccgcgcgctggcaatcgggccggcgctcctcgcagtcgcgctgttcggccagcatggttccaaccagttgctggtggcaagtcaggtagtgctgagcctgcaattgccgctcgcggtcgtgcctttgatccgttacacctcggacgccggactcatgcgcggctggcgcgtgcgcggcgtgccgctcgcgctcgcctggctgtccgccgcgttcatcgtgatgctcaatggcgcgctgctgtggcaactggcgtttggcaattga

SEQ ID NO: 8822 - protein, 448 aa, Burkholderia xenovorans LB400
MRLARGCSLEPQALMNTNPSALRPNRRRRLPASGPARPPHWFSFVGAGALIAVGYIDPGNWATALGAGAGYGYRLLSMVLLASLMAMLLQWLSSRLGVVTGRDLAQICRERTSRRGTLFLWLTSEVAIIACDVAEVVGSAVALQLLLGVSLTVGVLMSAVCTFALLALQQKGGRKLEAVIAALIGFVGLCFVVQLALARPDWHAALAGTVPSVELLRNAGMVWLAAGIVGATVMPHNLYLHSALVKHHAPEGSDAQIKAALHVVNLDTFGSLSFAFVINAALLIVAAAVFYVSGHRDVTDLADAHRLIAPLVGTHWAGILFAAALLACGLSATVTGTLAGQAVMEGFLRIRLPRWQRALLTRALAIGPALLAVALFGQHGSNQLLVASQVVLSLQLPLAVVPLIRYTSDAGLMRGWRVRGVPLALAWLSAAFIVMLNGALLWQLAFGN

SEQ ID NO: 8823 - DNA, 1281 bp, Acidobacteria bacterium Ellin345
  CDS (1)..(1281): transl_table=11
ttgcccgaggtgcacagcagcctgccgatcccgagcgggccgagcttcctgcgcaaactcgtcgcgttcgccggaccgggcttcctggttgccgttggatacatggacccgggcaactgggccaccgatctcgccgccggatcgcaattcaattacgcgctgctctcagtcgtgctgatctcgagcttgatggcaatcctcctgcaatcgctctctctgaagcttgggatcgtggtcgagcgcgacctcgcgcaggcttgccgcgatgcgtattccaagccggtgagcattgggctttgggtgctggcggaaatcggcattgccgcatgcgatcttgccgaagtgattggctcggcgatcgcgctgcagctgttgtttcatatcccgctcaccatcggcgtgtgcatcaccgctggcgacgtgctgctcatgctgctgttgcagcagcgcggctttcgctacattgaggcgatcgtcgtcaccctgattgcgaccatcagcatctgcttcggcctggagattctgtactcgcggcctgagctttggccgatgctcgccggttttctgccgcaccaggaactcgtcactaaccacgcgatgctctatatcgcggtcggcattcttggcgctacggtgatgccacataatctctacctgcactcggcgatcgtgcaaacgcgccagtacgagcgcacgcctgaaggcaaacgcgaggcgatcaagtactgcaacatcgattcggcgattgcgctctcgttcgcgttcctggtaaatgccgcgattttgatcatggctgcgtcggtgttctaccgcagcggacaccgcgaggttgccgagatcagcgacgcctatcgcctgctctcgccgctgctcggcgtcaccggcgcgagcgtgatcttcgccatcgcgctgctggcgtcgggccagaactccaccctcaccggcacgctcgccggacagatcgtgatggaaggcttcctctccatccgcctgaaaccgtggctgcgccggctggtcacgcggctgatcgcgatcattccggcggtgatcatcagcttcttctacggcgccagcggcaccgcgaagctgctcatcttcagccaggtcgtgctctccatgcagctgagcttcgccgtcttcccgctggtggcgttcaccagttcgaaagagaagatgggcgagttcgcgaatggggcgctcttgaagttggtcgcttggaccgtcgcgatcgtcatcgcggggctgaatatttggttgctggtggaagcggtgcgagggtaa

SEQ ID NO: 8824 - protein, 426 aa, Acidobacteria bacterium Ellin345
MPEVHSSLPIPSGPSFLRKLVAFAGPGFLVAVGYMDPGNWATDLAAGSQFNYALLSVVLISSLMAILLQSLSLKLGIVVERDLAQACRDAYSKPVSIGLWVLAEIGIAACDLAEVIGSAIALQLLFHIPLTIGVCITAGDVLLMLLLQQRGFRYIEAIVVTLIATISICFGLEILYSRPELWPMLAGFLPHQELVTNHAMLYIAVGILGATVMPHNLYLHSAIVQTRQYERTPEGKREAIKYCNIDSAIALSFAFLVNAAILIMAASVFYRSGHREVAEISDAYRLLSPLLGVTGASVIFAIALLASGQNSTLTGTLAGQIVMEGFLSIRLKPWLRRLVTRLIAIIPAVIISFFYGASGTAKLLIFSQVVLSMQLSFAVFPLVAFTSSKEKMGEFANGALLKLVAWTVAIVIAGLNIWLLVEAVRG

SEQ ID NO: 8825 - DNA, 1266 bp, Rubrobacter xylanophilus DSM 9941
  CDS (1)..(1266): transl_table=11
atgcggcgtgcgggcgaggatccggtggggcttgcggcgcggtcggcgctcgagggcgggcggcgggggcttggccgggtgtggccgtttctggggccggcgttcgttgcggcggtggcgtatgtggaccccgggaacttcgcggcggacatggagggaggggcgcggtacgggtacctgctgctatgggtcgtggcgtgcgccgacctggtggcggtgctggtgcagtccatgtcggcgcggctggggatcgccacggggaggaacctcgcggagctgtgccgggaggcgtttccctggccggtggtggcgctgctgtggctgcaggcggaggcggtggcgatggcgacggaccttgcggagttcgtgggggcggcgctggccctgcggctccttttcgggctggcgcttctgcccgccgcgctgctgacgggggcggcggtcttcgggctgctcgccctgcagcggcggggggtgaggccgctggaggccgcggtgtcggcgatggtgggggtcatagtcctggccttcgcgctgcaggtgtttctctccggaccggagtgggggcgggccgtcgccgggcttctggagcccggcttcgcggggccggggagcgtgctgcttgcggccgggatcctgggggccaccgtcatgccgcacgccatatacctgcactcggcgctcgtgcagcggcgggtcgtcggccgcaccgcggaggagcggcgcaggatctaccgcttcgagctcctcgacgtcgcggtggcgatgggcctcgcggggctggtgaacgcgagcatgctggtcgtggccgccgccctgttccacccgggcggcgcggcgggcctggaaggggtgttctacgggatctccgcgctcgaggggcgctgggcggccctgctcttcgggctcgcgctcctggccagcggcctctccagctcctccgtgggcaccatgagcgggcaggtcgtgatgcagggcttcgtctcccgcagcatcccgctcttcgcccgccgggcgctcaccatggcccccgccctcgcggtcatcgccgccggcgtggaccccgcgcgggccctcgtcctcagccaggtcgtcctctccttcggcatccccttcgccctcgtccccctcatcctcttctgccgcgaccgcgccctcatggggtccctcgccgccggacgccccctcaccgccgcggccgccgccgcggcggcggccgtgatctccctgaacgtcctcctcctctgccagaccctccggccgtag

SEQ ID NO: 8826 - protein, 421 aa, Rubrobacter xylanophilus DSM 9941
MRRAGEDPVGLAARSALEGGRRGLGRVWPFLGPAFVAAVAYVDPGNFAADMEGGARYGYLLLWVVACADLVAVLVQSMSARLGIATGRNLAELCREAFPWPVVALLWLQAEAVAMATDLAEFVGAALALRLLFGLALLPAALLTGAAVFGLLALQRRGVRPLEAAVSAMVGVIVLAFALQVFLSGPEWGRAVAGLLEPGFAGPGSVLLAAGILGATVMPHAIYLHSALVQRRVVGRTAEERRRIYRFELLDVAVAMGLAGLVNASMLVVAAALFHPGGAAGLEGVFYGISALEGRWAALLFGLALLASGLSSSSVGTMSGQVVMQGFVSRSIPLFARRALTMAPALAVIAAGVDPARALVLSQVVLSFGIPFALVPLILFCRDRALMGSLAAGRPLTAAAAAAAAAVISLNVLLLCQTLRP

SEQ ID NO: 8827 - DNA, 1347 bp, Mesorhizobium sp. BNC1
  CDS (1)..(1347): transl_table=11
atgaccgattcgacgtcggacgtcgccaacggctggaagggcaggtcgagtgccccttcaatgtccgatgtgcaccggtcagtgcccgtgcagggcatgcactcgtcctggcgccgggccgccgccttcatcggtccaggctatcttgtcgccgtcggctatatggaccccggcaactgggcgacgtcgatcgcaggcggctctcgcttcggatacaccctgctcgtggtggccctgatctccaacatcatggcgatcatcctccaatccctttgcgcgcggctcgccatcgcgtccggtagggacctggcgcaggcttgcaaggatgcctatccaaaatccgtgtcgcgtaccctgtgggtgctggccgagatcgcgatcatcgcgaccgacatcgccgaggtcatcggaacggccatcggcctgaacctgctctttggcattccgctggaaattggcgtcgtgatcaccgcgcttgacgtcttcctcatcctttatctgcaaaggctcggcttccggtgggtcgaagcactggtgatcgcgctgctcgccgtaatcgccgtctgcttcgtgcttcagattgtcctggcggatccgaactggggcgacgtcatccgcggtttcgccccgaccaccgagatcgtcaccaatcccgaaatgctctacctcgccctgggcatcctcggcgcgacggtgatgccgcataacctctatctccactccgggatcgtccagacgaggaattatggcgacagcctgccggagaagcgcgaagcgctgaagttcgccacgatcgactccacggtcgcactcatgttcgcactctgtgtgaatgcgtcgatcctcatccttgccgcagccacgttcaacacgaccggaaggacggaaatcgccgaattgggcgaagcccacagcttgctggctccgatgctcggcgcggccatcgcgccgaccttgttcgggatcgcactcctttgctgtggcataaactcgacggtgacggcgaccctggcgggacagatcgtcatggaaggcttcctcgatatcaagctaccaccctggctccgccggctcatcacgcgggcgatcgccatcattccggccgcggcgatcaccatctggtacggagagagcggcaccgcccagctcctgatcttgacccaggtgatcctcagccttcagctgtctttcgcggtatttccgctggtgatgttcactgccgaccggaaaaagatgggtgaactggtggcgccccgtgcgctggtcgccgtcgccttcttcatcgcctttgccatcgctgccctgaacgtcacgctgctcttcgactttcttgcgcccccggcttga

SEQ ID NO: 8828 - protein, 448 aa, Mesorhizobium sp. BNC1
MTDSTSDVANGWKGRSSAPSMSDVHRSVPVQGMHSSWRRAAAFIGPGYLVAVGYMDPGNWATSIAGGSRFGYTLLVVALISNIMAIILQSLCARLAIASGRDLAQACKDAYPKSVSRTLWVLAEIAIIATDIAEVIGTAIGLNLLFGIPLEIGVVITALDVFLILYLQRLGFRWVEALVIALLAVIAVCFVLQIVLADPNWGDVIRGFAPTTEIVTNPEMLYLALGILGATVMPHNLYLHSGIVQTRNYGDSLPEKREALKFATIDSTVALMFALCVNASILILAAATFNTTGRTEIAELGEAHSLLAPMLGAAIAPTLFGIALLCCGINSTVTATLAGQIVMEGFLDIKLPPWLRRLITRAIAIIPAAAITIWYGESGTAQLLILTQVILSLQLSFAVFPLVMFTADRKKMGELVAPRALVAVAFFIAFAIAALNVTLLFDFLAPPA

SEQ ID NO: 8829 - DNA, 1263 bp, Rhodococcus sp. RHA1
  CDS (1)..(1263): transl_table=11
gtgagcatcgaggcaccccgccctctcctcccgcgccgcacgccccgcaagggcagtatccgaacggtcgcgctcctcgggcccgccttcgtggcggccatcgcgtacgtcgaccccggaaacgtggccgccaacctcaccgcgggcgcgaagtacgggtacctgctcgtctgggtcctcgtgctcgccaacgccatggccgtgctggtgcagtacctctccgcgaaactcgggctggtcactggcaaatcactgcccgaaatgctggggacccgcctgaggaccggtaaccgtcgcgcgttctggctgcaggcggaggcgatggccgtcgccaccgacctcgccgaggtgatcggcggcgcgatcgcactcaatctcctgttcggcgttcccctcttcgccggaggcctgatcacgggcgtcgtatcgatgggcatcctgtcgatccagagtcgccgcggtcagcggacgttcgagttcgtcgtgatgggactcctgacgatcatcaccgtcgggttcctcaccgggctcgcgttcaccgacgtgtcgggcacggacgcgctcgccggactcgtgccgcgtttcgagggcaccgagacggtcctgctcgccgcgagcatgctcggcgccaccgtgatgccgcacgcgatctacctgcactccgccctcgcccgcgaccggcacgggaacgacctggaaggaccacgcctcgcgcggctgctacgggtgacgaagtgggacgtggtcggtgcgctgatcgtggcgggcgcagtgaacatcggcatgctgctgctcgccgcctcggccctgagcggcatccccggcaccgattcgatcgacggcgcgcacgccgcgatccagagttcgctcggccccaccgtcgccgtcatcttcgccgtcggactgctggcttccggcctggcgtccacgtcgatcggctgcgccgccggctccgagatcatgtacggcctgctgtcgatgcgcatcccgctgctgctacgccgggtggtcaccctgattcccgcactggtcgtgctggcggtcggcgtggatcccacgttcgcgctcgtcctcagtcaggtggtgctcagcctgtgcatcccgttcgcggtgattccactcgtgcggatgacgtcgagccacgacctgatgggcgtccaccgcaacgcgacggccaccacggtcgccgcctgggtggcggcgtcgctgatcgtcgtgctcaacgtgtcgctgctgtggctgacattcacgggctcggcctga

SEQ ID NO: 8830 - protein, 420 aa, Rhodococcus sp. RHA1
MSIEAPRPLLPRRTPRKGSIRTVALLGPAFVAAIAYVDPGNVAANLTAGAKYGYLLVWVLVLANAMAVLVQYLSAKLGLVTGKSLPEMLGTRLRTGNRRAFWLQAEAMAVATDLAEVIGGAIALNLLFGVPLFAGGLITGVVSMGILSIQSRRGQRTFEFVVMGLLTIITVGFLTGLAFTDVSGTDALAGLVPRFEGTETVLLAASMLGATVMPHAIYLHSALARDRHGNDLEGPRLARLLRVTKWDVVGALIVAGAVNIGMLLLAASALSGIPGTDSIDGAHAAIQSSLGPTVAVIFAVGLLASGLASTSIGCAAGSEIMYGLLSMRIPLLLRRVVTLIPALVVLAVGVDPTFALVLSQVVLSLCIPFAVIPLVRMTSSHDLMGVHRNATATTVAAWVAASLIVVLNVSLLWLTFTGSA

SEQ ID NO: 8831 - DNA, 1341 bp, Rhizobium leguminosarum bv. viciae 3841
  CDS (1)..(1341): transl_table=11
atggacgtccttaatccgaatccaaagagcggctggcggcacgaacgcggcgaggcgtcgctgtccgatgtctaccgcaccgtcggaaccgggcgtcacagctcggcatggcgaagggcggcagccttcgccgggccgggctacatggtcgccgtcggctacatggaccccggcaactgggcgacctcgctcgccggcggctcgaaattcggctatgcgctgctcaccgtcgcgctgctttccaacctgatggcgatcgtgctgcaatcgctctgcgcgcgcctggcgatcgcctccggccgcgacctcgcacaggcctgccgcgacgcctttccgaaatatgtctcgctgccgctttgggcctttgctgaaatcgccatcatcgccaccgatatcgccgaggtgatcggcacggcgatcggcctcaacctgttgatgggcatcccgctcgaactcggcgtgctgatcaccgcgctcgacgtcttcgtgatcctcttcctgcagaagctcggcttccgctgggtggaagccttcatcatcgcgctgctcggcgtcatcgcggtctgcttcggcgtgcagatcctgctggccgacccgcaatggggcgcggtccttaccggcttcttcccaacgaccgagatcgtcaccaatccggagatgctctatctggcgctcggcattctcggtgcgaccgtcatgccgcacaatctctacctccactccggcatcgtccagacacgggcctatggccataccattcccgaaaagagggaggcgctgacctttgcaacgatcgactcgacggtcgcgctctgtttcgcgctgctgatcaacgcgtcgatcctgatcctggcggccgccgccttcaatgcgcacggcaagaccgacgtcgtcgaactcggcgatgcctactcgctgctgtcgccgctgcttggcctcgccatcgcgccgacgctgttcggcatcgcgcttctctgctgcggtctcaactcgacagtgacggcgacgcttgccggccagatcgtcatggaaggcttcctcaagatcaggctgaagccgtgggtgcgccgcctgattacccgtgccatcgccatcgtgccggcagcgatcgtcaccatctggtatggcgacaagggcacggcggagcttttgatcctcacccaggtggtgctcagcctgcagctttccttcgccgtcttcccgcttgtgatgtttaccgccaacaaggccaagatgggcgaactcgtggcgccgcgctggctgagtggcgttgcctatctgatcgcggtcgtgatagccggactgaacgtcaagctgctcctcgacttcgtcaccggctga

SEQ ID NO: 8832 - protein, 446 aa, Rhizobium leguminosarum bv. viciae 3841
MDVLNPNPKSGWRHERGEASLSDVYRTVGTGRHSSAWRRAAAFAGPGYMVAVGYMDPGNWATSLAGGSKFGYALLTVALLSNLMAIVLQSLCARLAIASGRDLAQACRDAFPKYVSLPLWAFAEIAIIATDIAEVIGTAIGLNLLMGIPLELGVLITALDVFVILFLQKLGFRWVEAFIIALLGVIAVCFGVQILLADPQWGAVLTGFFPTTEIVTNPEMLYLALGILGATVMPHNLYLHSGIVQTRAYGHTIPEKREALTFATIDSTVALCFALLINASILILAAAAFNAHGKTDVVELGDAYSLLSPLLGLAIAPTLFGIALLCCGLNSTVTATLAGQIVMEGFLKIRLKPWVRRLITRAIAIVPAAIVTIWYGDKGTAELLILTQVVLSLQLSFAVFPLVMFTANKAKMGELVAPRWLSGVAYLIAVVIAGLNVKLLLDFVTG

SEQ ID NO: 8833 - DNA, 1317 bp, Pseudomonas aeruginosa UCBPP-PA14
  CDS (1)..(1317): transl_table=11
atgtccgcgaaggataccccggccccccaggccgccgagcccggtcgcgcccagccggtcgaagtccccggtggcggccactggtggcgccgcctgctggccttcgccggccccggctacctggtcgcggtgggctacatggacccgggcaactgggccaccgacgtcgccggcggcgcgcagctgggctacctgctgctctcggtgatcctgctctccagcctgatggcgatgctgctgcaggcgctgtccgcgcgcctgggcatcgccagcggcctggacctggcccaggcctgccgcgaacgctactcgccgagcacctgccgcctgctgtggctggcctgcgagacggcgatcatcgcctgcgacctggccgaggtgatcggcaccgccatcgccctgaagctgctgttcggcctgccgctggcctggggcgcgttgctctgcgtgggcgacgcgctgctggtgctggtcctgatcggacgtggccagcggccgctggaggccttcgtggtggcgttgctgacactgatcttcgcctgcttcgcggtacagttgctgctctcgcgtcccgaactcggcgaggtgctccaagggttcttgccgagcccgcgggtgctcagcgatccggctgccctgtacctggcgatcggcatcgtcggcgcgaccgtcatgccgcacaacctctacctgcattcctcgctggtgcagagccgcgcctacccacgcagcctcgccggcaagcgccaggcgctgcgctgggcggtggccgacagcagcctggcgctgaccctggcgctgctggtcaacgcggcgatcctgatcgtcgccgccagcgtgttccaccgcaacgggcacaccgaagtggtcgatatcgagcaggcccacgcgctgctctcgccattgctcggcctggaactcgcctcgctgctgttcgccgtggcgctgctcgcgtccggcctcaactcgacggtcaccaccaccctggccgggcagatcgtcatggagggcttcctccgcctgcgcctggcgccctgggcgcggcgcctgctgacccgtggcgtcgcggtgctgccggtgctgctggtgaccctgctctacggcgaggacggcaccgcgcggctgctgatcttcagccaggtgatcctgtcgatgcagttgccgctggcggtgatcccgctgctacagttcgtttctgaccggcgcctgatgggcccgctggcgatcggcgccgggacccggtggctggcctgggcggtagcgctggcgatcgtcggcctgaacctgcaactgctggccgacttcgcgttcggctga

SEQ ID NO: 8834 - protein, 438 aa, Pseudomonas aeruginosa UCBPP-PA14
MSAKDTPAPQAAEPGRAQPVEVPGGGHWWRRLLAFAGPGYLVAVGYMDPGNWATDVAGGAQLGYLLLSVILLSSLMAMLLQALSARLGIASGLDLAQACRERYSPSTCRLLWLACETAIIACDLAEVIGTAIALKLLFGLPLAWGALLCVGDALLVLVLIGRGQRPLEAFVVALLTLIFACFAVQLLLSRPELGEVLQGFLPSPRVLSDPAALYLAIGIVGATVMPHNLYLHSSLVQSRAYPRSLAGKRQALRWAVADSSLALTLALLVNAAILIVAASVFHRNGHTEVVDIEQAHALLSPLLGLELASLLFAVALLASGLNSTVTTTLAGQIVMEGFLRLRLAPWARRLLTRGVAVLPVLLVTLLYGEDGTARLLIFSQVILSMQLPLAVIPLLQFVSDRRLMGPLAIGAGTRWLAWAVALAIVGLNLQLLADFAFG

SEQ ID NO: 8835 - DNA, 1257 bp, Pseudomonas aeruginosa UCBPP-PA14
  CDS (1)..(1257): transl_table=11
gtggcggtgccggccgacgcctcgccgctgcgcaagctggcgctgttcgtcggccccggcctgctggtctcggtcggctacatggaccccggcaactgggccaccgccatcgaggcgggctcgcgcttcggctacgcgctgctgttcgtggtggtgctggcgagcttttccgggatgctcctgcaaagcctctgttcgcgcctggggatcgccaccggccgcgacctcgcgcagctctcccgggagcgctatcgccctggcgtggcgcgtggccaatggctgctggcggaactgtcgatcgtcgccaccgaccttgccgaggtgctcggcgcggcgctggccttccacctgctgctgggcgtctcgattaccaccggggtggtcctcaccgccttcgataccctgatcgtgctggccctgcagggcgccaacttccgccgcctggaggccatagtgctggggctgatcgcgaccatcggcgcgtgtttcttcgtcgaactggtgctgatcggcccctactggccggatgtcgccgccggcctgcggccatcctgggacaccctgagcagccaggagccgctgtacctggcgatcggcatcctcggcgcgacggtgatgccgcacaacctctacctgcattcgtccgtggtgcagacccgggtcagcggcgacgacgcggcgagcaaacgctcggcgatccgcttttcccggctcgacaccatcggctcgctgtccctggcgctgctggtcaatgcggcgatcctgatcctcgccgccgcggctttccacggcagcggccataccgaggtggtggagatccaggacgcctaccacctgctcgacccgctggtgggcggcgccctggccagcttcctgttcggcttcgccctgctggcggcggggcaaagctcgaccttcaccggcaccattgccgggcaggtggtgatggagggtttcctccgggcgaagattccctgctggcagcggcgcctgatcacccgcggcctggccctggtgccggccttgatcggcgtgctctggctgggcgaaggcgcggtaggcaagctgctggtgctcagccaggtggtgctcagcctgcaattgccgttcgccctgtggccgctgattcgcttcagcagcgaccggaacctgatgggggagttcgtcaacccgcgctgggtcagcgcgctggcctggtcgttgttcggcctgatctcggcggcgaacctgaccttgctgtatttctggttcggctga

SEQ ID NO: 8836 - protein, 418 aa, Pseudomonas aeruginosa UCBPP-PA14
MAVPADASPLRKLALFVGPGLLVSVGYMDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEGAVGKLLVLSQVVLSLQLPFALWPLIRFSSDRNLMGEFVNPRWVSALAWSLFGLISAANLTLLYFWFG

SEQ ID NO: 8837 - DNA, 1602 bp, Pediococcus pentosaceus ATCC 25745
  CDS (1)..(1602): transl_table=11
atgattttgatgagtaatgagatcaagaacccaaagaaacgtcgcaaattagtggaatacgctaatggacgatcattggaagaaataaatgggacagttaaggtgcctaagaatattggtttttggaaggcactgtttatgtattcgggtccgggagcattagttgctgttggttatatggaccctggtaattggtcaacatcaatcactgggggtcaaaacttccagtacatgctaatgtcgattatcttgatttcgagtttaatcgcgatgttgttacaatatatggcggctaaactgggaattgtgagtcaaatggacttagcgcaggcaattcgcgctagaacaagtaagtcattgggaattgtattatggattttaacggaattggcaattatggcgactgatatcgctgaagtaattggtgctgcaattgcgctgtatttgttgttccatattccgctagccatcgcggttttcattaccgttttggatgtactgctattactgttattgactaagattggttttagaaaaattgaagccattgtggtgtgtttaatcatggttattttagtggttttcgtctaccaagttgctttatcaaatccaaattggggtgcggtatttagcggcttagtaccaaccactaaagcatttgaaacttcaccaacaattggcggaatgactcctttaagtgggtcactaggaattattggtgcgacagttatgcctcataacttgtacttgcactcagcggtttcacaaacgcgtgaaattgatcataacgatgaagaagacgtagcaagaacgctacgcttctcaacttgggattcaaatattcagctatcattcgcatttatcgttaattcacttctattggtgatgggagttgccgtatttaagtccggcgctgtccaagatccatcattctttggtctattccatgcgttaaatgatacttcaactttgagtaacggaattttgattggagttgccaaaactggggtactttcgacattatttgcggtagctttgttggcttctggtcaaaattcaaccatcacgggaacgttaaccggccaggttatcatggaagggttcattcacatgcgaatgccactttgggcacggcgtttgattacccgtttgatttcagttgtaccagttttgatttgtgtcatgattaccagcggtaaaggtgatcttcaagaacacgaagccctaaatcagttgatgaataactctcaagtatttttggcttttgcattaccattctcaatgattccattgttgatgatgacggatagtcgcgttgaaatgggtgatcgatttaagaatagttgggcggtcaaaattttaggttggatttcggttattttcctaacctacctcaatatgactggtttaccaaattcaattacggccttctttggagctaatccaagtgctggtgaagtagagctggcgcacataattgcctatatgctagtggcagtagttctagcactcctagcttggacagtctttgaactccataaaggtaaccaacgttacgaattggaaatgcgaagtaaagcagaagctaaggaggaagcataa

SEQ ID NO: 8838 - protein, 533 aa, Pediococcus pentosaceus ATCC 25745
MILMSNEIKNPKKRRKLVEYANGRSLEEINGTVKVPKNIGFWKALFMYSGPGALVAVGYMDPGNWSTSITGGQNFQYMLMSIILISSLIAMLLQYMAAKLGIVSQMDLAQAIRARTSKSLGIVLWILTELAIMATDIAEVIGAAIALYLLFHIPLAIAVFITVLDVLLLLLLTKIGFRKIEAIVVCLIMVILVVFVYQVALSNPNWGAVFSGLVPTTKAFETSPTIGGMTPLSGSLGIIGATVMPHNLYLHSAVSQTREIDHNDEEDVARTLRFSTWDSNIQLSFAFIVNSLLLVMGVAVFKSGAVQDPSFFGLFHALNDTSTLSNGILIGVAKTGVLSTLFAVALLASGQNSTITGTLTGQVIMEGFIHMRMPLWARRLITRLISVVPVLICVMITSGKGDLQEHEALNQLMNNSQVFLAFALPFSMIPLLMMTDSRVEMGDRFKNSWAVKILGWISVIFLTYLNMTGLPNSITAFFGANPSAGEVELAHIIAYMLVAVVLALLAWTVFELHKGNQRYELEMRSKAEAKEEA

SEQ ID NO: 8839 - DNA, 1344 bp, Pediococcus pentosaceus ATCC 25745
  CDS (1)..(1344): transl_table=11
atgtcagaaaaacttgatgaagtagatagtaagagcctggacgagattaatggtagtatcaaggtacctaagaatgcaggcttttggaagacgctgatggcgtactccggacccggatttttaattgcggttggttatatggatccaggtaactggattacgtcaattgcgggtggggcgcaatttagatatacgctcctttcagttattttactttctagtttaatcgcgatgcttttacaggcaatgtcagcgagactaggaattgtaactggaaaagatttagcgcagttaacgcgggaacgaacgagtaaaagagttggattcttgctgtggattgtcgctgaattagcgattatggctacagatattgccgaaattattggatctggaattgcattggagctgttattccatattccattgattattggtattttgattacagcggcagatgttttgatattgctgctattaatgaagctcggttttagaaaaatcgaagcaattgttgcaaccttagttgctgttattttaattgtttttgcgtacgaagtgctgctttctgatccaagtatttcagggattatcaaagggtatgtaccttcagttgagattttaggtaataactcaatgttgtatctatcactaggaattgtcggtgcgacagttatgccccatgatttgtatctgggttcttcaatttcacaaactcgtgaagtggaccgaaaagatcgggaaaatgtcgctcaagcaattcgtttttcaacgattgactctaatatgcaactattcttagctttcattgttaatagtttactattgattttgggagcggccttattctatggaacggatagttcactaggacgtttcgttgatttgtttaatgctttaagtaataaccaaattgttggggccattgctagcccagtacttagtatgctatttgctgtagccttacttgcttctggacaaagctcaacaattaccggaacattatctggtcagattatcatggaaggattcattcgactacgtgtcccattgtgggtacaacgtttggtgactcgagttctttctgtggcaccagttttgatttttgccatttattaccacggtgatgaagctaaaattgaaaacttactaacgttctcgcaagtattcttaagtgtggctttaccgtttgcggtaattcctctggttatatatacaagcagtaaaaagttgatgggtgaatttgctaatcgagcatgggtaaaatggtgtgcttggactgcaacaattgtcttgattttgttaaatatatatttaatccttcaaacgctaggtttaatcaaataa

SEQ ID NO: 8840 - protein, 447 aa, Pediococcus pentosaceus ATCC 25745
MSEKLDEVDSKSLDEINGSIKVPKNAGFWKTLMAYSGPGFLIAVGYMDPGNWITSIAGGAQFRYTLLSVILLSSLIAMLLQAMSARLGIVTGKDLAQLTRERTSKRVGFLLWIVAELAIMATDIAEIIGSGIALELLFHIPLIIGILITAADVLILLLLMKLGFRKIEAIVATLVAVILIVFAYEVLLSDPSISGIIKGYVPSVEILGNNSMLYLSLGIVGATVMPHDLYLGSSISQTREVDRKDRENVAQAIRFSTIDSNMQLFLAFIVNSLLLILGAALFYGTDSSLGRFVDLFNALSNNQIVGAIASPVLSMLFAVALLASGQSSTITGTLSGQIIMEGFIRLRVPLWVQRLVTRVLSVAPVLIFAIYYHGDEAKIENLLTFSQVFLSVALPFAVIPLVIYTSSKKLMGEFANRAWVKWCAWTATIVLILLNIYLILQTLGLIK

SEQ ID NO: 8841 - DNA, 1335 bp, Oenococcus oeni PSU-1
  CDS (1)..(1335): transl_table=11
atgaaaaccgatcaaaaacaagacaatcaacaaaaaagtttggatgaggtcaatgggagtatcaaggttcctaaaaatgccggtttttggcgaactctgctggcttatacaggtccaggttctttaattgccgtcggttatatggatccggggaattggatcacttctattggcggtggcgctcagttcaaatatgctcttttgtcggtaattcttctttccagtttaatcgcgatgttgttgcagtctatggcagccaaacttggaattgttactgggaaagatttggctcaattgacgcgggaccggacttctaaaagagtcggttttgttttgtggataattaccgaattggcgattatggcaactgatgttgcggaaattatcggttctggaatagcgatagaactgcttttcggaattcctttgatcgttggcattttgattacttcggctgatgttttgattctgttattgctgatgagatcaggttttcgaaagattgaggcaatcgtcgcaactttggttgcagttgttctttttgtcttctcctatgaagtgattttatcgcagccaaatattccggaagttttgaagggatatcttcccacctacaaaatcgttacaaatacaccaatgctctacctggctttagggattgtcggtgcaacgattatgccgcatgatttgtatttgggatcctcgatttctcagaccaggcgagttgatcgttcagataaaaattctgttaaaaacacgattcgttttacgacgattgattcaaacattcaattgacaattgccttcgttgttaactgtctgctgctggttttaggggcggcattgttttatggcacgaacagcagcttaggacgttttgttgatttgtttagggctttgaacaacagccaggtggttggcgcaatcgccagcccggttctgagtatgctttttgcaatcgctctgctggcttccggccaaagttcaacgattaccggtactttatcggggcagattattatggaaggttttattcacttacatatgccactgtggattcagcgcttgctaactcgattgatctctgtcaccccggtactaatttttgccataatttatcatggcaatgaagccaaaatcgaacagttgctgactttctcgcaggtatttttgagtattgctttgccctttgcggttgttccactggttattttcacaaatgatgaaaagttaatgggagagtttaaaaaccatgcttgggttaagtggacatcttggctgattacggctgttttaattgttttgaatatttatttgattttacaaattatttaa

SEQ ID NO: 8842 - protein, 444 aa, Oenococcus oeni PSU-1
MKTDQKQDNQQKSLDEVNGSIKVPKNAGFWRTLLAYTGPGSLIAVGYMDPGNWITSIGGGAQFKYALLSVILLSSLIAMLLQSMAAKLGIVTGKDLAQLTRDRTSKRVGFVLWIITELAIMATDVAEIIGSGIAIELLFGIPLIVGILITSADVLILLLLMRSGFRKIEAIVATLVAVVLFVFSYEVILSQPNIPEVLKGYLPTYKIVTNTPMLYLALGIVGATIMPHDLYLGSSISQTRRVDRSDKNSVKNTIRFTTIDSNIQLTIAFVVNCLLLVLGAALFYGTNSSLGRFVDLFRALNNSQVVGAIASPVLSMLFAIALLASGQSSTITGTLSGQIIMEGFIHLHMPLWIQRLLTRLISVTPVLIFAIIYHGNEAKIEQLLTFSQVFLSIALPFAVVPLVIFTNDEKLMGEFKNHAWVKWTSWLITAVLIVLNIYLILQII

SEQ ID NO: 8843 - DNA, 1599 bp, Oenococcus oeni PSU-1
  CDS (1)..(1599): transl_table=11
atgagcgaaaatgctgaaggcaaaactcgcaggaatcatggcttgatccattatgcgaatggtccttctttggaggaaattaacggcactgtcaaggtaccaaaaggacgtggttttggcgaaaccctgtttgcttattcgggtcccggagcacttgtagcggttggatatatggatcctggtaattggtcgacttctattactggtggccaaaattttcaatatctgctgatgtcaactattctgatttcaagcctgattgcaatgcttctgcaatatatggccgcgaagttgggaattgtttctcaaatggatttggcccaggcaattcgtgctcggactagcaaatcactgggaattgtactctggattatgactgaattggcaattatggcgaccgatatcgccgaagtcatcggggctgcgatcgccttgtatttgttgttccatattccattagttattgcggttttcataacagttttcgatgttcttttacttttattgttgacgaaaatcggttttcgaaagattgaagcaatcgtggtggctttgattcttgtaattctatttgtatttgtttatcaggtggctctctccgatcctaattggagtggggtcattgcgggacttgtcccaagcgcaaaagcatttgcaacttcgccgcatattggtgggcagacaccgttaaccggttccttgggaattattggtgcaaccgttatgccccataatttatacttgcattcggctatttcgcagacccgtaagattgatcacaatgatgaggaagatgttgcccggacagttcgtttttccagctgggattcaaatatccaactgacggccgctttttttgttaatgcactgcttttaatcatgggtgttgctgtctttaaatccggagctgttaaagatccttcctttttcggtttgtttgaggccttgtccgatacatcgactttaagtaatggcattttaatcagtgttgcaaaaaccggtattttatctactttgtttgccgtcgctctgcttgcttccgggcaaaattcgacaattaccggaactttaaccggccaggttattatggaaggctttgttcatatgaaaatgcccttatggttgcgtcgtttggtaacccgtttgatttctgttattccggttttgatttgtgtctcgatgactagtggacaaagtgctatcaatgagcacgaagctttaaatactttaatgaacaattcgcaggtctttttagcttttgcattgccgttttcaatgctgccccttttaatgtttacggatagtgatattgaaatgggaaggcgttttaaaaacacaatgtgggttaaagtccttggctggatttcagttcttagcctgactttactaaatttgatcaatctgcctggagctaatggacagattgctgccttctttggtgacaatgccactaaatctcagttatttttggctaacatcattgcttatgctttgattgttgcgattatagctttgttggtttggacgattgtcgaaatattaaaaggcaataaacgttatcaactagaaaatcattcggttgtcggtgtcgaagattaa

SEQ ID NO: 8844 - protein, 532 aa, Oenococcus oeni PSU-1
MSENAEGKTRRNHGLIHYANGPSLEEINGTVKVPKGRGFGETLFAYSGPGALVAVGYMDPGNWSTSITGGQNFQYLLMSTILISSLIAMLLQYMAAKLGIVSQMDLAQAIRARTSKSLGIVLWIMTELAIMATDIAEVIGAAIALYLLFHIPLVIAVFITVFDVLLLLLLTKIGFRKIEAIVVALILVILFVFVYQVALSDPNWSGVIAGLVPSAKAFATSPHIGGQTPLTGSLGIIGATVMPHNLYLHSAISQTRKIDHNDEEDVARTVRFSSWDSNIQLTAAFFVNALLLIMGVAVFKSGAVKDPSFFGLFEALSDTSTLSNGILISVAKTGILSTLFAVALLASGQNSTITGTLTGQVIMEGFVHMKMPLWLRRLVTRLISVIPVLICVSMTSGQSAINEHEALNTLMNNSQVFLAFALPFSMLPLLMFTDSDIEMGRRFKNTMWVKVLGWISVLSLTLLNLINLPGANGQIAAFFGDNATKSQLFLANIIAYALIVAIIALLVWTIVEILKGNKRYQLENHSVVGVED

SEQ ID NO: 8845 - DNA, 1395 bp, Leuconostoc mesenteroides subsp. mesenteroides ATCC 8293
  CDS (1)..(1395): transl_table=11
atgcaagattctacaagtgttaatccgaaacatcaccttgttcaaaaaactgaggatgatttaagtttatcggatgttaatggttccatagaagtaccagaaaatgggtcattttggcgtaaattattggccttttctggtcccggagccttggtggccgttggctatatggatccgggtaactgggttacttcggtagccggtggtgcgcaataccgttatacattgttgtctgttgttttaatttctagtttgattgccatgatgctacagtacatggccggtaagttaggaattgttaagcaagaagacttagcgcaagcaacacgtgatcgtacaaataaagttggtggattcgtactatggatcatgactgaattagcattgattgctacagatattgccgaagttattggaggggctatagcacttcacttattgttcggttggtcaatgattgcatctgttctgaccacagcttttgatgttattttgttgctattgttgatgaaatttggtttccgtaaaatcgaagctattgtcatgacattgatcattactattttggttatttttgcttatctagttattttatcaacaccacaattatcagcactgtttggcggttatttgcctcaattacagactttaagctcacatacgccaattggtggtggtgattctcagttaacattaacattgggaattatcggtgccactgttatgccacataatctgtacttgcattcatcaatatctcagacacgtaaagtagatagaagtaacaagtcagaacttaaagaagctgttcgcttcatgacttgggattcaaatattcagttgtcattggcattcgttattaactcattattgttgattttgggtgcagcattattctttggacatgctgataaagttggtacatttggttcaatgtataacgctttgaaggataattcaattgctggtgctattgcatcaccaattttatcaacattgtttgctgttgctttgcttgcttcaggacaaaactcaacaatcactggaacgcttactggtgaaattgtcatggaaggtttcttgcacttgcgcattccaatgtggctacgtcgtgttgttactcgtggtttggcattgataccagttgttgccttcacgttgatttatggtggatctgagggtaagttagatgatttgatggttcaatcacaagtcttcctttcaattgctttgccatttactatggcaccattaatctatttcacgtcttcaaagaagattatgggagaagaatttgctaatccaaagtggattgcaaccttaggatggattgcatttgccgttctgacttatttaaatgttcaacttgtcgtacaacaattaatgggatcttaa

SEQ ID NO: 8846 - protein, 464 aa, Leuconostoc mesenteroides subsp. mesenteroides ATCC 8293
MQDSTSVNPKHHLVQKTEDDLSLSDVNGSIEVPENGSFWRKLLAFSGPGALVAVGYMDPGNWVTSVAGGAQYRYTLLSVVLISSLIAMMLQYMAGKLGIVKQEDLAQATRDRTNKVGGFVLWIMTELALIATDIAEVIGGAIALHLLFGWSMIASVLTTAFDVILLLLLMKFGFRKIEAIVMTLIITILVIFAYLVILSTPQLSALFGGYLPQLQTLSSHTPIGGGDSQLTLTLGIIGATVMPHNLYLHSSISQTRKVDRSNKSELKEAVRFMTWDSNIQLSLAFVINSLLLILGAALFFGHADKVGTFGSMYNALKDNSIAGAIASPILSTLFAVALLASGQNSTITGTLTGEIVMEGFLHLRIPMWLRRVVTRGLALIPVVAFTLIYGGSEGKLDDLMVQSQVFLSIALPFTMAPLIYFTSSKKIMGEEFANPKWIATLGWIAFAVLTYLNVQLVVQQLMGS

SEQ ID NO: 8847 - DNA, 1914 bp, Solibacter usitatus Ellin6076
  CDS (1)..(1914): transl_table=11
atgttgccgacgagtcgtacggcggaggaatcgcggtccctggcggacgtgcactcaagcgtcgggacatcccaagtctcgttctggaagcggatgtttgcgtttgcaggaccggcgtacctggtgagcgtggggtacatggaccccgggaactgggccacggacctggagggcggagcgcgtttcggctacaagctgctctgggtgctggtgatgtccaacctgatggcggtgctgctgcagacgctgagcgcccggcttgggattgtgcgcgggcgcgacctggcgcaggcctgccgggagacgtacccgcgggcagtcaacctggctttgtgggcgctctgcgaaatcgcggtggcggcctgcgacttggcggaagtgatcggcgccgcgatcgggctcaacctgctgttccacattccgctgctcatgggcgtgctgatcacgtcggcggacacgctgctgctgttgtggttccagagcttcggcatccgcacgatcgaggcggtggtgctggcgttgatcacggtgatcgcggcctgcttctgcatcgagattttctgggccaggcccgcggtgagcgagttatttaccgggctggtgccaaggctcaacggcagcagcctttacgtagcgatcggtatcttgggcgcgacggtgatgccgcacaatctctacctgcattcggcgctggtacagacgcgcaacatcgggcagagcgaggcggccaaacggacggcctgcaagtacaacttcatcgatagcgtggtggcgctgaatggcgcgctgctggtgaatgccggaatcctggtgatggcggcggcggtcttcttccggcgcggaatcgtggtgaccgagatccagcaggcgcacctgctgctggcgccgttgctgggcacaggcctggccggtgttctgttcgcgatcgcgctgctggcttcgggccaatcttccacgctgaccgggacgctggcagggcagatcgtgatggaaggcttcctgaacttccgcatgcgggcatggctgcggcgcttgatcacccgcaccatcgcggtggcgccggcggcattcaccatctggtacgcgggggagaaatccacctaccagctgctcattttgagccaggtgatcctcagcatgcaactgccgttcgcggtcatcccgctgatacacttcacgagcgaccggcagcgcatgggcaacttcgccaacgcgctctgggtgcggattctggcgtggctgacggcggcggtgattatcgcgctcaatattcgcctggccgcggcggcgattgcggactggctggatgccgccggccgctggaagccgctggtgatcgccggcctggttccggtgttgggcggtttcctgctgctgctgctctgggtctccttcgagccgctgctgagcggaaggacaggcaaatacgggcgttccccggtttccctccccgaaccggccggcgcggaagtgccggcgccgatctatcagcgcatcctggtgccgctcgatcataccgacctggaccgcctggcgatcagccatgcggtggccatgggaaagctgtacggagcccgggtctacctgctgcacgtggaggagggcgtgaccagccagatttacggcggggacgcctcttcggcggaggaggaggcgggccagcgatacctggagcgcgtcgcgcagtcgctgcgggatcaaggagttacggtggagacggcaatccggcattcgtcctcgccgacgaaggagatcctgagctacgcccgggaggtcgggccggatctggtgatcatgggcgcgcacgggcacggcggtttgaaggacctgatctttggcaccaccatcagcccggtccgtcatcacctgcaggtacctatgctgattgttcgtcctggaaagcccaaaaattga

SEQ ID NO: 8848 - protein, 637 aa, Solibacter usitatus Ellin6076
MLPTSRTAEESRSLADVHSSVGTSQVSFWKRMFAFAGPAYLVSVGYMDPGNWATDLEGGARFGYKLLWVLVMSNLMAVLLQTLSARLGIVRGRDLAQACRETYPRAVNLALWALCEIAVAACDLAEVIGAAIGLNLLFHIPLLMGVLITSADTLLLLWFQSFGIRTIEAVVLALITVIAACFCIEIFWARPAVSELFTGLVPRLNGSSLYVAIGILGATVMPHNLYLHSALVQTRNIGQSEAAKRTACKYNFIDSVVALNGALLVNAGILVMAAAVFFRRGIVVTEIQQAHLLLAPLLGTGLAGVLFAIALLASGQSSTLTGTLAGQIVMEGFLNFRMRAWLRRLITRTIAVAPAAFTIWYAGEKSTYQLLILSQVILSMQLPFAVIPLIHFTSDRQRMGNFANALWVRILAWLTAAVIIALNIRLAAAAIADWLDAAGRWKPLVIAGLVPVLGGFLLLLLWVSFEPLLSGRTGKYGRSPVSLPEPAGAEVPAPIYQRILVPLDHTDLDRLAISHAVAMGKLYGARVYLLHVEEGVTSQIYGGDASSAEEEAGQRYLERVAQSLRDQGVTVETAIRHSSSPTKEILSYAREVGPDLVIMGAHGHGGLKDLIFGTTISPVRHHLQVPMLIVRPGKPKN

SEQ ID NO: 8849 - DNA, 1227 bp, Mycobacterium avium 104
  CDS (1)..(1227): transl_table=11
ttggcgcagcgcacccagggctcgctcaagggcaactggtacctgctcgggcccgcgttcgtcgccgccatcgcctacgtcgacccgggaaatgtcgcggccaacgtcagcgccggctcgcaatacggctacctgctgctgtgggtgatcgtggccgccaacgtcctggccggcctggtgcagtacctgtcggccaagctcgggctggtgaccgggcgctccctgcccgcaaccatcggcaagcgaatgagccgtccggcacggctggtctattgggttcaggccgagctggtggccatcgccaccgacgcggccgaggtggtcggcggggccatcgccttgcacatcctgttcgggttgccgctgctggccggtgggctgatcaccggcgtggtggcgctgctgctgttgggcatccaggaccggcgcggccagatcctcttcgaacgggtcatcaccggcctgctgctggtcatcgcgatcgggttcgcggccagtttcttcgtcaagaccgcgcccccggaggcggtgctgtccgggctgctcccgaggttccgcggcaccgagagcgtgctgctggccgccgccatcctgggcgccaccgtcatgccgcatgcggtgtacatgcattcggggctggtcctggaccggcacgggcaccccgacgaggggccacaccgccgcctgctgctgcgcgtcacccgctgggacgtggtactggcgatggcggtggccggcaccgtgaacgccgcgatgctgctgatcgccgccaccaacctgcagcaccgcgacgtgagcgcctcaatcgagggcgcgtacgccgcgatccacaacacgctgggcgcgaccatcgcggtgatgttcgccgtggggttgctcgcctccgggctggcgtcgtcgtcggtgggtgcctacgccggcgccatgatcatgcaggggctgctgcaccgctcgattccgatggtggtgcgccggttgatcacgctgtgccccgcgctgctgatcctggcggtcggatacgacaccacccgcgccctggtgctgtcccaggtggtgctgtcgttcgggataccgttcgcggtgctgccgttgatcaagctgaccagcgaccgcgagctgatggggtccgacgccaaccaccgcatcacgacgatccttggctggggcgtcggcatcttgattagtctgctgaacatggtgctcatctggctgacggtgaccggctga

SEQ ID NO: 8850 - protein, 408 aa, Mycobacterium avium 104
MAQRTQGSLKGNWYLLGPAFVAAIAYVDPGNVAANVSAGSQYGYLLLWVIVAANVLAGLVQYLSAKLGLVTGRSLPATIGKRMSRPARLVYWVQAELVAIATDAAEVVGGAIALHILFGLPLLAGGLITGVVALLLLGIQDRRGQILFERVITGLLLVIAIGFAASFFVKTAPPEAVLSGLLPRFRGTESVLLAAAILGATVMPHAVYMHSGLVLDRHGHPDEGPHRRLLLRVTRWDVVLAMAVAGTVNAAMLLIAATNLQHRDVSASIEGAYAAIHNTLGATIAVMFAVGLLASGLASSSVGAYAGAMIMQGLLHRSIPMVVRRLITLCPALLILAVGYDTTRALVLSQVVLSFGIPFAVLPLIKLTSDRELMGSDANHRITTILGWGVGILISLLNMVLIWLTVTG

SEQ ID NO: 8851 - DNA, 1224 bp, Mycobacterium smegmatis str. MC2 155
  CDS (1)..(1224): transl_table=11
gtgctcgaggacacgaaggtgcgcgcgcggccgagctggctgctgctcgggcctgcgttcgtggcggcgatcgcctacgtcgatccgggcaacgtcgccgcgaacgtcagcgcaggcgcgcagtacggcttcctgctggtgtgggtgatcgtcgtcgccaatgtcatggcgggcctggtgcagtacctctcggcaaaactgggactcgtcaccggccgctcactgccggaggcagtcgccgaccacacccgcacgcccacgcgcgtcgccttctggctgcaagccgaattggtcgcgatggcaacggatctcgccgaggtggtgggtggcgccatcgcgctgtacctattgttcgacctaccgctgctggtcggcgggctcatcaccggcgtggtgtcgctgcttctactggcggtgcagaaccgtcgtggacagcgggtgttcgagcgcgtgatcacaggcctgctcatggtcatcgcgatcggcttcctcaccagtctgttcgtcaagacgccgcccgccgccgcggtcgccgacggcctgatcccgcgcttcgacggcgccgagagcatcctgctcgcgacggccatgctgggcgccacggtcatgccgcacgcggtgtacctgcactcggggctggcacgcgatcgccacggccacgcagagggtccgcgcctgcggatgctgttgcgcgtcaccaggttcgacgtgggtctggcgatgctggtcgcgggcgcggtgaacatggcgatgctgctggtcgctgccaccaatctgcagggccgcggcgacaccgactccatcgagggcgcgcacgccgcggtttccgatgcgctggggcccaccgtcgcgttgctgttcgcgatcggcctgctggcctcgggtctggcgtcgacgtcggtgggcgcgtacgcgggcgcgatgatcatgcagggcctgctgaagaagtcctatccgctgctgctgcgccggttggtgacgttggtacccgcactgctggtcctcgcgatcggcgtcgaccccagccgggccctggtgttgtcgcaggttgtactgtccttcggcatcccgttcgcgctcatccccctggtccggctgaccagcgacaaagccctcatgggcggcgacgccaaccaccgcgtgaccaccgcttttggctggggagttgccggactgattagtgtcttgaacgtggtgctgatctatctgaccgtcaacgggtga

SEQ ID NO: 8852 - protein, 407 aa, Mycobacterium smegmatis str. MC2 155
MLEDTKVRARPSWLLLGPAFVAAIAYVDPGNVAANVSAGAQYGFLLVWVIVVANVMAGLVQYLSAKLGLVTGRSLPEAVADHTRTPTRVAFWLQAELVAMATDLAEVVGGAIALYLLFDLPLLVGGLITGVVSLLLLAVQNRRGQRVFERVITGLLMVIAIGFLTSLFVKTPPAAAVADGLIPRFDGAESILLATAMLGATVMPHAVYLHSGLARDRHGHAEGPRLRMLLRVTRFDVGLAMLVAGAVNMAMLLVAATNLQGRGDTDSIEGAHAAVSDALGPTVALLFAIGLLASGLASTSVGAYAGAMIMQGLLKKSYPLLLRRLVTLVPALLVLAIGVDPSRALVLSQVVLSFGIPFALIPLVRLTSDKALMGGDANHRVTTAFGWGVAGLISVLNVVLIYLTVNG

SEQ ID NO: 8853 - DNA, 1227 bp, Mycobacterium sp. KMS
  CDS (1)..(1227): transl_table=11
gtgctgccggacaccgaccgtcggaccagatcgacgtggctgctcctgggcccggcgttcgtcgccgcgatcgcctacgtcgatccgggcaacgtcgcggccaacgtcagcgcgggcgcccagttcggcttcctgctcgtctgggtcatcgtgctggccaatgtgatggccggactggtgcagtacctgtcggcgaagctgggtctggtcaccggccgatcgctgcccgaatccgtcgcgggccgcacccgcacgccgacccgcatcgcctactggctacaggccgaattggtcgccatggcaacggatctcgcggaggtggtgggcggcgcgatcgcgctgtacctgttgttcgacctgccgctgctgatcggcggcgtgatcacgggcgcggtgtcgctggccctgctggcggtgcagaaccgccgcggtcaacggcacttcgagcgggtgatcagcagtctgctgctgatcatcgccatcggcttcctgacgagcgtgttcgtcgaaccgccgcccgtcgccgacgtcgccggcggcctcatcccgctcttcgaaggcaccgacagcgtcctgctggcgaccgcgatgctgggcgcgaccgtgatgccgcacgcggtctacctgcactccgggctggcccgcgaccgccacggccacgccgaacccggcgcccggcggcgcctgctgctcaaggccacccgcatcgatgtgggcctggcgatgctgatcgccggggcggtgaacatgtcgatgctgctggtcgccgccaccaacctgcagggcatgtccgataccgacaccctcgagggcgcgcatgccgcggtgcagcagacgctcggcccggccgtcgcactgtgcttcgcgatcggcctgctggcatccggtctggcgtcgacgtcggtgggcgcctacgccggcgcgatgatcatgggcggactgctgcgccgcacctacccgctgctggtgcgccgcctcgtcacgctggtgcctgccctggcgatcctcgcgatcggcgtggaccccacccgcgccctggtgctgtcgcaggtggtgctgtcgttcgggatcccgttcgcgctgatcccgctcatccggctgaccagcgatcgggccgtgatgggtgacgacgtcaaccaccgcatcaccaccacactgggctgggttgtcgcgggtttgattagtcttttgaacgtggtgctcatctatctgaccgtgacaggctga

SEQ ID NO: 8854 - protein, 408 aa, Mycobacterium sp. KMS
MLPDTDRRTRSTWLLLGPAFVAAIAYVDPGNVAANVSAGAQFGFLLVWVIVLANVMAGLVQYLSAKLGLVTGRSLPESVAGRTRTPTRIAYWLQAELVAMATDLAEVVGGAIALYLLFDLPLLIGGVITGAVSLALLAVQNRRGQRHFERVISSLLLIIAIGFLTSVFVEPPPVADVAGGLIPLFEGTDSVLLATAMLGATVMPHAVYLHSGLARDRHGHAEPGARRRLLLKATRIDVGLAMLIAGAVNMSMLLVAATNLQGMSDTDTLEGAHAAVQQTLGPAVALCFAIGLLASGLASTSVGAYAGAMIMGGLLRRTYPLLVRRLVTLVPALAILAIGVDPTRALVLSQVVLSFGIPFALIPLIRLTSDRAVMGDDVNHRITTTLGWVVAGLISLLNVVLIYLTVTG

SEQ ID NO: 8855 - DNA, 1347 bp, Magnetospirillum magnetotacticum MS-1
  CDS (1)..(1347): transl_table=11
atggaagccgtgatggatcaggttcggccggcaccgcccgggcaagcctccgcagaggcgagcctcggcgcactgaacgccagcgtgccggtgcggatggacggatcctggctgcggcggctcgtggcctttctcggcccgggctacatgatctcggtcggctacatggacccgggcaactgggcgaccgacatcgccggcggcgcccagttcggctacacgctgctcgcggtcatcctgctctcgaacctgatggcgatcgtgctgcaggcgctggcggcgcggctcggcatcgccaccggcctcgaccttgcccaggcctgccgcgagcgaacctcgcggcccgtcgccatcgccctctggctgatctgcgaggcggcgatcatcgcctgcgacctcgccgaggtgatcggtacggcgatcgccctcaagctcctgttcggcatcccgctgacgctcggcgccatcatcaccgccctcgacgtgttcgtggtgctgctgctgctgcgccgggggttccgggcgctcgaagccttcgtcatcgggctcctgacgatcatcttcgtctgcttcggcctgcagatcgcgatggccgcgcccccgctccaggcggtgctcggcggcttcatcccctcacgggagatcgtgacgaatccggccgcgctctacatcgccatcggcatcatcggcgccacggtgatgccccataacctctacctgcattcctcgatcgtgcagacacgggcctatccccgcacggaggaagggcgccgcgaggccctgcgcttcgccgtcaccgactcgacggtggcgctgatgctggccctgttcgtcaacgccgccatcctgatcatggcggcggcggtgttccacgcgggtggtcgcaccgatgtcgaggaaatcgagcaggcctacgagttgctctcgccgctgctcggggtcgggctcgcctcgaccctgttcgccgtggccttgctcgcctcgggcctgaactcgacggtgaccgcgaccctggccggccagatcgtcatggagggcttcctgcgcctgcggctgcccaactgggcccgccgcctcatcacgcggggcatcgccatcgtgccggtcgtcatcgtcacagccctttatggcgaccagggcacggcgaaactcctcgtgctcagtcaggtcgtgctctcgatgcagcttcccttcgcggtgatcccactggttcgcttcgtctccgaccggaagctgatgggcagcttcgtggttccgggctggctgaagggcctgtcctgggccattgccgcgatcatcgtcgtgctgaacctcaagctcctcgccgagacgctgcttcccggctga

SEQ ID NO: 8856 - protein, 448 aa, Magnetospirillum magnetotacticum MS-1
MEAVMDQVRPAPPGQASAEASLGALNASVPVRMDGSWLRRLVAFLGPGYMISVGYMDPGNWATDIAGGAQFGYTLLAVILLSNLMAIVLQALAARLGIATGLDLAQACRERTSRPVAIALWLICEAAIIACDLAEVIGTAIALKLLFGIPLTLGAIITALDVFVVLLLLRRGFRALEAFVIGLLTIIFVCFGLQIAMAAPPLQAVLGGFIPSREIVTNPAALYIAIGIIGATVMPHNLYLHSSIVQTRAYPRTEEGRREALRFAVTDSTVALMLALFVNAAILIMAAAVFHAGGRTDVEEIEQAYELLSPLLGVGLASTLFAVALLASGLNSTVTATLAGQIVMEGFLRLRLPNWARRLITRGIAIVPVVIVTALYGDQGTAKLLVLSQVVLSMQLPFAVIPLVRFVSDRKLMGSFVVPGWLKGLSWAIAAIIVVLNLKLLAETLLPG

SEQ ID NO: 8857 - DNA, 1308 bp, Nostoc punctiforme PCC 73102
  CDS (1)..(1308): transl_table=11
atgactcccccagaaaacaaacctagcttaccagaggttcaccgtagcattggagttcctaacagcagcagcttttggcgcaagatgatggcttatacagggccagggtatctggtttcagtgggatatattgatcctggaaattgggcaacagatatcgctgggggttcaaggtttgggtacactctattaacagtgatcctgctgtcgaacctgatggcaatattactccaatcactctgtgtacgtttgggagttgctacagggcgagatctagcacaggcttgtcgagactatttcagtccaaaggttagtttttgcttgtgggtactgtgtgaaattgcgatcgcagcttgtgatttagcagaactactaggaagtgcgatcgcactgcaacttttattcggtattcccttagtatggggtgtttgcatcacagcagtggatgtcctactattgttatttttgcaacataaaggctttcgctatacagaagccctagtaataatgctggtaggaacagtaggcatctgttttacagctgaaattctgttttctcgccctgatatggggggaattttattgggatatctgcccaagaaagagattttacagaatccagaaatgctctacattgctattggtattttaggggcgacagtgatgcctcacaacttatatttacactcctcaattgtacaaacccgtagttggcagcctaatactgaaaaaagatgggaagcaattaagtttggtacaattgattcaacttttgctttatctttagcactatttatcaactcagcaattttaattgtgtctgccgcaacatttcatttttctggtaatcagcatgtggcagaaattcaagacgcttataaattactttcaccattgttaggagttagtgctgccagtgctatttttggcattgctttacttgcttctggacaaagttcaacgctaactgcaactctggcaggacaaattgttatggaaggctttttacaatttcgctttccatcttggttacgccgtttaataacccgtctgattgcaatcattccagcgttaattactatcattatttttggtgaaaatagtacaagcagtctgatagttctcagccaagttatcctcagtttacagttaccatttgcagtgattccattggtgatgtttacgagtaatcgccgcttgatgggtgagtttgtaaatcccttgtggttgaaatcgttggcctggttagttgctattgttatcgtaggtttaaatatttggttgctattacaaagtattttgggatga

SEQ ID NO: 8858 - protein, 435 aa, Nostoc punctiforme PCC 73102
MTPPENKPSLPEVHRSIGVPNSSSFWRKMMAYTGPGYLVSVGYIDPGNWATDIAGGSRFGYTLLTVILLSNLMAILLQSLCVRLGVATGRDLAQACRDYFSPKVSFCLWVLCEIAIAACDLAELLGSAIALQLLFGIPLVWGVCITAVDVLLLLFLQHKGFRYTEALVIMLVGTVGICFTAEILFSRPDMGGILLGYLPKKEILQNPEMLYIAIGILGATVMPHNLYLHSSIVQTRSWQPNTEKRWEAIKFGTIDSTFALSLALFINSAILIVSAATFHFSGNQHVAEIQDAYKLLSPLLGVSAASAIFGIALLASGQSSTLTATLAGQIVMEGFLQFRFPSWLRRLITRLIAIIPALITIIIFGENSTSSLIVLSQVILSLQLPFAVIPLVMFTSNRRLMGEFVNPLWLKSLAWLVAIVIVGLNIWLLLQSILG

SEQ ID NO: 8859 - DNA, 1323 bp, Bifidobacterium longum DJO10A
  CDS (1)..(1323): transl_table=11
atgacgaacgccgtggcagacatcgaacaggaaacaccggaaatcgagaaggaacgccagcttgccggagtcggagccggagctggaaccgtggcaaacggcaagaaaaagccgcatgaccatgcgctggccagcatcctcggccccgcgttcgtggcggccgtggcctacgtcgatcctggcaacgtggcagccaacatcacctccggcgcgcgatatggctacctgttggtgtgggtgctggtgctcgccaacgccatgagcgtgctcatccagtatcagtccgccaaactcggcatcgtgaccaacaaatccctgccggaactgctgggtgaacgtatgagcgatgccggccgcttcatgttctttatgcaggccgaggtcatcgccatcgccaccgatctggccgaggtgatcggcggtgccatcgccctgaacctgctgttcggattgccgctgttcatcggcggtctggtgatcggcgcaatctccacggtgatgctgtggttccaaggtggcaagacgcaaaccacgttcgagcgcatcatcatcgtgatgctgctgattatcacattcggcttcatcgcaggcctgttcgtggacccgccgagccccggcgaagtggtcaagggcatgattccacgcttccaaggcaccgactcggtgctgatggccgcctcgattctgggcgccaccgtgatgccacacgccatctacctgcactccacgctggtgaacgaccattacgcaggcggcgaaaagccatcgatcaaaacgcagctgaaaggctcgaaaatcgatgtggtctgggcgctgttgctggccggcaccgtgaatctggcgatgctggtgctcgccgccaactcgctgcacggcatgtctggcacggattccatcgacggcgcacagcgggcgatcgcgcaggtgcttggcccggtgatcggcacgatcttctccatcggcctgctggcttcgtcgctgagctccacatcggtcggcacgtatgccggctcggaaatcatgcacggtctgctgcacgttaacgccccgatgtgggcctgccgcgtggtcacgctggtgccggcactgattgtgctgtggttcgccaaggacccgactcaggcgctggtcatcggccaggtggtgctttccattggcatcccgttcgccgtgattccgctgatgcgatacacgcatgacaaggaactcatgggcaagtgggctgatggaaccgtcaagcacgtgatttttatgattgtggtggcactgattgtggcgctcaacgtgctgctgattgtcctgacgctgatgggcagggcgtaa

SEQ ID NO: 8860 - protein, 440 aa, Bifidobacterium longum DJO10A
MTNAVADIEQETPEIEKERQLAGVGAGAGTVANGKKKPHDHALASILGPAFVAAVAYVDPGNVAANITSGARYGYLLVWVLVLANAMSVLIQYQSAKLGIVTNKSLPELLGERMSDAGRFMFFMQAEVIAIATDLAEVIGGAIALNLLFGLPLFIGGLVIGAISTVMLWFQGGKTQTTFERIIIVMLLIITFGFIAGLFVDPPSPGEVVKGMIPRFQGTDSVLMAASILGATVMPHAIYLHSTLVNDHYAGGEKPSIKTQLKGSKIDVVWALLLAGTVNLAMLVLAANSLHGMSGTDSIDGAQRAIAQVLGPVIGTIFSIGLLASSLSSTSVGTYAGSEIMHGLLHVNAPMWACRVVTLVPALIVLWFAKDPTQALVIGQVVLSIGIPFAVIPLMRYTHDKELMGKWADGTVKHVIFMIVVALIVALNVLLIVLTLMGRA

SEQ ID NO: 8861 - DNA, 1296 bp, Bacillus cereus G9241
  CDS (1)..(1296): transl_table=11
atgaataaagatatatcaaaagatgaacatgtcccttctcaaagtacaactgttcaatcagcgcatttagcattaagcggacaaacgaaaggcttaaaaagactattaccattcttaggtcctgctttcatcgcttcagtcgcttatattgaccctggcaatttcgcgacaaatattgctgctggatcacaatatggatatttattactctgggtaattcttgcttctaatttaatggcagtattaatccaaactttatctgctaaattgggaatcgctacaggaagaaaccttcctgaaatcgctcgagaaaacttcccaaaacctgtttccatcggtttatggattcaaggagagctcgttattatggcgactgatttagctgaatttattggagctgcactcggattgtacttattatttgggattccgatgttaccggcagctttaattacagctgctggatcatttattattcttgaatttcaacgtagaggcttccgtccattagaagctattataacaggaatgatttttatcgttgttatcgcttttggtgtacaagtcttttatgcaaaaccggaattaagccctttactttcaggactatttattccaaaattccaaggtgtagacagtatattacttgcagccggaattttaggtgcgacagttatgccacatgcaatctatttacattccgccttaacgcagcgccgcgtagtcggaacaaatgatgaacaaaagaaaaagattttccgattcgaatttatagatatcattatcgcaatggttatcgcaggagcaattaatgcaagtatgttaattgttgctgctgcactattctttaaaaacggcttgcatgtcgaagatcttgatgtcgcttttaaccagtttagcaacttagtcggtcctgtatcagctgctttatttggaattggtctcttatcagcaggactatctagctcttctgtcggtacaatgtcaggtgatattattatgcaaggtttcattcgaatgcatattccgttatacttacgccgatttattacaatgattccaccattagttattatcgctttaggtgtaaatccaacttacgctctagtcatgagtcaagtcgtcttatcattcggtattgcctttgcattagtaccacttattatgtttacaagtagtaaaaaaattatgggtgcactcgtcaatcaccgcatcactacctttatcgcttggatcattgctatacttgttatcattttaaatattttcttactgtatcaaacatttgtagggtaa

SEQ ID NO: 8862 - protein, 431 aa, Bacillus cereus G9241
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFEFIDIIIAMVIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAILVIILNIFLLYQTFVG

SEQ ID NO: 8863 - DNA, 1221 bp, Exiguobacterium sibiricum 255-15
  CDS (1)..(1221): transl_table=11
gtggtaagtcaaccgatcgttccagtggagcgtttgaaaaaaagacactatatcggaccggcttttgtcgccgccgtcgcttacctcgatccggggaattttgcgatgaacatgacggcaggagcccagtacggatttttactgttgtgggtaattgttgccgccaacctgatggccgtgatgattcagacactatcggccaaactggggctggtcagcaatacgagccttgcggaagtcattcgggatgaactgtcgccggtcatgcgaattctttattgggcgcaggccgaactcgtcgcgatggcaacggatttagcggagttcgtcggggcggcactcggttttaacctgctgttcggcatcgatttgaaaatcgccgccttgctgacagcggttgcttcgttcgtcatccttggatttgaacggaaagggttacgtcattttgaagctgtcatcggagcgttagtcctcgtcatcgctctggcgtttgcgattcaggtcattgaagttaaaccggtcctgcgcgatgtcgccggcggattgattcccggattttccggaacgtcgagcattgtccttgcagcagggatgctcggggcgacggtcatgccgcatgcgatttatctccattccgatctaacgaaacgccggatggggacaattgcggataaaaaagggttgttacggattcaaaagatggatatttgggctgcgatgctgattgcgggggcagtcaacggcgcaatgcttgtcattgccgcgacggtcttcttcggaacgagccaacaggcagagacactggaaagtatttttcacggactcgggacgtcgctcggcggcgcggcaccttatctgtttggcggagcgttactgatttccggacttgcctcgtcgagtgtcgggacgatgtccggggatgccatcatgcgcggattcctgaagatggagattccgattttcctccggcgcagtgtgacgatgttaccggcgatcctcttattgttatccggctttgacccgaccagggcgttgatttggagtcaagtcgccttatcgttcggaattccgtttgcgttaatcccgttgatccgtgccacatccagtgaacggatcatgggcaaatataaaaatcagccgttaacgaaagggatttcctggacgatcgtcagtatcgtcatcgtcttcaatgtctatctgctgggggatcttttattttga

SEQ ID NO: 8864 - protein, 406 aa, Exiguobacterium sibiricum 255-15
MVSQPIVPVERLKKRHYIGPAFVAAVAYLDPGNFAMNMTAGAQYGFLLLWVIVAANLMAVMIQTLSAKLGLVSNTSLAEVIRDELSPVMRILYWAQAELVAMATDLAEFVGAALGFNLLFGIDLKIAALLTAVASFVILGFERKGLRHFEAVIGALVLVIALAFAIQVIEVKPVLRDVAGGLIPGFSGTSSIVLAAGMLGATVMPHAIYLHSDLTKRRMGTIADKKGLLRIQKMDIWAAMLIAGAVNGAMLVIAATVFFGTSQQAETLESIFHGLGTSLGGAAPYLFGGALLISGLASSSVGTMSGDAIMRGFLKMEIPIFLRRSVTMLPAILLLLSGFDPTRALIWSQVALSFGIPFALIPLIRATSSERIMGKYKNQPLTKGISWTIVSIVIVFNVYLLGDLLF

SEQ ID NO: 8865 - DNA, 1257 bp, Kineococcus radiotolerans SRS30216
  CDS (1)..(1257): transl_table=11
atgatgtccgccatgacgacggacgaacgcgccgacgcgcccgcccgccccgccggccggcgctcgctgctgcggatgctgggacccgccttcgtggcggccatcgcctacgtcgaccccggcaacgtcgcggcgaacctcaccgccggcgccgggtacggctacctgctgctgtgggtgctggtgctggccaacgcgatggccgtcctcgtgcagtacctctcggcgaagctctccgtcgtcaccgaccgcaccctgccggaggtgctgcgcgaccggctcagccgtcccgcgcggctggcctactgggcccaggccgagctcgtcgccgtggccaccgacctcgccgaggtcatcggcggcgccgtcgccctgcacctgctcttcgggaccccgctcctgctcggcgggatcgtcgtcggcgcggtgtcgctgggcctgctcgccctgcacgggcgcaacggcgtgcgccgcttcgaggccgtcatcgtcgggctgctgctggtcatcgtcgtcggcttcgtctccggggtcgtcttctcccccccggacgccggggaggcggtgaaggggctcgtcccccgcttcgagggctccgagacggtgctgctggccgcgagcatgctcggcgccacggtcatgccgcacgcggtgtacctgcactccgcgatggcccgcgaccaccacggcaccgtcacccccgcgctgacccgccgcgtcctgggcgccacccgcgtcgacgtcgtggctgcgctcgtggtggccgggctggtcaacatctcgatgctgctgctcgccgcgagcgccctgcgcggggtcgagggcaccgacaccctggagggcgcgcacgccgccgtcgaggccaacctggggacgggggcggcgctgctgctggccatcggcctgctggcctccgggctcgcctcgacctcggtgggcgcctacgccggggcggtgatcatgcaggggctgctgcggatcgacgtcccgctgctggtgcgccgggtggtgacgctcatcccggccctggtgtgcctggggatcggcgtggaccccacccgggcgctggtcgtgtcgcaggtcgtcctcagcttcggcatcccgttcgcgctggtgcccctggtgcggctgaccagctcgcgcgccctcatgggcgagcacgtgaaccgccgggggacgcaggtcgcggccacgatcgcggtcgggctcgtcgtggccctgaacctcgccctgctctggctgacgttcaccggctga

SEQ ID NO: 8866 - protein, 418 aa, Kineococcus radiotolerans SRS30216
MMSAMTTDERADAPARPAGRRSLLRMLGPAFVAAIAYVDPGNVAANLTAGAGYGYLLLWVLVLANAMAVLVQYLSAKLSVVTDRTLPEVLRDRLSRPARLAYWAQAELVAVATDLAEVIGGAVALHLLFGTPLLLGGIVVGAVSLGLLALHGRNGVRRFEAVIVGLLLVIVVGFVSGVVFSPPDAGEAVKGLVPRFEGSETVLLAASMLGATVMPHAVYLHSAMARDHHGTVTPALTRRVLGATRVDVVAALVVAGLVNISMLLLAASALRGVEGTDTLEGAHAAVEANLGTGAALLLAIGLLASGLASTSVGAYAGAVIMQGLLRIDVPLLVRRVVTLIPALVCLGIGVDPTRALVVSQVVLSFGIPFALVPLVRLTSSRALMGEHVNRRGTQVAATIAVGLVVALNLALLWLTFTG

SEQ ID NO: 8867 - DNA, 1377 bp, Xylella fastidiosa Dixon
  CDS (1)..(1377): transl_table=11
atgtttcgcccttcacttattcatcgttctatgtcttcgcttcagcctatgtctcccgtgtcggattctccaagtcttggagagatgcatgccagtgttgcggtgtcgcgcagggggcattgggggttccgttttttagcctttctcgggccgggctatatggtgtcggtcggctatatggatcctggtaattgggcgacggggttagcgggtggttcgcgttttggctatatgttgttatcggtgatcctgctctcgaatgtgatggcgattgtgttgcaggcgttggcggcgcgtttggggattgccagtgatatggatttggcgcaggtgtgccgtgcgcgttattcgcgtgggactactctggcgttgtgggtggtctgtgagttggcgattattgcgtgtgatttggctgaggtgatcggtacggcgattgcgctcaatctgttgttagggattccaatcatttttggggtcttgatcacggcggttgatgtggtcttggtgttgttgttgatgcatcgtggtttccgtgcgcttgaggcgtttgtgatcgcgttgttgttggtgatttttgggtgtttcgtggttcaaattgtgttggctgcgccgccgttgcaggaggtgttgtgtggttttgtgccgcgttggcaggtggttgctgatccgcaagcgctgtatttggcgatcggtattgtcggtgcgacggtgatgccgcataacttgtatttgcattcttcgattgtgcagacgcgtgcttatccgcgtacgccggtggggcgacgttcggccttgcgttgggctgtggccgacagtactttggcgttgatgttggcgttgtttatcaatgcgtcgattctgattcttgctgcggcggtgtttcatgcgcagcatcattttgatgtggaggaaatcgagcaggcgtatcagttgctcgcgccggtccttggggttggtgtggctgcgacgttgtttgcaacggcattgttggcgtcagggatcaattcgacgatcacggcgacgttggcagggcagatcgtgatggaggggtttttgcggttgcggttgcggccgtggttgcggcgtgtgttgacccgcggtttggcgattgtgccggtgattgttgtggtagcgttgtatggggagcaagggactgggcgcttgctgctgttgagtcaagtgattttgtcgatgcagttgccgtttgcggtgattccgttattgcgttgtgttgcggatcgtaaggtgatgggtgcgttggtggcgccacgttggttaatggtggttgcgtggttgattgctggggtgattgtcgtactcaatgttaagttgttgggcgattatgctgttcatttgatggttggtgtcagtaattga

SEQ ID NO: 8868 - protein, 458 aa, Xylella fastidiosa Dixon
MFRPSLIHRSMSSLQPMSPVSDSPSLGEMHASVAVSRRGHWGFRFLAFLGPGYMVSVGYMDPGNWATGLAGGSRFGYMLLSVILLSNVMAIVLQALAARLGIASDMDLAQVCRARYSRGTTLALWVVCELAIIACDLAEVIGTAIALNLLLGIPIIFGVLITAVDVVLVLLLMHRGFRALEAFVIALLLVIFGCFVVQIVLAAPPLQEVLCGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTITATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSN

SEQ ID NO: 8869 - DNA, 1473 bp, Xylella fastidiosa Ann-1
  CDS (1)..(1473): transl_table=11
atgttggtatcaggtgtttggttgtgtttggtatgggcagcgattttttgtagggtgagttgctgtatagccaatgctataagatgggatgtgtcgctgcttattcatcgttctatgtcttcttctatgtcttcggttcagcctacgtctccagtgtcggattctcccagtcttggggagatgcatgccagtgtcgcggtgtcgcgcagggggcattgggggttccgtttgttggcctttttggggccgggctatatggtgtcggtcggttatatggatccgggcaattgggcgacggggttggcgggtggttcgcgttttggctatatgttgttgtcggtgattttgctctccaatgtgatggcgattgtgttgcaggcgttggcggcgcgtttagggattgccagtgatatggatttggcgcaggcgtgccgtgcgcgttattcgcgtgggactactctggtgttgtgggcggtctgtgagttggcgattattgcgtgtgatttggcggaggtgatcggtacggcgattgcgctcaatttgttgttaggggttccaatcatttggggggttgtgatcacggcggttgatgtggtcttggtgttgttgttgatgcatcgtggtttccgtgcgcttgaggcgtttgtgatcgcgttgttgttggtgatttttgggtgtttcgtggttcaaattgtgttggctgcgccgccgttgcaggaggtgttgggtggttttgtgccgcgttggcaggtggttgctgatccgcaagcgctgtatttggcgatcggtattgtcggtgcgacggtgatgccgcataacttgtatttgcattcttcgattgtgcagacgcgtgcttatccgcgtacgccggtggggcgacgttcggcgttgcgttgggctgtggccgacagtactttggcgttgatgttggcgttgtttatcaatgcgtcgattctgattcttgctgcggcggtgtttcatgcgcagcatcattttgatgtggaggaaatcgagcaggcgtatcagttgctcgcgccggtccttggggttggggtggctgcgacgttgtttgcaacggcattgttggcgtcagggatcaattcaacggtcacggcgacgttggcagggcagatcgtgatggaggggtttttgcggttgcggttgcggccgtggttgcggcgtgtgttgacccgcggtttggcgattgtgccggtgattgttgtggtagcgctgtatggggagcaagggaccgggcgcttgctgttgttgagtcaagtgattttgtcgatgcagttgccgtttgcggtgattccgttattgcgttgtgttgcggatcgtaaggtgatgggcgcgttggtggcgccacgttggttaatggtggttgcgtggttgattgctggggtgattgtcgtactcaatgttaagttgttgggcgattatgctgttcatttgatggttggtgtcagtgattga

SEQ ID NO: 8870 - protein, 490 aa, Xylella fastidiosa Ann-1
MLVSGVWLCLVWAAIFCRVSCCIANAIRWDVSLLIHRSMSSSMSSVQPTSPVSDSPSLGEMHASVAVSRRGHWGFRLLAFLGPGYMVSVGYMDPGNWATGLAGGSRFGYMLLSVILLSNVMAIVLQALAARLGIASDMDLAQACRARYSRGTTLVLWAVCELAIIACDLAEVIGTAIALNLLLGVPIIWGVVITAVDVVLVLLLMHRGFRALEAFVIALLLVIFGCFVVQIVLAAPPLQEVLGGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTVTATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSD

SEQ ID NO: 8871 - DNA, 1242 bp, Photobacterium sp. SKA34
  CDS (1)..(1242): transl_table=11
atggcctctacatctatttctgttaagcccgagatggctaccttcagtttaaaactaaagaaaaaactattacttctaggcccagcatttattgccgctattggttacattgatccaggtaattttgctacaaatattgaagcgggatctgcttttggctatcaactattatgggttgtgctttgggcaaatttaatggctatgtttattcaatatctatctgcaaaactaggcattgttacgggtaaaaacctcgctgaacatttacgtgaccatttacctaagtgggcgataggaccatattggattcaagctgaaattatagctatggcaactgatttagctgagtttattggcgcagccgttggtttccaattattgtttagcattactttaatggaaggggcgataattacagccatagtaacaatggctattctattattaagtaataaaagccagaaaccattagaagttgttattgctacattattattagtcgttgctgttgtatacgttattgagcttttctttgctcatcctgctactggtgagatgataaaaggtcttgctattccaacaatgaatagttcacatcaaatttatttagccgcaggtattttaggtgcaacagtaatgccgcatgttatttacttacattcggcgctattcaaaaatacttacggtgaaacaaaagcaaaaagattaaaatcaacacgtttagatgtactcattgcaatggtcattgctggctttgtgaatattgcaattgtggccatggcggcagccgtcttccattactcaggtaatcaagatattgcagagattgaaaccgcttacaaaacattgacaccacttgttggacaagcagcttccacattatttgccatttcacttattgcatcaggattatcatctactgttgttggtacaatggcaggggatgtagtaatgcaaggtttcgtaaaatttaaaattcctttgttattacgccgtgttgttacaatgatcccatcttttattgttatcggacttgctattaataccactgagattttagtaatgagtcaagtcgttcttagttttggtattgcattagctattataccgttactgattttcaccaataatgaaaaactaatgggtgagtttaaaaataacaaatacgttagttatgctggtgttgttattattgctcttgttgttgccttgaatatatatttaatgatgacactttcttaa

SEQ ID NO: 8872 - protein, 413 aa, Photobacterium sp. SKA34
MASTSISVKPEMATFSLKLKKKLLLLGPAFIAAIGYIDPGNFATNIEAGSAFGYQLLWVVLWANLMAMFIQYLSAKLGIVTGKNLAEHLRDHLPKWAIGPYWIQAEIIAMATDLAEFIGAAVGFQLLFSITLMEGAIITAIVTMAILLLSNKSQKPLEVVIATLLLVVAVVYVIELFFAHPATGEMIKGLAIPTMNSSHQIYLAAGILGATVMPHVIYLHSALFKNTYGETKAKRLKSTRLDVLIAMVIAGFVNIAIVAMAAAVFHYSGNQDIAEIETAYKTLTPLVGQAASTLFAISLIASGLSSTVVGTMAGDVVMQGFVKFKIPLLLRRVVTMIPSFIVIGLAINTTEILVMSQVVLSFGIALAIIPLLIFTNNEKLMGEFKNNKYVSYAGVVIIALVVALNIYLMMTLS

SEQ ID NO: 8873 - DNA, 1275 bp, marine gamma proteobacterium HTCC2080
  CDS (1)..(1275): transl_table=11
atggcagtagtatgggccgctgagaatgtttttgagtgtagtaacggcgcgttgctaaacgaaggggggttgtttatgaggctgcgtattggtccaggagcgatggttgctgcggcatttataggccctggcaccatcactacggccagtgttgccggagccacaaccggcataacgctgatttgggcgattgctttctcggtctttgcaacggtgttgctacaagaactcgcggtacgaagtgccctagccactgatcgtgatctggcgactctcattagagattttggtgcgggttattggtggggagcgcctttacttttgctgatcatattggcggttggtgtgggcaacgctgcctaccaatctggtaatttgtcaggcgctggaatcggtctaaacaccgccttgggaaccaacttcacgtcagtcgtcttactaagcgccactgcctccgcaattctgattgttattaatcggtatcggttattggagcgcattttggtggtcttagtggccgcaatgggcttgctgtttactgggttagcgataatgttggcgccattgctatgggttcagccagaggtgcgactgttgcctgacttctcctatgccaacctcaccttggtgctggccttaattggaacgacggtcgtaccttacaacttatttcttcatgcgaccgcggccagacagcattggcagggcagctcaattggcgaagcgctaaaaggcgctcgttgggagtcttgtgtggcaattcttttcggtggtgtgactaccactgcaatagtagtcgttgccgctgcgctagtacctaacgctgtcgatcaacccgcgataaatgcggtaatagaagcaattgaggttcaaatgcctgggtggggcgtcatgattttgggtatgggcttattcgcagcgggtcttacatcagccattgccgcgcccgttgcggcgggctggactatctgcggtgctctagggtggtccgttgatcctcagagcctccgttttaaactcgttgcgctcactgtggtattgattggcggtctttttgcggtggttacctcccgaccgtctgcactcatcctcactgcacaggtaacaaacgctctgttacttccgctaattgccctagttttaataatggtcgctaatagcagtttattaccaagttcctatcgcaataatgttgtgctcaatgcgacgggcatagcggttttggtggccatgaccctgttggccggtggcaagctctttaaaattttggggtga

SEQ ID NO: 8874 - protein, 424 aa, marine gamma proteobacterium HTCC2080
MAVVWAAENVFECSNGALLNEGGLFMRLRIGPGAMVAAAFIGPGTITTASVAGATTGITLIWAIAFSVFATVLLQELAVRSALATDRDLATLIRDFGAGYWWGAPLLLLIILAVGVGNAAYQSGNLSGAGIGLNTALGTNFTSVVLLSATASAILIVINRYRLLERILVVLVAAMGLLFTGLAIMLAPLLWVQPEVRLLPDFSYANLTLVLALIGTTVVPYNLFLHATAARQHWQGSSIGEALKGARWESCVAILFGGVTTTAIVVVAAALVPNAVDQPAINAVIEAIEVQMPGWGVMILGMGLFAAGLTSAIAAPVAAGWTICGALGWSVDPQSLRFKLVALTVVLIGGLFAVVTSRPSALILTAQVTNALLLPLIALVLIMVANSSLLPSSYRNNVVLNATGIAVLVAMTLLAGGKLFKILG

SEQ ID NO: 8875 - DNA, 1623 bp, Ostreococcus tauri
  CDS (1)..(1623)
atgggcggggagacgcgcgcgtggacgacggatgcgcggcgcgcgcgggacggcgacgggaaagcgaccgcggaggacgagcgcgcggcgaaggacacggtggagatcacgggattggacgatgacgatcataggtttaatctccggacgctgtggcggttcatgggacccggattcttgatgtgcatcgcgtacgtggacccggggaactttgagagcgacctgcaggcgggcgtgttgttcgggtataagttgttgtgggtgctgttgtgggccaccgcgggggggtggtacattcaagggctcacgattcgtctggcgctggcgacggggtgggatttggcgaggtgtttgcgggaggaatatccggacccggtgcggtacgcgctgtgggtgatatccgaactcgggatcatcgcgagcgatgttccggaggtcatcggcaccgcgctggcgttgaaactgatatttagcattcccacgtgggtaggcgtggtgctgacgtcgatgtcaacaatggttttcttagggttgcaatctttcggagtccggaagctagaggcatttatggcgtctctggtcggcgtgatgtcgctgtgcttcttggccgagtgcacgtacgtcgacgcggcggtgtcgagcgtgacggcggggatcattataccgcgcttgcccgggagcacggcgctgtacatcgcgatatcgctcgtcggagccgtggtgatgccgcacaacttattcttgcacagcgcgctcgttttgagtcgaggtttcgtcttgggagagaagagtttgaagatggcgtacaagtataacgtcgtcgagtcggggttggcgttatctgtatcgttattcatcaacattgccgtcgtcgtcgtcgccgcagcgaatttcgcccatctcacagatccgcaggagaagaacaacgtgcgcgataggccgcttcagtatgcgccgcaaatgttaaaggaagtgctcggtcctgcggcgaagggatttttcgctgcggctctcctcgcatcagggcaaagttccaccatcaccggtacgtacgccggacagttcgtcatggatgggtttctagagcttcgagtgaatccggttttgcgagcctttgtcacgcgcatgtgcgcaatcgtcccgtccctggcggtcgtcttgatcgcgggtgatcagtactcagagtctctgatcgtgatatcatcgacgattttggcgatacagcttccgtttgcgctcattccgctcatcaagttcaccgcgagctcgaatattgtgggacccatggcggtgaagccaaaggcgttacggtacaccatcgcgctcacgggaaccatcatctcagccaacgtgatcctggtcatcttaaccgtcgctgagtctggattggtacacgcctcgctcgccggtgtcttcctcggcatgatcatcaccgctctgctcggtctgtacgtcgtctcactcgtgtggctcgccatgcgaccagtgcatcaaaacttaaccgctaggatcgcaccgcgcatgaagcgcccgtcctccgcctctgaggaccccgaggacgcggcctggaccaatgatgaactcctcccggacccgaacgaacccgccgtgtactcgctctag

SEQ ID NO: 8876 - protein, 540 aa, Ostreococcus tauri
MGGETRAWTTDARRARDGDGKATAEDERAAKDTVEITGLDDDDHRFNLRTLWRFMGPGFLMCIAYVDPGNFESDLQAGVLFGYKLLWVLLWATAGGWYIQGLTIRLALATGWDLARCLREEYPDPVRYALWVISELGIIASDVPEVIGTALALKLIFSIPTWVGVVLTSMSTMVFLGLQSFGVRKLEAFMASLVGVMSLCFLAECTYVDAAVSSVTAGIIIPRLPGSTALYIAISLVGAVVMPHNLFLHSALVLSRGFVLGEKSLKMAYKYNVVESGLALSVSLFINIAVVVVAAANFAHLTDPQEKNNVRDRPLQYAPQMLKEVLGPAAKGFFAAALLASGQSSTITGTYAGQFVMDGFLELRVNPVLRAFVTRMCAIVPSLAVVLIAGDQYSESLIVISSTILAIQLPFALIPLIKFTASSNIVGPMAVKPKALRYTIALTGTIISANVILVILTVAESGLVHASLAGVFLGMIITALLGLYVVSLVWLAMRPVHQNLTARIAPRMKRPSSASEDPEDAAWTNDELLPDPNEPAVYSL

SEQ ID NO: 8877 - DNA, 1596 bp, Medicago truncatula
  CDS (1)..(1596)
atggcaaacttgatacagcagcagcagcagcagcagcaacaacaacaacatcaagttatggaaacatcctcaaatcatgaagagacacaaaaatctggatggagaaagtttttgccatatataggccctggttttcttgtttcgttggcttaccttgatcctggaaacatggaaactgatttgcaagctggagctaatcacggatacgagttgctgtggctggtacttattggactcatattcgcgcttataattcagtcactggctgcaaatcttggtgtaaccactggcaaacacctttcagaagtatgtgaagttgaatatccattatttgtgaagtattgcttatggttattagcagaggttgctgtcatagcagctgacatacctgaagtgattgggacagcctttgctctcaacatactattcaacatcccattatgggcaggagttctgttgactggcttcagcactctcttgcttttgagtctgcagaggtttggggtgaggaagttggaactactgataacaatcctagtatttgtaatggctggatgtttctttgctgaaatgagctatgtaaatcccccagcttctggtgtacttaagggaatgtttgtgcccaaactggctggtgaaggagccgtagccgatgctattgctcttttgggggcccttatcatgccgcacaatcttttcctccactctgctcttgtgctatctagaaaagtacctaaatctgtgagaggcatcaatgaagcatgtagatatttcctctatgagagcggattcgctttgtttgtggcgtttttaatcaatgttgcaatgatttctgtgtcgggcactgtctgctctgccaatgacctatctggagacaatgttgaacgctgcaatgatctcacccttaactccgcttctttccttctaaagaatgtgttgggacgatcgagctcaaccatttatgccatagcactgcttgcctcaggacaaagttctaccatcacaggaacttatgcaggacagtacatcatgcagggtttcttagacataaggatgaaaagatggaaaaggaatttgatgactagatgcattgccatagcacccagtcttgctgttgccatcattggtggttcttctggctctagtcgccttatcatcatcgcatcgatgatactttcttttgagcttccatttgctttaattccactccttaagtttagcagcagcagtaccaaaatgggacctcacaagaattctatgattatcattacaatctcatggatactaggttttggaatcattagtatcaatgtgtactacctcagtactgcctttgtgaagtggataatacatagtagtctaccaaaggtggcaaatgtgttcattgggattatagtgtttcctctaatggcaatttatattgcctcagttatctaccttaccttcagaaaagacactgttgagatgttcatcgagacgaaaaatgatacagtaatgcaaaaccaagtggaaaaaggaattgtggataatggtcaactagagttgagccatgttccttatagagaagatttagctgatataccactaccagaataa

SEQ ID NO: 8878 - protein, 531 aa, Medicago truncatula
MANLIQQQQQQQQQQQHQVMETSSNHEETQKSGWRKFLPYIGPGFLVSLAYLDPGNMETDLQAGANHGYELLWLVLIGLIFALIIQSLAANLGVTTGKHLSEVCEVEYPLFVKYCLWLLAEVAVIAADIPEVIGTAFALNILFNIPLWAGVLLTGFSTLLLLSLQRFGVRKLELLITILVFVMAGCFFAEMSYVNPPASGVLKGMFVPKLAGEGAVADAIALLGALIMPHNLFLHSALVLSRKVPKSVRGINEACRYFLYESGFALFVAFLINVAMISVSGTVCSANDLSGDNVERCNDLTLNSASFLLKNVLGRSSSTIYAIALLASGQSSTITGTYAGQYIMQGFLDIRMKRWKRNLMTRCIAIAPSLAVAIIGGSSGSSRLIIIASMILSFELPFALIPLLKFSSSSTKMGPHKNSMIIITISWILGFGIISINVYYLSTAFVKWIIHSSLPKVANVFIGIIVFPLMAIYIASVIYLTFRKDTVEMFIETKNDTVMQNQVEKGIVDNGQLELSHVPYREDLADIPLPE

SEQ ID NO: 8879 - DNA, 1629 bp, Medicago truncatula
  CDS (1)..(1629)
atggcacatcaagaagtgaataatggtagcaacaaccgtatagtagccgtcaatgtgaccccttctagcacaccatcttataaccatgatgactcctcaaagcaagatcagaaaccaggatggaagaagtttttggcatatgtaggtcctggttttcttgtctccttggcctaccttgatcccggaaatatggaaactgatttgcaagctggagctaaccacggatatgagctgttgtggatcatacttattggactcatatttgcctgcataattcaatcattggctgcaaatcttggagtatgcaccggtaaacacctttcagaaatttgtaaagctgagtacccatggtttgtgaaatactgtttatggatattagcagaacttgctgtcatagctgcagacatacctgaagtgattgggacggcctttgcactaaacatactattccacgtccctgtatggggaggggttctgttgactgggtgcagcactctcttgtttttgggtctacaaagatttggggtgaggaagttggaactgctgatttcaattctagtatttgtaatggctgcatgtttctttggtgaattgagctatgtaaaaccccctgctaaaggagtaattgagggaatgtttgttcccaaactcaacggaaatggagctgtaggcgatgctattgcccttttgggtgcccttatcatgccgcacaatcttttcctccactctgctctagtgctatctcgaaaaatacctggtaccaagcgcggcatcaatgatgcatgcagatactttctcattgagagtggtttcgcgttgtttgttgcatttctaatcaatgttgcaatgatttctgtgactggcactgtttgcaaggctgatgatatttctggagagaatgttgatcgttgcaatgatattacccttaactccgcttctttccttctccagaatgtgttgggacgttcaagctcaactatttatgccatagcattgctagcttcaggacaaagttctgccatcactggaacctatgcaggccagtttatcatgcagggtttcttggacttgaagatgaaaaaatggataaggaacttggtgactaggattgttgccatagcaccaagtctagttgtctctatcattggtggttcttctggagctggaagactcattatcattgcatcgatgatactttcttttgagcttccattcgctttaattccactccttaagtttagcagcagcaggaccaagatgggacctcacaagaattctatcattatcattatcatctcatggatactgggtttgggaatcattggaatcaatgtgtactacctcattactgcttttgtgggttggattattcacaacagtctaccaaaggtggcaaatgtgttcattgggctcatagtgttccctctaatggcactgtatatcgtctcagttatctatctaacattcagaaaagacactgttgtaacgtttgtggaggttaaggatgacccgtcaatgcaaacccatgtggaaaaggggtttgtaaacgatggtcagttagagttgagttatactccttatagagaagatttagctgatatcacccgaccagagggacctaggttgtga

SEQ ID NO: 8880 - protein, 542 aa, Medicago truncatula
MAHQEVNNGSNNRIVAVNVTPSSTPSYNHDDSSKQDQKPGWKKFLAYVGPGFLVSLAYLDPGNMETDLQAGANHGYELLWIILIGLIFACIIQSLAANLGVCTGKHLSEICKAEYPWFVKYCLWILAELAVIAADIPEVIGTAFALNILFHVPVWGGVLLTGCSTLLFLGLQRFGVRKLELLISILVFVMAACFFGELSYVKPPAKGVIEGMFVPKLNGNGAVGDAIALLGALIMPHNLFLHSALVLSRKIPGTKRGINDACRYFLIESGFALFVAFLINVAMISVTGTVCKADDISGENVDRCNDITLNSASFLLQNVLGRSSSTIYAIALLASGQSSAITGTYAGQFIMQGFLDLKMKKWIRNLVTRIVAIAPSLVVSIIGGSSGAGRLIIIASMILSFELPFALIPLLKFSSSRTKMGPHKNSIIIIIISWILGLGIIGINVYYLITAFVGWIIHNSLPKVANVFIGLIVFPLMALYIVSVIYLTFRKDTVVTFVEVKDDPSMQTHVEKGFVNDGQLELSYTPYREDLADITRPEGPRL

SEQ ID NO: 8881 - DNA, 1557 bp, Oryza sativa subsp
  CDS (1)..(1557)
atgggggtgacgaaggcggaggcggttgccggcgacggcgggaaggtggtggacgacatcgaggcgctcgccgatctcagaaaggagccagcatggaaaaggtttttgtcccacattggaccaggctttatggtctgtttggcttacctcgatcctggaaatatggagactgatctacaagctggtgccaatcacaaatatgagcttctttgggtgattttgattggcctgatctctgcactgattatacaatcattatcggctaatcttggagtggtgacagggcgccatcttgctgagctgtgcaagactgaatatccagtatgggtgaaaacctgcttatggctgctagcagaactagctgtgattgcttccgatattccagaagttataggtacaggatttgctttcaaccttttgttccacataccagtgtggaccggggttctcattgctggctctagcacgcttcttcttcttggactgcgaagatatggggtaaggaaactggaggttgtggtcgcgctattggtgtttgtcatggcagggtgcttcttcgtggagatgagcatagtcaagcctccggttaatgaggtccttcaaggattattcatccccaggctcagtgggcccggtgccacaggagactccattgcccttcttggggctcttgtaatgccgcacaatctattcttgcactctgccctggtgctgtcgaggaatacacccgcatcagcaaaaggaatgaaggatgtctgtaggttcttcctctttgagagtgggatagctcttttcgtggctctgcttgtcaacattgcaatcatctctgtctccggcactgtatgtaatgcaaccaacctttcaccagaagatgctgtaaaatgcagcgaccttacattggactcctcatccttcctcctcaggaatgtgctaggaaagtcaagtgcgacagtgtacggtgtagcactcttggcttctggacagagctcgaccattactggcacttatgctgggcaatatgttatgcaggggttcctagacatcaaaatgaaacagtggcttcggaacctgatgacacgcagcattgccattgtgcctagcttaatcgtctccatcattggagggtctagtggcgccggtcgtctcatcgtcattgcatcgatgattctatcctttgagctaccatttgctctgatccctcttctcaagttcagcagcagcagcaacaagataggtgaaaacaagaactccatctatattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgagcacagcaaagagccacccgtgtag

SEQ ID NO: 8882 - protein, 518 aa, Oryza sativa subsp
MGVTKAEAVAGDGGKVVDDIEALADLRKEPAWKRFLSHIGPGFMVCLAYLDPGNMETDLQAGANHKYELLWVILIGLISALIIQSLSANLGVVTGRHLAELCKTEYPVWVKTCLWLLAELAVIASDIPEVIGTGFAFNLLFHIPVWTGVLIAGSSTLLLLGLRRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKIGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 8883 - DNA, 1731 bp, Aspergillus oryzae
  CDS (1)..(1731)
atgaactgcccctcgcgaaccgatgacactttggagcatccgggttggaaccaaaatccatccgacttgaatgcagacgtaaccactcgcaacgacttcaacggtattgccaattccaaagtgcataggaaacatgcttctggtgtgggagcagcaatgggggaaggcatcgcgactgtagagcctcaactacatggtcgggatcgaaacgataccgagtccgagaagaagatgcctggcgaagtggtctctgcagcctctgggtatcaaacacccgagaggaacagtagatcacctcgccgctctcttaaaacttctatcacagcacccttttctcatatggtgcagagtatcgtgaaattcgctcgctttgtgggccccggattcttgatcgccgtagcttacattgacccgggaaattatgcgactgatgtcgctgccggtgcagaatatcgatatgctctcttgttcatcgttcttgtctccaatctctttgccatattcctgcaatcgttatgcatcaagcttggtacggtaactgggttgaatctggcagagaactgcagagagcaccttcctcgatggctggtatatatcctctactttctttcggaggcagccattgttgcaacggatattgcagaggtcgttgggtctgcaattgcactcaacctacttttgaagatccccctggtggctggatgtgcgatcacacttgctgatgtgcttttcattctcatcttctacaaacctgatggcagtatgctgggtttacgtttgtttgaattcttcgtcatgggtttggtgttaggagtcgttgtttgcttctgcatacagctctcactcatcagggaccagtcagtcggggatgtattcaggggttacttgccatcgtctgctatagtagagtctacaggtttatatcaaagctgtggaatcctcggtgctacagttatgcctcattcgatgtttctcggcagtggtgttgtccagtcgcgcctgaaagagtttgatgtaactgaaggctacgtcgacccgtccgtttgtttaggaagcaccaacggggaggttgaatatagaccttctcttcatgctatccgaggatgcttaaagtattccatcgtagaacttgcgttgtcgcttttcacatttgctcttttcgtgaacagttctatcttgatcgtcgcaggcgctgcgctatatggaaacccggatgttggcgaggctgatctctggggtatccacgatttgctttctacttctattgctccagctgctggcctcatttttggactggccctgcttctctctggaatatcagccgggattgtgtgcacgatggcaggacagatggtgagtgagggtatgttgaattggagcattagaccttggctccgcagattgatcactcggtctgtcagcataatacccagtatcgtcgttgcaggtgccgttggcaggaaaggtctagataagacccttactgctagtcaagtggtgttgagtgtgattctcccctttgtgagcgcccctttggtctactttacctgccgcaaccgatatatgaccgtcccatccgatcgagttatgcacggtgaagaccagacccaaaccgaaggggtgaaaatgaaaaacaatctcattaccactgtaattgcaatcgtgatatggttgattattgctgtcatgaatgtggctttgcttgtcttagttggtctcggcaaagcctaa

SEQ ID NO: 8884 - protein, 576 aa, Aspergillus oryzae
MNCPSRTDDTLEHPGWNQNPSDLNADVTTRNDFNGIANSKVHRKHASGVGAAMGEGIATVEPQLHGRDRNDTESEKKMPGEVVSAASGYQTPERNSRSPRRSLKTSITAPFSHMVQSIVKFARFVGPGFLIAVAYIDPGNYATDVAAGAEYRYALLFIVLVSNLFAIFLQSLCIKLGTVTGLNLAENCREHLPRWLVYILYFLSEAAIVATDIAEVVGSAIALNLLLKIPLVAGCAITLADVLFILIFYKPDGSMLGLRLFEFFVMGLVLGVVVCFCIQLSLIRDQSVGDVFRGYLPSSAIVESTGLYQSCGILGATVMPHSMFLGSGVVQSRLKEFDVTEGYVDPSVCLGSTNGEVEYRPSLHAIRGCLKYSIVELALSLFTFALFVNSSILIVAGAALYGNPDVGEADLWGIHDLLSTSIAPAAGLIFGLALLLSGISAGIVCTMAGQMVSEGMLNWSIRPWLRRLITRSVSIIPSIVVAGAVGRKGLDKTLTASQVVLSVILPFVSAPLVYFTCRNRYMTVPSDRVMHGEDQTQTEGVKMKNNLITTVIAIVIWLIIAVMNVALLVLVGLGKA

SEQ ID NO: 8885 - DNA, 1966 bp, Acanthopanax sciadophylloides
  CDS (160)..(1773)
ccgctcatcagtaccggagtccgttcaaccaaaacccttatcctctccgctccatccatctccatctccgtaaacacaaataaaacggagcttcactgatcgttcagtcaactcgatcagtcaactaattgaagcagagagtagagattagtggaaaggatggcttctacgcagctgcagtttatggctagcatggggaatgggaatacgtcttcgaatgcaccgctcattgagaatactgattcaaaccaaattattgtacctgataagacaagctggaagaacttgtctgcctacatgggtccagggtttctagtttctattgcatatattgatcctggaaactttgaaaccgatctacagtcaggagctcagtacaagtatgagttactatggatcatattagtggcttcatgtgctgctctaattatccaatcattggcagcaaatctgggggttgtttcaggaaagcatttagcagagcactgtagaactgaatatgaaaaggtgccgaatttcatcttatggattctggctgaaatttctatagttgcatgcgacattcctgaagtgattggaacagcatttgctttgaacatgctcttcgacataccagagtggattggtgttcttctcacaggatttagtacattggttctactagcactacagcaatatggggtgaggaaacttgagttcttgattgcttttctggtatttacaatcgctgcatgctttttagtagagcttggatatgcaaagccaaatgcttcagaagtgttatatggactttttgttcctcaactccagggaagtggttctaccctccttgcaatttcactgcttggtgctatggttatgccgcataatcttttccttcactcagctctggtgctttccagaaaaataccaagatctgttaatggcatcaaagaggcttgcagattctatatggtagaaagtggctttgctctagtgctggcccttctaattaatgtatcagttatcgcagtaagtggttcagtttgcagttcctcaaatttaaatccagatgatcagaagagctgtcaaaacttggacttgaacaaagcatcctttttgcttaaaaatgttctaggcagttggagttccaagctttttgcaattgctttgctggcctcaggtcaaagttcaacaataactggaacctatgctgggcaatatgttatgcaggggtttcttgatttacgattgaagccatggatcaggaacttcttaactcgatgtttagccattgtccctagtctaattgttgcactcatcggcggttctgctggagcaggaaagttaattattattgcatcaatgatcttgtcatttgaactcccttttgctctcattccacttctcaagtccacaagcagcaagaccaagatgggcgcatatgccaactctaccatgatctcagcaaccacttggaccattggctccctaatcatgggcataaacatttactttctggtggaccacttaattgaattgctaattcatagccagttgaaactggtggacaaggttttgtgtggaatattgggctttttgggcacattagtttacttggctggaattggatatcttgtcttgaggaaaaatagagagtcgtcacaccttctagcattgacaacaccggaaagtcgacaaagcgaggcagggaatacatcagtatatagtctacccagagaggacatagtaagcatgcaactacctcagaggggtagggcagatgttgactaaaaaggaggatcaatcctttttaattttagcaaataatttcggaaagttgaattgctcctttttttttaattttatttagttgtactattagtgctaataatttggaatgaataatttttgcacccactgcttttatgtctacgtaacagctatggattgtatatgattgcagttttttaaaaaaaaaaaaaaa

SEQ ID NO: 8886 - protein, 537 aa, Acanthopanax sciadophylloides
MASTQLQFMASMGNGNTSSNAPLIENTDSNQIIVPDKTSWKNLSAYMGPGFLVSIAYIDPGNFETDLQSGAQYKYELLWIILVASCAALIIQSLAANLGVVSGKHLAEHCRTEYEKVPNFILWILAEISIVACDIPEVIGTAFALNMLFDIPEWIGVLLTGFSTLVLLALQQYGVRKLEFLIAFLVFTIAACFLVELGYAKPNASEVLYGLFVPQLQGSGSTLLAISLLGAMVMPHNLFLHSALVLSRKIPRSVNGIKEACRFYMVESGFALVLALLINVSVIAVSGSVCSSSNLNPDDQKSCQNLDLNKASFLLKNVLGSWSSKLFAIALLASGQSSTITGTYAGQYVMQGFLDLRLKPWIRNFLTRCLAIVPSLIVALIGGSAGAGKLIIIASMILSFELPFALIPLLKSTSSKTKMGAYANSTMISATTWTIGSLIMGINIYFLVDHLIELLIHSQLKLVDKVLCGILGFLGTLVYLAGIGYLVLRKNRESSHLLALTTPESRQSEAGNTSVYSLPREDIVSMQLPQRGRADVD

SEQ ID NO: 8887 - DNA, 1967 bp, Oryza sativa
  CDS (63)..(1616)
ccggcgcagttgttgagaggcaaggcaaactcaggcgactgagctaaagaagccgcactagtatgggggtgacgaaggcggaggcggttgccgcgacggggaaggtggtggacgacatcgaggcgctcgccgatctcagaaaggagccagcatggaaaaagtttttgtcccacattggaccaggctttatggtctgtttggcttacctcgatcctggaaatatggagactgatctacaagctggtgccaatcacaaatatgagcttctttgggtgattttgattggcctgatctttgcactgattatacaatcattatcggctaatcttggagtggtgacagggcgccatcttgctgagctgtgcaagactgaatatccagtatgggtgaaaacctgcttatggctgctagcagaactagctgtgattgcttccgatattccagaagttataggtacaggatttgctttcaaccttttgttccacataccagtgtggaccggggttctcattgctggctctagcacgcttcttcttcttggactgcaaagatatggggtaaggaaactggaggttgtggtcgcgctattggtgtttgtcatggcagggtgcttcttcgtggagatgagcatagtcaagcctccggttaatgaggtccttcaaggattattcatccccaggctcagtgggcccggtgccacaggagactccattgcccttcttggggctcttgtaatgccgcacaatctattcttgcactctgccctggtgctgtcgaggaatacacccgcatcagcaaaaggaatgaaggatgcctgtaggttcttcctctttgagagtgggatagctcttttcgtggctctgcttgtcaacattgcaatcatctctgtctccggcactgtatgtaatgcaaccaacctttcaccagaagatgctgtaaaatgcagcgaccttacattggactcctcatccttcctcctcaggaatgtgctaggaaagtctagtgcgacagtgtacggtgtagcactcttggcttctggacagagctcgaccattactggcacttatgctgggcaatatgttatgcaggggttcctagacatcaaaatgaaacagtggcttcggaacctgatgacacgcagcattgccattgtgcctagcttaatcgtctccatcattggagggtctagtggcgccggtcgtctcatcgtcattgcatcgatgattctatcctttgagctaccatttgctctgatccctcttctcaagttcagcagcagcagcaacaagatgggtgaaaacaagaactccatctatattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgaggacagcaaagagccacccgtgtagtacccttccagaccggttaccggtgttggctggtttttattggatagatgtttaggtccaattttttttatataaaaaatccaatagatgtttaggtccaaaattttgaattcaaaaaccggttagcagtgataaccggctgaaattttggcccatgggagtagattgttgctttttttcttagtgattagttattggcagattggcagaatgttgtagctaggcaatctaattgtatggttagatatttagtcataaatccaagagtgagttttcttggatgcgaggacaaggacaaatataaatgtaaataaatgcagttaaagtaacaccttgctccttgtggacatc

SEQ ID NO: 8888 - protein, 517 aa, Oryza sativa
MGVTKAEAVAATGKVVDDIEALADLRKEPAWKKFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDACRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEDSKEPPV

SEQ ID NO: 8889 - DNA, 2090 bp, Malus baccata
  CDS (71)..(1726)
cacattcaggcaatactagtcatccctactcaatttaactagctgctgcagatcacagacacagagagagatggaaaacaaaatacaagatcagcaacagggaacgagtacagatggagcttccaaacgcatatcagccatctattcagaacccacaccaccaccacccagcgaacactttgatcttgagcttgatcataatactgaccctaaggatgagcctcagaagcctggattgagaaagtttctagcacatgttggccctggcttccttgtctctttggcttaccttgatcctggcaacttggaaactgatctccaagctggagcaaatcacagatacgagctgctatgggtgattcttattggattgatcttcgctctcataatccagtctctctcagcaaaccttggtgtgataactgggaaacatttgtcagaattatgcaaggcggaatacccaccatttgtgaagtattgtttgtggttgctagcagaagtagccgtcatagcggctgacatacccgaagttattggcacagcgtttgccctaaatatactgttcaatattccagtttggactggagtactcttaactggtttcagtactcttctccttcttggcctgcagaaatatggggtgaggaagctggaaatgctgatagcagtgctggtgtttgtgatggctgcctgtttctttggggaaatgagttatgtgaagcctccggcatccggtgtgctcaaaggcatgttcatccctaagctcagcggccagggagccaccggagatgccattgccctcttgggtgcccttattatgccgcacaatctttttctccactcagctcttgtgctttcaaggaaaattccaaattctgtccgtggcatgaacgatgcatgtcgatatttcttgatagagagtggatttgcattatttgtagcatttttaatcaatgttgctattatatccgtatccggcaccgtttgccatcagagcaacctctcggataagaacaacgacacatgcagtgatcttactctcaattctgcttcctttcttctccagaatgtgttgggacgatcaagcaaaatcttgtatgccattgcactattagcctcaggccaaagctccacgattacaggcacttacgcaggacaatttgtcatgcagggtttcttggacattaagatgaaaaaatgggctagaaacttgatgacgaggtgcattgccattacaccaagcctcattgtttccattatcggtggatcttcaggagcaggaaggctcattatcattgcctcgatgatactatcttttgagctcccatttgctctaattccactcctcaaattcagcggtagtgccaccaaaatgggaccccacaagaattcaatctatatcattgtgatatcatggattataggaatggcaatcataggcatcaacatctactacctcagcacaggatttgtagggtggataatccacagcagtctacccaaagttgcaactgtgttcattgggatcttggtgttccctatcatggccatttacatccttgcagtcctttacctagccctaagaaaagacagtgtggtaacttttgttgagcccacaaagaacgacccagcagcccaaaaccaaatggaaaatgggcttcccaactatggtgagcccccagtgcctttcagagaggacttggctgacgtatctttacctcaatagaggacatatatattttcatatgcatatgcttcccactttgcattacgagtgttagtcgaacctaatacctgttgaacttcgtaccggttcaagaccttcgaggaaaagagacgagccgtgttagtcgaacttaatacctgccgaatctttgtaccgtttcgagaccttgagaggaaagggaccagcgttgcacttaagaattaagattgtaatggttttttatgaactagaagatagaagctctttaagaagtagtaggactcttattgtatcactcggatagtgtccccgagaggattatgtggtgtttatcatattgaataataaattatctaagggaagaataatcaaaaaaaaaaaaaaa

SEQ ID NO: 8890 - protein, 551 aa, Malus baccata
MENKIQDQQQGTSTDGASKRISAIYSEPTPPPPSEHFDLELDHNTDPKDEPQKPGLRKFLAHVGPGFLVSLAYLDPGNLETDLQAGANHRYELLWVILIGLIFALIIQSLSANLGVITGKHLSELCKAEYPPFVKYCLWLLAEVAVIAADIPEVIGTAFALNILFNIPVWTGVLLTGFSTLLLLGLQKYGVRKLEMLIAVLVFVMAACFFGEMSYVKPPASGVLKGMFIPKLSGQGATGDAIALLGALIMPHNLFLHSALVLSRKIPNSVRGMNDACRYFLIESGFALFVAFLINVAIISVSGTVCHQSNLSDKNNDTCSDLTLNSASFLLQNVLGRSSKILYAIALLASGQSSTITGTYAGQFVMQGFLDIKMKKWARNLMTRCIAITPSLIVSIIGGSSGAGRLIIIASMILSFELPFALIPLLKFSGSATKMGPHKNSIYIIVISWIIGMAIIGINIYYLSTGFVGWIIHSSLPKVATVFIGILVFPIMAIYILAVLYLALRKDSVVTFVEPTKNDPAAQNQMENGLPNYGEPPVPFREDLADVSLPQ

SEQ ID NO: 8891 - DNA, 1849 bp, Glycine max
  CDS (96)..(1646)
taataataaagctaaatcatagtagtgaggagtgactagtacaaacagaatccaaagcttttttttttcttcttcttcttcttctttctaacgccatgtctgggagccaccaagagcagccactgttagagaactcgttcatagaagaagacgagccgcaagaaacagcttatgattcgtcggagaagatagtggtggtcggagtcgacgagttcgatgacgaggagaattgggggagagtgccccgattctcgtggaagaagctatggctgttcaccgggccgggctttctgatgagcatagcgtttctggaccctggaaacttagagggggaccttcaggcgggtgccattgcagggtactcattgttgtggcttctgatgtgggccacagcaatgggcctcctgatccagctcctctcggcacggctcggcgtggccacagggaagcacctcgccgagctctgccgagaggagtatcctccgtgggcccggatagtgctctggatcatggcggaactcgctctcattggctccgatattcaggaggttattgggagcgctattgcaatcaggattcttagtcatggggttgtgcccctttgggctggggttgtcattactgctcttgattgttttatttttctctttcttgagaactatggtgtgaggactttggaagctttttttgctattctcattggtgtgatggcaatctcgttcgcatggatgtttggtgaagccaagcccagtggcaaggaacttcttcttggagttttgattccaaaactcagctccaaaactatacagcaggctgttggagttgtggggtgccttattatgcctcacaatgtgttcttgcactctgctcttgttcagtcaaggcaggttgaccgcagcaagaaaggccgagttcaagaagctcttaattattactcgatagagtccacccttgcccttgtagtttcctttattataaatatttttgtaacaacagtgtttgctaagggattttatggctctgaacttgcaaacagcataggtcttgtaaatgcaggacagtatctagaggagacatatgggggtggactatttccaattttatacatatggggtattggattattagcagcaggccaaagtagcactattactgggacttatgcaggacaattcatcatgggaggttttctaaatttaaggttaaagaagtggatgagggcgttgattacccgaagttgtgcaataattccaactatgatagttgctcttttattcgatacctcggaggaatcgttagatgttttgaatgagtggcttaatgttcttcagtcagtccagatcccctttgcacttattcccttgctttgtctggtgtcaaaggagcagataatgggcactttcagaattggtgctgtcctcaagactacttcatggctcgtggctgctctggtgatagtgattaatggctatcttttgacggaattcttttcctctgaagtgaatggaccaatgattggcactgtagtgggtgtaataactgctgcatatgttgccttcgtagtataccttatttggcaagccatcacctatttaccttggcaaagtgtaacacaaccaaagacaattgctcattcagagggttgaggttgagtgatcaatctttaaaatcgcggaataggaagtgccatccatttttaagtatgctcatgcttgtttgttactcgtgtggcaagttgatgcaataggtggtggcaccttattctttgcctgtaattataaactatgtcagagtagattttagctctgtattagtactttcaaattttgttgtcaaaaaaaaaaaaaaa

SEQ ID NO: 8892 - protein, 516 aa, Glycine max
MSGSHQEQPLLENSFIEEDEPQETAYDSSEKIVVVGVDEFDDEENWGRVPRFSWKKLWLFTGPGFLMSIAFLDPGNLEGDLQAGAIAGYSLLWLLMWATAMGLLIQLLSARLGVATGKHLAELCREEYPPWARIVLWIMAELALIGSDIQEVIGSAIAIRILSHGVVPLWAGVVITALDCFIFLFLENYGVRTLEAFFAILIGVMAISFAWMFGEAKPSGKELLLGVLIPKLSSKTIQQAVGVVGCLIMPHNVFLHSALVQSRQVDRSKKGRVQEALNYYSIESTLALVVSFIINIFVTTVFAKGFYGSELANSIGLVNAGQYLEETYGGGLFPILYIWGIGLLAAGQSSTITGTYAGQFIMGGFLNLRLKKWMRALITRSCAIIPTMIVALLFDTSEESLDVLNEWLNVLQSVQIPFALIPLLCLVSKEQIMGTFRIGAVLKTTSWLVAALVIVINGYLLTEFFSSEVNGPMIGTVVGVITAAYVAFVVYLIWQAITYLPWQSVTQPKTIAHSEG

SEQ ID NO: 8893 - DNA, 1691 bp, Thlaspi japonicum
  CDS (81)..(1613)
actcacttaggacttaggattagctcaagcaccgactccaaacactcaatactgacggtgaaatcgccggtgccggagagatgtcggagtcggagagagcgcgtccatttttagaatcggaggagaaagcttttgaagaaactgacaaggttcacgttgtcggagtcgacgaagatgatgacgtcggttacgacgagctcggaaatgcgcctccgttctcatggaagaagctttggctgttcaccggacctggctttctgatgagcatcgccttcctcgatcccggtaacctcgagagcgatctccaagccggagccatcgctggttactctctgatttggctcttgatgtgggcgacggcgatcgggcttctgattcagcttctctctgctcgtctcggcgtcgccaccggccgacacctggcggagctgtgtcgggaagagtatccgacttgggccaggatggtgctttggatcatggcggagattgctttgatcggtgccgatattcaggaagtcatcggaagtgccatagctatcaagatcttgtctaatggattgatccctctctgggctggtgttgtaatcactgctctcgattgtttcatatttctaattctggagaattacggagtaaggaaactagaagctgtgtttgctgttttgattgcaacaatggcgctttcatttgcttggatgtttggccagacaaagcctagtggaaccgaacttcttgttggagctttggtcccaaaactaagctccaggactataaaacaagctgttggaattgtgggatgcatcatcatgcctcacaatgtgtacttgcactcagcgcttgtgcaatcgagagaaatcgatccgaaaaagagattccgtgtcaaagaagccctcaggtactattccattgaatccaccggagctctcgtggtttccttcataatcaacgtctgtgtgaccaccgtgtttgctaaatctttctataagacagacatagcggatactatcggtcttgcaaacgcaggagattacttacaggaaaaatacggcggcggatattttccggtgtactatatatgggccgtcggacttttagctgctggtcagagtagtaccatcactggtacatacgccggacagtttataatgggagggttcttgaatctcaagatgaagaaatggattagagcgacaatcacaagaagctgcgcgatcatccctacgatgatcgtggcgattgtctttaattcttcggctacattgctcgacgagctcaacgaatggctaaacgttcttcagtctgttcagatccctttcgctgtgatccctctcctttgcttggtctccaacgagaggatcatgggcagcttcaaaatcaaacctttaatgcaggcaatctcgtggcttgtagctgctcttgtgatagccattaacgcgtatctgatggtaaatttcttctcgggagctgcgaagagtgtggtcatgctcgtgcttgtgatcatattcgttgttgcgtatgttttttttgtgctttaccttatctcaagaggcttcacgtacactccctggcagttagtggcttcggagaaagtaaaagagagggatgatgagtaagtatgtaaacgcagagaccatttgcgtgaagaataagacaagagagaaaggctctctttgattaaaaaaaaaaaaaaa

SEQ ID NO: 8894 - protein, 510 aa, Thlaspi japonicum
MSESERARPFLESEEKAFEETDKVHVVGVDEDDDVGYDELGNAPPFSWKKLWLFTGPGFLMSIAFLDPGNLESDLQAGAIAGYSLIWLLMWATAIGLLIQLLSARLGVATGRHLAELCREEYPTWARMVLWIMAEIALIGADIQEVIGSAIAIKILSNGLIPLWAGVVITALDCFIFLILENYGVRKLEAVFAVLIATMALSFAWMFGQTKPSGTELLVGALVPKLSSRTIKQAVGIVGCIIMPHNVYLHSALVQSREIDPKKRFRVKEALRYYSIESTGALVVSFIINVCVTTVFAKSFYKTDIADTIGLANAGDYLQEKYGGGYFPVYYIWAVGLLAAGQSSTITGTYAGQFIMGGFLNLKMKKWIRATITRSCAIIPTMIVAIVFNSSATLLDELNEWLNVLQSVQIPFAVIPLLCLVSNERIMGSFKIKPLMQAISWLVAALVIAINAYLMVNFFSGAAKSVVMLVLVIIFVVAYVFFVLYLISRGFTYTPWQLVASEKVKERDDE

SEQ ID NO: 8895 - DNA, 1365 bp, Enterococcus faecalis
  CDS (1)..(1365): transl_table=11
atgggcaaagaaaagaaaacggaaaaaatgcttaattatgcaaatggacctagtttagaagagataaataataccgtcgaggtacctaaaaacgcaagcttttggcgaactttgttagcctatagcggacctggcgctttagtggctgttggttatatggatccaggaaattggattacgtcaattgctggcggagcggaatataagtacacgttacttagtgtgattttgctttctagtttagttgccatgttactacaaagtatggctgcgcgcttaggaatcgtgacaggaatggatttagctcaagcgactagagagcatacaagtaaacgaacgggcgttgccttgtgggtggtgacggagttagccataatggctacagatatcgctgaggtaattggtggtgccgttgctttgcaattattatttggttttccattattaattggtgtgttgataacaacgtttgatgttttattactgttgctactgacaaagttaggctttcgcaaaatcgaagcaattgtttcttgtttaattgcagtcatcttttttgtttttgcttatgaagtggcattagcagatccaaatgttggtgaagtattacgaggttttattccagacacaaaaatagcgacagataaatccatgttatttttagccttggggatcgttggagcgacagtcatgccccataacttatatttgcattcttccattgcgcaagcacggaaatttgatcgtaacgatgatgttgagaaagccaaagcaattcgtttcactacttgggattcaaatattcaattaactgttgctttcgtcgtaaattgtttgttgttaattttaggaggagcattattttatggaaccaacagtgaattaggtaaatttgttgatttatttgatgctctgaaaaatccagatattgttggtaatattgctagcccagtgttaagtattctttttgcaattgctttactggcttcgggtcaaaattcaacgattacaggtacgctgtcaggacaaattgtaatggaaggctttatccatttaaaaatgccgttgtgggcacgacgagtgttaactcgtttgttagcaattgtgccagtcattatctgtgtcattatttatggcggtagcgaaacggctgttgaagacttgttactttatacgcaagttttcctaagtattgctttgccagtgtcgattattcctttaacgatgtatacaagtgataaaaaattaatgggccaatttgcgaatccagcgtgggtgaaatttttagcttggattattgctattgccttgacgttattgaatttatttttaatttatggcacattaactggtttaacgaattaa

SEQ ID NO: 8896 - protein, 454 aa, Enterococcus faecalis
MGKEKKTEKMLNYANGPSLEEINNTVEVPKNASFWRTLLAYSGPGALVAVGYMDPGNWITSIAGGAEYKYTLLSVILLSSLVAMLLQSMAARLGIVTGMDLAQATREHTSKRTGVALWVVTELAIMATDIAEVIGGAVALQLLFGFPLLIGVLITTFDVLLLLLLTKLGFRKIEAIVSCLIAVIFFVFAYEVALADPNVGEVLRGFIPDTKIATDKSMLFLALGIVGATVMPHNLYLHSSIAQARKFDRNDDVEKAKAIRFTTWDSNIQLTVAFVVNCLLLILGGALFYGTNSELGKFVDLFDALKNPDIVGNIASPVLSILFAIALLASGQNSTITGTLSGQIVMEGFIHLKMPLWARRVLTRLLAIVPVIICVIIYGGSETAVEDLLLYTQVFLSIALPVSIIPLTMYTSDKKLMGQFANPAWVKFLAWIIAIALTLLNLFLIYGTLTGLTN

SEQ ID NO: 8897 - DNA, 1602 bp, Enterococcus faecalis
  CDS (1)..(1602): transl_table=11
atggggaaaaattcagaagaacatgaaccaaagcaaagacatcatttgattgaatatgcaaatggtccttcgcttgaagaaattaatggcaccatcgacgtgcctaaaaatatgagtttttggaaaacgttatttgcttactcaggtccaggagcattggtagcagtggggtatatggatccaggaaactggtctacttcaattactgggggacaaaattttcaatatttattgatgtcgattattttaatttccagtttgattgcaatgttgctccaatatatggctgctaaattaggcattgtttcacagatggatttagcacaagcgattcgtgctagaactagtaagacgttaggtattgtattatggattttaacagagttagcaattatggctacagatatcgctgaagttatcgggggcgcaattgccttatatttattatttcatattcctttaggtctggctgtcttcattacggtatttgatgttttacttttgttgttattgacaaaaattggttttagaaaaattgaagctattgttgttgctttaattgttgttatttttgtgatttttgcttatcaagtggcattgtcaaatccagtatggggagatgtaattaaagggctggttcctagcgcagaagctttttctacatcacatgcggtgaatgggcaaacgccactgacaggtgcattggggattattggtgcaacagtgatgcctcataatttgtatttacattcttctgttgtgcaaagtcgtaaaattgatcgtaaagataaaaccgatattcaacgcgctttacgcttttcaacttgggattctaatattcaattaacgatggcattttttgttaactctttattattgattatgggtgtggccgtttttaaatccggcagtgtcaaagatccttcattctttggtttgtttgatgctttatcaaatccagcggttatgagtaattctattttagcgcatattgcaggttctggaattttatcaattttatttgcggtagccttattggcatcaggacaaaattcaacaattacaggaacgttaactggtcaaatcattatggaagggtttattcatatgcgcgtaccaatttggttacgtcggatggtcacacgtttgttatctgttattcctgtcttaatctgtgttttaatgaccagcggaaaaagtacagtggaggagcatattgcgattaataatttaatgaacaattcacaagtttttctagcatttgctttgccattttcgatgttgcctttactgatgtttacagatagccgtgttgaaatgggtgaacattttaaaaactcgtggttaattaaattgttaggctgggtttctgtcattggcttaatttacctcaatatgaaaggtttacctgatcaaattgaaggattcttcggtgataatccgacagcgagtcaaattacgttagccgataatattgcctatgtcatcatagcactcgtcatcctcttgttagtttggacggttgtggaattatataaaggcgataaacgatatgcacagcagcttgcagctatggagcaacaagtagaggaggttaaataa

SEQ ID NO: 8898 - protein, 533 aa, Enterococcus faecalis
MGKNSEEHEPKQRHHLIEYANGPSLEEINGTIDVPKNMSFWKTLFAYSGPGALVAVGYMDPGNWSTSITGGQNFQYLLMSIILISSLIAMLLQYMAAKLGIVSQMDLAQAIRARTSKTLGIVLWILTELAIMATDIAEVIGGAIALYLLFHIPLGLAVFITVFDVLLLLLLTKIGFRKIEAIVVALIVVIFVIFAYQVALSNPVWGDVIKGLVPSAEAFSTSHAVNGQTPLTGALGIIGATVMPHNLYLHSSVVQSRKIDRKDKTDIQRALRFSTWDSNIQLTMAFFVNSLLLIMGVAVFKSGSVKDPSFFGLFDALSNPAVMSNSILAHIAGSGILSILFAVALLASGQNSTITGTLTGQIIMEGFIHMRVPIWLRRMVTRLLSVIPVLICVLMTSGKSTVEEHIAINNLMNNSQVFLAFALPFSMLPLLMFTDSRVEMGEHFKNSWLIKLLGWVSVIGLIYLNMKGLPDQIEGFFGDNPTASQITLADNIAYVIIALVILLLVWTVVELYKGDKRYAQQLAAMEQQVEEVK

SEQ ID NO: 8899 - DNA, 1533 bp, Lactococcus lactis subsp
  CDS (1)..(1533)
atggatgataaagaacatcaacgtcatcgattgatttatcatacgaatggaaaatccttagaggaaataaatgggacagtagaagtacctaaaaatgttggctttttcaaaatgttgctaacttactcaggaccgggtgccttagttgcagttggttatatggacccaggaaattggtcaacctcaataactggcggacaaaactttcaatacttactgatttcagtcattctgatgtcaagtctaattgcaatgctccttcaatatatgtcggcaaaattgggtattgtcagtcaaatggatttggctcaagctataagagcaagaacaagtaaatctttagggattgttttatggatattaactgagcttgccataatggcaacggatattgcagaagtaattggggctgctatcgctctttatcttttatttaatatcccattaatcttagcggtttttattacagttcttgatgtctttttgcttttgttattgacgagagtaggttttagaaaaattgaagcccttgttatctgtttgattttagtcattttggtcatttttgcttatcaagtcgctttatcaaatccagattggaaaggaattattgagggatttatccccaatagccggacgtttgcctcttcaccaacagtggcagggatgtctcctttaacaggggccttagggattattggtgctacagttatgcctcataatttgtatctccattcttctatttcacaaagccgaaaaatcaatcatcaggataaatcagatgttgctagagcggtgagattttcaacatgggattctaatattcaattgacagtggcttttgttgtgaattccctcttgttaatcatgggagttgccgtattcaaaacgggcgtgattgatgatccatcattctttggtttatatgatgccctctctaatccaactgttttaagcaatggactgcttgccgatgtagcaaaaacaggagctttatccactttgtttgccgtagctcttcttgcttcaggacagaattctactattacagggactttaactggtcaagttattatggaaggtttcattcatatgagaatgccaatgtgggccagaagattagtgacacgtttgctttcagttgttccagtattgatttgtgtctctatgacaagaggacaaactttgaaagcacagcatgaagcaattaataatttgatgaataattctcaagtttttctagcctttgctctacctttttcaatcattcctttgttgatgttgactaatagtaaaaaggagatgggtgattttaaaaataatttcattattaaatgtttgggctggttttcagttattgctttgacctatcttaatttgattggtttgccagatcaaattgccaactttatacctcataatcttggactatctcatcttatttctggttttcttattttgggagttctctttttattaatttggacaatcgtagaactttatcgaggaaataaaaaaatgatggcttgctaa

SEQ ID NO: 8900 - protein, 510 aa, Lactococcus lactis subsp
MDDKEHQRHRLIYHTNGKSLEEINGTVEVPKNVGFFKMLLTYSGPGALVAVGYMDPGNWSTSITGGQNFQYLLISVILMSSLIAMLLQYMSAKLGIVSQMDLAQAIRARTSKSLGIVLWILTELAIMATDIAEVIGAAIALYLLFNIPLILAVFITVLDVFLLLLLTRVGFRKIEALVICLILVILVIFAYQVALSNPDWKGIIEGFIPNSRTFASSPTVAGMSPLTGALGIIGATVMPHNLYLHSSISQSRKINHQDKSDVARAVRFSTWDSNIQLTVAFVVNSLLLIMGVAVFKTGVIDDPSFFGLYDALSNPTVLSNGLLADVAKTGALSTLFAVALLASGQNSTITGTLTGQVIMEGFIHMRMPMWARRLVTRLLSVVPVLICVSMTRGQTLKAQHEAINNLMNNSQVFLAFALPFSIIPLLMLTNSKKEMGDFKNNFIIKCLGWFSVIALTYLNLIGLPDQIANFIPHNLGLSHLISGFLILGVLFLLIWTIVELYRGNKKMMAC

SEQ ID NO: 8901 - DNA, 1530 bp, Solanum lycopersicum
  CDS (1)..(1530)
atgcctctaaacgatgaagaagaacaccaccaattgttggcggatagattactcgaggaagaatctgcctatgagtactccgacaaagtccatattatcggagtcgacgatgatgatgatttcaccaaaactcctcctttttcctggaaaaaactatgggcttttactggaccgggtttcttgatgagtatagcctttttggatccgggaaatcttgaaggagatcttcaggcaggggctatcgctgggtattctctgttatggctactcttttgggctacggctatgggattacttgttcagcttttagcggctcgtttgggtgtcgctacttctaggcatttggctgagctatgtagggatgagtatccgaaatgggctcgattgcttttgtgggtcatgaccgaattggctctaattggggctgatattcaagaggttattggaagtgctattgctataaagattttgagtcgagggttcttgcctctatggtctggtgttgtcatcactgctcttgattgctttgtattcttatttcttgagaactatggagtgaggaagctggaagcactctttgctgtccttattgcagttatggccgtctcatttgcatggatgtttggagagacgaaaccaaatggagtggaacttcttgttggtgtggtggtcccaaaacttagctccaaaacaataaagcaggcagtgggaattgtagggtgtgttatcatgcctcacaatgtgtttctacattcggcgctagtgcagtccagagacattgacaaccgtaagattggcagagttcgagaagcacttaattactactccatagagtcgacaattgccttggcaatttcattcatgatcaatttgtttgttacaacagtgttcgcaaagtcattttatggtagtgaaatagccaatagcattggcctagaaaatgctggtcaatatcttcaggataagtatggtgggggatcgttccccatcctttatatctgggctattggattgttggctgctggacagagtagtactataactggtacttatgctggacaatttattatgggaggttttctgcacatgaggttgaaaaaatggcagagagcgttaataacaagaagttgtgctatcgtcccaactctgatagttgctcttgcttttgacacctctgagaaatcattagatgttctgaacgagtggctcaacgttcttcagtgtgtccaaatcccttttgccctgatcccccttctttgtcttgtatccagagaagaaatcatgggtgttttcaagattggctctactatgaaggtgatatcatggctagtagctgtgctggttatgctgattaatggctatcttttgatggactctttatcttctgctgtcagtgggatgttgtttacatctgttgtagttgcttttacaggtgcatacattgccttcattgtatacctcatttcacggggaattaccttccccaattggtttgtaaaaaacaaaagtatctcgagcatagataattga

SEQ ID NO: 8902 - protein, 509 aa, Solanum lycopersicum
MPLNDEEEHHQLLADRLLEEESAYEYSDKVHIIGVDDDDDFTKTPPFSWKKLWAFTGPGFLMSIAFLDPGNLEGDLQAGAIAGYSLLWLLFWATAMGLLVQLLAARLGVATSRHLAELCRDEYPKWARLLLWVMTELALIGADIQEVIGSAIAIKILSRGFLPLWSGVVITALDCFVFLFLENYGVRKLEALFAVLIAVMAVSFAWMFGETKPNGVELLVGVVVPKLSSKTIKQAVGIVGCVIMPHNVFLHSALVQSRDIDNRKIGRVREALNYYSIESTIALAISFMINLFVTTVFAKSFYGSEIANSIGLENAGQYLQDKYGGGSFPILYIWAIGLLAAGQSSTITGTYAGQFIMGGFLHMRLKKWQRALITRSCAIVPTLIVALAFDTSEKSLDVLNEWLNVLQCVQIPFALIPLLCLVSREEIMGVFKIGSTMKVISWLVAVLVMLINGYLLMDSLSSAVSGMLFTSVVVAFTGAYIAFIVYLISRGITFPNWFVKNKSISSIDN

SEQ ID NO: 8903 - DNA, 1593 bp, Solanum lycopersicum
  CDS (1)..(1593)
atggagaatcaacagcaaaatcaagtgattggaggtagcaagagaattgtagcactaaatgagagtccattaccttctaataatgatcatcatattgagcatcagaaacatggctggaaaaacttttttgcatatgtggggccaggttttcttgtttccttggcatatcttgatcccggaaacttggaaactgatttgcaagcaggagcaaaccatagatatgagcttctttgggtgatcctcattggattgatatttgctcttattattcaatcacttgctgctaatcttggagtaagcactgggaaacatttatcagaattatgcagggctgaatatccagtatttgttaagtactgcctatggttgctagctgaagttgctgtcatagctgcagatattcctgaagtgattgggacagcatttgctcttaatatattgttccatattcctgtttgggctggagttctttgcactggtgttagtactcttctattcattggcctgcagagatatggggttaggaagttagaattgttaatagcaattctagtatttgtaatggcagcttgtttctttggggaaatgagttatgtaaaacctcctgctaatgaattattcaaaggaatgttcattcctaagctcaacggtgacggagccaccgctgatgctatcgccttgttgggcgcccttgttatgccacacaatctcttccttcactctgcccttgtactatctaggaagatacctaactcggttcgtggcattaatgatgcatgtaaattcttcttgatagagagcggtttcgcgttgtttgtgtccttcctaatcaatgtggcagttgtgtctgtgtctggtactgtttgtggagctgacaatctttcagatcagaataaagaaagttgtagtgacattacattgaactctgcttcttttcttctcaagaatgtacttggaaaatcaagttctactgtttatgccattgcattattagcctcaggacaaagctctaccattactggtacttatgctggccaatttatcatgcaaggatttttggatcttaaaatgaagacgtggttaaggaacttgtttactagacttattgctattactccaagccttgttgtttcaattattggaggatcgtcaggagcgggaagactaatcatcattgcttctatgatactttcctttgaacttccatttgcactcattccactactcaaattcagcagtagctccactaagttgggaccacacaagaactcaatttatattatcgtgatctcgtggattcttggactaggcatcattgggatcaacatctactaccttagcacagctttcgtgggttggctgataagcaacaatttgcctaaagttggaaatgtattgattgggatcgtagtatttccattgatggctatatatattctagctgtgatataccttatgtttcgaaaagataaagttgtgacctacattgatccaatcaaggatgatcatatggaaaatggaataaacagtatggaattagtagatcgtgtgccttatagagaggatcttgctgatattccattgccacaataa

SEQ ID NO: 8904 - protein, 530 aa, Solanum lycopersicum
MENQQQNQVIGGSKRIVALNESPLPSNNDHHIEHQKHGWKNFFAYVGPGFLVSLAYLDPGNLETDLQAGANHRYELLWVILIGLIFALIIQSLAANLGVSTGKHLSELCRAEYPVFVKYCLWLLAEVAVIAADIPEVIGTAFALNILFHIPVWAGVLCTGVSTLLFIGLQRYGVRKLELLIAILVFVMAACFFGEMSYVKPPANELFKGMFIPKLNGDGATADAIALLGALVMPHNLFLHSALVLSRKIPNSVRGINDACKFFLIESGFALFVSFLINVAVVSVSGTVCGADNLSDQNKESCSDITLNSASFLLKNVLGKSSSTVYAIALLASGQSSTITGTYAGQFIMQGFLDLKMKTWLRNLFTRLIAITPSLVVSIIGGSSGAGRLIIIASMILSFELPFALIPLLKFSSSSTKLGPHKNSIYIIVISWILGLGIIGINIYYLSTAFVGWLISNNLPKVGNVLIGIVVFPLMAIYILAVIYLMFRKDKVVTYIDPIKDDHMENGINSMELVDRVPYREDLADIPLPQ

SEQ ID NO: 8905 - DNA, 1560 bp, Oryza sativa subsp
  CDS (1)..(1560)
atgggggtgacgaaggcggaggcggttgccggcgacggcgggaaggtggtggacgacatcgaggcgctcgccgatctcagaaaggagccagcatggaaaaggtttttgtcccacattggaccaggctttatggtctgtttggcttacctcgatcctggaaatagtgtggagactgatctacaagctggtgccaatcacaaatatgagcttctttgggtgattttgattggcctgatctttgcactgattatacaatcattatcggctaatcttggagtggtgacaggtagccatcttgctgagctgtgcaagactgaatatccagtatgggtgaaaacctgcttatggctgctagcagaactagctgtgattgcttccgatattccagaagttataggtacaggatttgctttcaaccttttgttccacataccagtgtggaccggggttctcattgctggctctagcacgcttcttcttcttggactgcaaagatatggggtaaggaaactggaggttgtggtcgcgctattggtgtttgtcatggcagggtgcttcttcgtggagatgagcatagtcaagcctccggttaatgaggtccttcaaggattattcatccccaggctcagtgggcccggtgccacaggagactccattgcccttcttggggctcttgtaatgccgcacaatctattcttgcactctgccctggtgctgtcgaggaatacacccgcatcagcaaaaggaatgaaggatgtctgtaggttcttcctctttgagagtgggatagctcttttcgtggctctgcttgtcaacattgcaatcatctctgtctccggcactgtatgtaatgcaaccaacctttcaccagaagatgctgtaaaatgcagcgaccttacattggactcctcatccttcctcctcaggaatgtgctaggaaagtcaagtgcgacagtgtacggtgtagcactcttggcttctggacagagctcgaccattactggcacttatgctgggcaatatgttatgcaggggttcctagacatcaaaatgaaacagtggcttcggaacctgatgacacgcagcattgccattgtgcctagcttaatcgtctccatcattggagggtctagtggcgccggtcgtctcatcgtcattgcatcgatgattctatcctttgagctaccatttgctctgatccctcttctcaagttcagcagcagcagcaacaagatgggtgaaaacaagaactccatctatattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgagcacagcaaagagccacccgtgtag

SEQ ID NO: 8906 - protein, 519 aa, Oryza sativa subsp
MGVTKAEAVAGDGGKVVDDIEALADLRKEPAWKRFLSHIGPGFMVCLAYLDPGNSVETDLQAGANHKYELLWVILIGLIFALIIQSLSANLGVVTGSHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 8907 - DNA, 1936 bp, Chlamydomonas reinhardtii
  CDS (65)..(1606)
gcttctccataagtttaagttttaatcttgtgtgcctcgaagcgcggcaagggccaacgaccaaatggttctggggcgcttgttcgcgcgctctgagagcgccgcgccagccctcgctgattataataatgaggggaatggctccactatcgatacctccgtggtggcggtcgaggtcgaggcgagtggctcgcctagcagtgctactgtccgtggcgacagcactttgaacgagccgctgcttgagggcttcaaggaccgcggtgaactcccctcactgccagagtcgaacgcgtccctttcattccccgaggagtcagcgccatggtggagaaaattcttcgctttcatgggtctgggcttcctcatcagcgtcggctacatggatcctggaaactgggccactgacctggcggctgggtcgtcatttggctacacgctgctgttcgtggtcctgtgctcctcgctgtgcgccatgttccttcagtacctgtcgctcaagctcggtattgcttcagaccgcgatctggctcaggcctgccgcgacgcctaccacccccatgtcaacaagcttctgtgggtggtggccgaggccgccatcgcagccaccgacctggcggaggtggtgggctgtgccatcgcattcaacctgctactgggcatcccgctgtgggcaggtgtgctgatcacggcggctgacgtgatcatcctgctggtggctgaggcgcgcagcttccgcttcctggagatcctggtgggggcgctgaccgccctgatctcggcgtgcttcatctacgagctggtgaaggcgcagcccgacatgggcaaggtgatgcgcggctacctgccgtccaaggaaatcatcaccaacaaggacatgctgtacctggccacaggtatcctcggtgccacggtcatgccgcacaacctttacctgcactcgtccgtcatccagacccgcgcctaccccaggaccacggccggtcgcaccatagccatcaagttgggcctggtggactcgaccctgtcgctgctcgtcgcctttgtcatcaactcgtccatcctcatcgtggctgccgccgccttccactacgccacaccgccgctggaggacattgctgacatcactgacgcctacgagctgcttgcctcgagcctaggctccaaggccgcctccatcctgtttggtgtggcgctgcttgcggcgggccagaactccaccatcaccggcacgctgtcgggccagattgtgatggagggtttcctcagcttcaagatgaggccctggctgcgccgcattatcacccgtggcgccgccatcgtgcccgccgccaccgtggccgccgtgatgggtcgcgagggggtgtcgcagctgttggtgctgtcgcaggtgattttgtcgctgacgctgccgttcgcggtgttcccactggtgcacttcaccagcagccgcaagtacctcggcaacttcgccaaccgctggtacgcctccgtcatcgcgtggctccttttcctgttcatctcggccctcaacgtcaacctggtggttcagtctgcgatcagcggaagctttggcgggcttggccaccggcgcgcggcggtgtgatggggccttgcgggcgccagggttgttctccgcgcatgcgcaaagcggaagcgcgcgcggccccatgcaggggcagcgggtaatccagggctttttgctcgccagccggcgagttgtgttagcttggcgcctcttggcgctgggcgcacttgcactctggtggttccgcttggataggtggacgtcgtgtcgttgccgtggtgcgcaggatcgattgtcgggcaggcgtcgagtggcgctgctgatcgccaacttctcgcgaggttgggcaattgtgacctactgttttgaatgtagtgagcatgcatgcaatgtaagcttgtgcgaacg

SEQ ID NO: 8908 - protein, 513 aa, Chlamydomonas reinhardtii
MVLGRLFARSESAAPALADYNNEGNGSTIDTSVVAVEVEASGSPSSATVRGDSTLNEPLLEGFKDRGELPSLPESNASLSFPEESAPWWRKFFAFMGLGFLISVGYMDPGNWATDLAAGSSFGYTLLFVVLCSSLCAMFLQYLSLKLGIASDRDLAQACRDAYHPHVNKLLWVVAEAAIAATDLAEVVGCAIAFNLLLGIPLWAGVLITAADVIILLVAEARSFRFLEILVGALTALISACFIYELVKAQPDMGKVMRGYLPSKEIITNKDMLYLATGILGATVMPHNLYLHSSVIQTRAYPRTTAGRTIAIKLGLVDSTLSLLVAFVINSSILIVAAAAFHYATPPLEDIADITDAYELLASSLGSKAASILFGVALLAAGQNSTITGTLSGQIVMEGFLSFKMRPWLRRIITRGAAIVPAATVAAVMGREGVSQLLVLSQVILSLTLPFAVFPLVHFTSSRKYLGNFANRWYASVIAWLLFLFISALNVNLVVQSAISGSFGGLGHRRAAV

SEQ ID NO: 8909 - DNA, 1317 bp, Pseudomonas aeruginosa
  CDS (1)..(1317): transl_table=11
atgtccgcgaaggataccccggccccccaggccgccgagcccggtcgcgcccagccggtcgaagtccccggcggcggccactggtggcgccgcctgctggccttcgccggccccggctacctggtcgcggtgggctacatggacccgggcaactgggccaccgacgtcgccggcggcgcgcaactgggctacctgctgctctcggtaatcctgctctccagcctgatggcgatgctgctgcaggcgctgtccgcgcgcctgggcatcgccagcggcctggacctggcccaggcctgccgcgaacgctactcgccgagcacctgccgcctgctgtggctggcctgcgagacggcgatcatcgcctgcgacctggccgaggtgatcggcaccgccatcgccctgaagctgctgttcggcctgccgctggcctggggcgccttgctctgcgtgggcgacgcgctgctggtgctggtcctgatcggacgtggccagcggccgctggaggccttcgtggtggcgttgctgacactgatcttcgcctgcttcgcggtacagttgctgctctcgcgtcccgaactcggcgaggtgctccaagggttcttgccgagcccgcgggtgctcagcgacccggctgccctgtacctggcgatcggcatcgtcggcgcgaccgtcatgccgcacaacctctacctgcattcctcgctggtgcagagccgcgcctacccgcgcagccttgccggcaagcgcaaggcgctgcgctgggcggtggccgacagcagcctggcgctgaccctggcgctgctggtcaacgcggcgatcctgatcgtcgccgccagcgtgttccaccgcaacgggcacaccgaggtggtcgatatcgagcaggcccacgcgctgctctcgccattgctcggcctggaactcgcctcgctgctgttcgccgtggcgctgctcgcgtccggcctcaactcgacggtcaccaccaccctggccgggcagatcgtcatggagggcttcctccgcctgcgcctggcgccctgggcgcggcgcctgctgacccgtggcgtcgcagtgctgccggtgctgctggtgaccctgctctacggcgaggatggcaccgcgcggctgctgatcttcagccaggtgatcctgtcgatgcagttgccgctggcagtgatcccgctgctacagttcgtttccgaccggcgcctgatgggcccgctggcgatcggtgccgggacccggtggctggcctgggcggtagcgctggcgatcgtcggcctgaacctgcaactgctggccgacttcgcgttcggctga

SEQ ID NO: 8910 - protein, 438 aa, Pseudomonas aeruginosa
MSAKDTPAPQAAEPGRAQPVEVPGGGHWWRRLLAFAGPGYLVAVGYMDPGNWATDVAGGAQLGYLLLSVILLSSLMAMLLQALSARLGIASGLDLAQACRERYSPSTCRLLWLACETAIIACDLAEVIGTAIALKLLFGLPLAWGALLCVGDALLVLVLIGRGQRPLEAFVVALLTLIFACFAVQLLLSRPELGEVLQGFLPSPRVLSDPAALYLAIGIVGATVMPHNLYLHSSLVQSRAYPRSLAGKRKALRWAVADSSLALTLALLVNAAILIVAASVFHRNGHTEVVDIEQAHALLSPLLGLELASLLFAVALLASGLNSTVTTTLAGQIVMEGFLRLRLAPWARRLLTRGVAVLPVLLVTLLYGEDGTARLLIFSQVILSMQLPLAVIPLLQFVSDRRLMGPLAIGAGTRWLAWAVALAIVGLNLQLLADFAFG

SEQ ID NO: 8911 - DNA, 1386 bp, Agrobacterium tumefaciens
  CDS (1)..(1386): transl_table=11
atgttctttatgagaatgatttgcaattgcattaattcgatttccatgaaagcacagaagatggacaagccagtctttggatggcgacggaacggcgatgatctctcgctgtctgacgttcacagttcgatccgcatcaaaccggatgccagcacgtttcgccgggcaatggccttttttggccccggctatctcgtcgctgtcggttacatggatcccgggaactgggcgacgtcgctcgccggcggctccaaattcggctacacgctgctggcagtcgcgctggtttccaacatcatggcgattgtgctgcagtcgctctgtgcccgtcttgcgatcgcctccggccgcgatctcgcccaggcctgccgtgatgcctatccgaaacccgttgccatggtgctgtggctgctcgcggaaatcgccatcatcgccaccgacattgccgaggtgatcggcaccgccatcggcctcaacctgatcttcggcattccgctggaacttggcgtcctcatcaccgcgctcgatgtgttcctgatcctctatctgcaaaagctcggttttcgctgggtggaggcactggtcatcacgctgctcggcgtcatcgccgtgtgtttcgccattcagctggcgctggccgatcctgactgggggcaggtgatcctcggttttgcgccgacgacggagattgtcaccaatccggacatgctttatctggcgctcggcattctgggtgcgactgtcatgccgcataatctctatctgcattcgggcatcgtgcagacccgcgaaatcggccccaccattgccgaaaaacgcgaggcgctgaaattcgccacgctcgattccaccatcgcgctgatgttcgctttgctcatcaacgcctcgatcctcattctcgcggcggcgaccttcaacaaaacggggcagactaatgtcgccgaactcggcgaagcgcatagtctgcttgcgccgctgctcggccttgccatagcgccgacgctgttcggcgtggcgcttctgtgctgcggcatcaattccaccgtcacggcaacgctcgccggccagatcgtgatggaaggtttcctcaagatgcggctcgccccatggctgcgccgcctcatcacccgcgccatcgccatcgttcccgccgccggcgtcaccatcttttatggcgacagcggcacgggccagctgctgatcctgacgcaggtggtgctcagcctgcaactttccttcgccgtcttcccgcttgtgatgtttacctccgacaaggccaagatgggtgagttgcgctcgccactctggctctcggccattgcgtggttgatcgcggtggtgattgcggcgctgaatgtgaagttgctgatggattttatggggtga

SEQ ID NO: 8912 - protein, 461 aa, Agrobacterium tumefaciens
MFFMRMICNCINSISMKAQKMDKPVFGWRRNGDDLSLSDVHSSIRIKPDASTFRRAMAFFGPGYLVAVGYMDPGNWATSLAGGSKFGYTLLAVALVSNIMAIVLQSLCARLAIASGRDLAQACRDAYPKPVAMVLWLLAEIAIIATDIAEVIGTAIGLNLIFGIPLELGVLITALDVFLILYLQKLGFRWVEALVITLLGVIAVCFAIQLALADPDWGQVILGFAPTTEIVTNPDMLYLALGILGATVMPHNLYLHSGIVQTREIGPTIAEKREALKFATLDSTIALMFALLINASILILAAATFNKTGQTNVAELGEAHSLLAPLLGLAIAPTLFGVALLCCGINSTVTATLAGQIVMEGFLKMRLAPWLRRLITRAIAIVPAAGVTIFYGDSGTGQLLILTQVVLSLQLSFAVFPLVMFTSDKAKMGELRSPLWLSAIAWLIAVVIAALNVKLLMDFMG

SEQ ID NO: 8913 - DNA, 1278 bp, Bacillus subtilis
  CDS (1)..(1278): transl_table=11
atgatgaacaaggacatcacagcacaatctccccgttccaaagccgtccaagatgcgcttgacgggaaaatcagaggattcagagggctgctcccttttctcggccctgcatttatagcagccattgcctatattgatcccggcaacttcgcaacgaatatttcggcgggttctaaatacggatatatgctcttatgggtgatcttattttccaatatcatggcgcttttaattcaatccctatccgccaaactcggtattgcgacaggcaaaaatctgcctgaggttgcccgtgaagaattcccgaagcctgtctcgatcggattatggattcagggcgagttggtcattatcgcaactgatctggcggaatttatcggagcggctctgggactgtatttgctgttcggcattccgatgcttgaagcgtctattattgcggcgatcggttctttcgcgatattggagcttcagcgccgtggttatcgctcacttgaagcaggtattgccggtatgctgtttgtggtcgtgatcgcctttgcgttgcagacctttttcgcaaagcctgatgccgtgtcagtgatgaagggcctttttgtcccggcgtttcatggcaccgacagtgtgcttcttgcagcgggtattcttggcgcaactgttatgccgcacgccatttatttacactctgcccttacacagcggcgggtggttggcaaaactgatgcagaacggaaaaaaatctttaggtttgaatttattgatattttaatagcgatgctgattgcaggggctattaatgcaagtatgctgattgtggctgccgcattattcttcaaaaacggcctgtttgttgaggatctcgacgtcgcatttcagcaattcggacatcttgtcagccctatgtctgcggctttgttcgggatcgggctgctcgttgccggtctatccagttcgtctgtcggcacactttcaggcgacgtgattatgcaaggatttatcaactaccgcattccgctgtatgtacggcgttttatcacgatcattccgccgatcttgatcatcgcgtcaggtgttaatccgacgaccgctctcgtactgagccaggtcgtgctgtccttcgggatcgcctttgccctcattccgcttattatgtttacaagcaataaacggatcatgggatctctgatcaacgccaaatggatcacagtggtgtcttggctgattgctgtattgatcgttgctttgaatgtgtttttaattgtagatacgtttcgataa

SEQ ID NO: 8914 - protein, 425 aa, Bacillus subtilis
MMNKDITAQSPRSKAVQDALDGKIRGFRGLLPFLGPAFIAAIAYIDPGNFATNISAGSKYGYMLLWVILFSNIMALLIQSLSAKLGIATGKNLPEVAREEFPKPVSIGLWIQGELVIIATDLAEFIGAALGLYLLFGIPMLEASIIAAIGSFAILELQRRGYRSLEAGIAGMLFVVVIAFALQTFFAKPDAVSVMKGLFVPAFHGTDSVLLAAGILGATVMPHAIYLHSALTQRRVVGKTDAERKKIFRFEFIDILIAMLIAGAINASMLIVAAALFFKNGLFVEDLDVAFQQFGHLVSPMSAALFGIGLLVAGLSSSSVGTLSGDVIMQGFINYRIPLYVRRFITIIPPILIIASGVNPTTALVLSQVVLSFGIAFALIPLIMFTSNKRIMGSLINAKWITVVSWLIAVLIVALNVFLIVDTFR

SEQ ID NO: 8915 - DNA, 1353 bp, Bradyrhizobium japonicum
  CDS (1)..(1353): transl_table=11
atggatgcccgatcgcccgatttaaccaccgacgccgccggctggcgcaccgacgtgccgaccacaaaaagcctggccgaggtgaatgcctccgtcgccctccccacggcgggggtgtggtggcggcggctgctcgccttcgtcggtccgggctatctcgtctcggtcggctacatggatcccggcaactgggcgaccgacctcgccggcggatcgaagttcggctacacgctgctctcggtcatcctgctctccaacctgatggcgatcctgctccagtcgctggcggcgcggctcggcatcgtcacggaccgcgacctcgcgcaggcctgccgcgcgacctattcgccggcggtgaacttcctgctctggctcgcctgcgaggcggcgatcatcgcctgcgatctcgccgaggtcatcggcacggcgatcgcgctcaagctcctgttcggcatccccctgatcggcggcgcgctgatcgccgcgctcgatgccttcctgctgctgctattgatgaaccgcggcttccgtttcctggaagccttcgtcatcgcgctgctcgcggtgatcgcggtttgcttcgcggtccagatcgtggccgcggcgccgccggtcgcggaggtcctgcatggcttcatgccgaagagcgagatcttcaccaatccggagatgctctacatcgcgatcggtatcatcggtgccaccgtgatgccgcataatctctatctgcactcctcgatcgtgcagacgcgcgcctatgagcgcaacgagacaggccggcgcgaggcgatcaaatgggcgacgacggactcgaccatcgccctgatgctggcgctgttcatcaacgccgcgatcctcgtggtcgccgcggcaaccttccacaagagcggccattccgacgtcgccgagatcggccaggctttcgagctcttgtcaccgctgctcggcctcggtatcgcctcgacgctgtttgccatcgcgctgctggcctcgggcctcaactcgacggtgaccgcgacgcttgcaggccagatcgtgatggagggttttctcgatctgcgcctgccaagctgggcgcgccgcctgctcacgcgcggcatcgcgatcattccggtgatcatcgtcacggcgatctacggcgagcgcggcacggccgatctcttggtgttcagtcaggtcgtgctgtcgatgcagctgcccttcgccgtcatcccgctggtccgcttcgtctccgatcgccgcaagatgggcaagttcgcgatttccccgtacgtcgctgcgatcgcgtggatcgtcgcgggcgtcatcgtggttttgaatctgaagctgctggcggatacgctgttggggtga

SEQ ID NO: 8916 - protein, 450 aa, Bradyrhizobium japonicum
MDARSPDLTTDAAGWRTDVPTTKSLAEVNASVALPTAGVWWRRLLAFVGPGYLVSVGYMDPGNWATDLAGGSKFGYTLLSVILLSNLMAILLQSLAARLGIVTDRDLAQACRATYSPAVNFLLWLACEAAIIACDLAEVIGTAIALKLLFGIPLIGGALIAALDAFLLLLLMNRGFRFLEAFVIALLAVIAVCFAVQIVAAAPPVAEVLHGFMPKSEIFTNPEMLYIAIGIIGATVMPHNLYLHSSIVQTRAYERNETGRREAIKWATTDSTIALMLALFINAAILVVAAATFHKSGHSDVAEIGQAFELLSPLLGLGIASTLFAIALLASGLNSTVTATLAGQIVMEGFLDLRLPSWARRLLTRGIAIIPVIIVTAIYGERGTADLLVFSQVVLSMQLPFAVIPLVRFVSDRRKMGKFAISPYVAAIAWIVAGVIVVLNLKLLADTLLG

SEQ ID NO: 8917 - DNA, 1371 bp, Brucella melitensis
  CDS (1)..(1371): transl_table=11
atggtaccccatggatcatgtccctccggcgctagagaggtaacatttgaaggctggcgtcgcgagcgtggagaagcctccatgtccgatgtccatcgtaccatccgggtcaaccgctctggttcaaaattccgccgcgcgctttcatttttcggcccgggctatcttgtagccgtcggttatatggatcccggcaactgggccacctctctagctggcggctcccgtttcggctatgcactgctctcggtcgtgcttctgtcgaacctcatggcggttttgctgcaagcactttgcacgcggcttgccgttgccacggggcgcgatcttgcgcaggcctgccgggacgcttatccgcgtttcctcgcatggccgctctggcttctggcagagcttgccatctgcgccaccgaccttgcggaagttatcggcaccgccatcggcctcaatcttctgttcggcattccgctggaaatcggcgttatcctcactgccgtcgatgtgcttctggttctctatttgcaaaacaagggattccggcgcgtagaggccctcatcattaccctgcttggcgtcattgcgctctgcttcctcacccagatcatcatggcccagccgcaatggggcgaggtcatcaagggttttgcgcccaccaccgagatcgtcagcaaccccgatatgctatatatcgcgctcggcatcatcggcgcgaccgttatgccgcataatctctatctgcattccggcattgtgcagacccgcgactatggccacacaaccgcggaaaagcgcgaggcaatccgctatgcgacgcttgattccaccatcgcgctgacctttgcgctcgtcatcaatgcgtcgatcctcatccttgccgcagcaagcttccacgcgaccggccatacgggtgtggaagatctggacaaggcccatgcccttttgaatccgcttctgggttcggccatcgccccggcactcttcgccattgccctgctctgctgcggcctgaattcgaccatcaccgccaccatggcggggcagatcgtgatggaaggcttcatcgatatccggttgaagccctggatacgccgcgccattacgcgcttcgtcgccatcgtgcccgccgcaattgtgacgatcctctatggttcgcagggaacgaccgaacttctgatcctctcgcaagtggtgctgagccttcagctcccctttgcagtcatcccgctggtgattttcacggcacagaagaagaagatgggatcgctggccgccgcaccatgggtgacgttcctcgcagccataacggcggcaatcatcgtggtgctgaacctgaagctcatctatgactttttcaccggcgcccctatttaa

SEQ ID NO: 8918 - protein, 456 aa, Brucella melitensis
MVPHGSCPSGAREVTFEGWRRERGEASMSDVHRTIRVNRSGSKFRRALSFFGPGYLVAVGYMDPGNWATSLAGGSRFGYALLSVVLLSNLMAVLLQALCTRLAVATGRDLAQACRDAYPRFLAWPLWLLAELAICATDLAEVIGTAIGLNLLFGIPLEIGVILTAVDVLLVLYLQNKGFRRVEALIITLLGVIALCFLTQIIMAQPQWGEVIKGFAPTTEIVSNPDMLYIALGIIGATVMPHNLYLHSGIVQTRDYGHTTAEKREAIRYATLDSTIALTFALVINASILILAAASFHATGHTGVEDLDKAHALLNPLLGSAIAPALFAIALLCCGLNSTITATMAGQIVMEGFIDIRLKPWIRRAITRFVAIVPAAIVTILYGSQGTTELLILSQVVLSLQLPFAVIPLVIFTAQKKKMGSLAAAPWVTFLAAITAAIIVVLNLKLIYDFFTGAPI

SEQ ID NO: 8919 - DNA, 1296 bp, Clostridium acetobutylicum
  CDS (1)..(1296): transl_table=11
atggataagttaagtatacgtgaagacaactacaatataaaacataaaacaatttcgttaaatagagcttcaagtgttacaagaaatttaaaaggattattaaagtttttaggaccagcttttgttgtcagtgtagcctacattgatcctggtaattttgctacaaacattagtggaggttccagcttcaattataatcttatatgggttattctttggagtaatttgatggctatatttcttcaaactatgtctgcaaaattaggaattgcaactggctgcagcttacctgaaatgtgtgctaaggttttttcaaaaagagcaaattggatattttggattgttggcgagttgggtgctatggcaacggatttggcagagtttattggaggaactttaggcttgtatttattatttagaataccaatgatttatgcaggactacttacaggagttttaacttttataatagtttacatggaaaagtatggtcaaaagatggtagaaaccataatagctgctttaatagctgtaatatgtgttgcctatacaatagagttatttcttgccaggccagcgtggacacaggtaggaatgcatactttaattccgagtttacctaatggagaagctgttctaatagcggttggtatgttgggggctacggttatgccgcatgtaatataccttcattccgaattggttcagcatagaaatacaaattcatctgataaagaaaagttgcatcacttaaagatggagaaaatcgatatacttatagcaatgaatattgcctttgttgtcaatgcggcaatggtaattgtatctgcagccgtattctttaagcatggaataaaagtaagtacaatagaagaagcacatagatcactacagcctttactcggaaatttatccagtggtgcctttggaatagcgcttttagcatcaggattatcttcatccgccgtaggaacgatggcagggcaaactattatgaaaggctttgttaatttaagcatacctataaatttaagaagaattataactatgcttccagcactaattatcatagctttaggtataaatccaatgagagtattagttttaagtcaagttgctttgagttttatacttccgtttcctataattcaaatgcttttaatagctgggcgtaaagatttaatgggaattttagttaataagaaatttactaaaattgtaggctttataattgcaaccatgataattttgctgaatataatacttttatatttaacctttacaggtcaaacttaa

SEQ ID NO: 8920 - protein, 431 aa, Clostridium acetobutylicum
MDKLSIREDNYNIKHKTISLNRASSVTRNLKGLLKFLGPAFVVSVAYIDPGNFATNISGGSSFNYNLIWVILWSNLMAIFLQTMSAKLGIATGCSLPEMCAKVFSKRANWIFWIVGELGAMATDLAEFIGGTLGLYLLFRIPMIYAGLLTGVLTFIIVYMEKYGQKMVETIIAALIAVICVAYTIELFLARPAWTQVGMHTLIPSLPNGEAVLIAVGMLGATVMPHVIYLHSELVQHRNTNSSDKEKLHHLKMEKIDILIAMNIAFVVNAAMVIVSAAVFFKHGIKVSTIEEAHRSLQPLLGNLSSGAFGIALLASGLSSSAVGTMAGQTIMKGFVNLSIPINLRRIITMLPALIIIALGINPMRVLVLSQVALSFILPFPIIQMLLIAGRKDLMGILVNKKFTKIVGFIIATMIILLNIILLYLTFTGQT

SEQ ID NO: 8921 - DNA, 1311 bp, Deinococcus radiodurans
  CDS (1)..(1311): transl_table=11
atggattcccgttctcccagcctgcccgacgaccgccccgacccgccagaacagcatctcgacgcgcgggccggggcgacgctgcgcgggacggcgggaccacgcggagtgcggcgcatcctgccgtttctcgggccggcggtcatcgcgtctatcgcctacatggaccccggcaactttgcgaccaacatcgagggcggtgcccgttacggctacagcctgctgtgggtgattctggccgccaacctgatggcgatggtgattcagaacctcagcgccaacctgggcatcgccagtgggcgcaacctgcccgaactgatccgtgagcgctggccccggcccctggtgtggttttactggattcaggccgaactcgtggcgatggcgaccgacctcgccgagtttctgggggccgccctcgccattcaactgctcaccggcctgccgatgttctggggcgcggtggtcacgggcgtcgtcaccttctggttgctgaacctgcaaaagcgcggcacccgtccgctggaactcgcggtgggcgccttcgtgctgatgatcggggtggcgtacctcgtgcaggtcgtgctggcgcggcccgacctcgcggcggtgggcgcgggcttcgtgccccgcttgcaggggccgggcagcgcttacctcgcggtgggcatcatcggggcgacggtcatgccacacgtcatctacctgcactcggcgctcacgcagggacgcatacagacggacaccactgaggaaaagcgccgcctcgtgcgcctgaaccgggtggacgtgatcgccgcgatggggctggcgggcctgatcaacatgagcatgctcgccgtcgctgccgccacctttcacggcaagaacgtggaaaacgcgggcgacctgaccaccgcctaccagacgctcacgccgctgctggggccggcggcgtcggtgctgttcgccgtcgccctgctcgcctcgggcctgagcagctcggcggtgggcaccatggccggcgacgtgatcatgcagggcttcatgggctttcacatcccgctgtggctgcgccgcctgatcaccatgctgcccgctttcatcgtcattctgctgggcatggacccgtcgtcggtgctgatcttgtcgcaggtcattctgtgtttcggggtgcccttcgcgctggtgccgctgctgctgttcacggcgcggcgggacgtgatgggcgcactcgtgacccggcgctccttcacagtgattggctgggtcatcgcggtcatcatcatcgcgctcaacggctacctgctgtgggagctgctggggggctga

SEQ ID NO: 8922 - protein, 436 aa, Deinococcus radiodurans
MDSRSPSLPDDRPDPPEQHLDARAGATLRGTAGPRGVRRILPFLGPAVIASIAYMDPGNFATNIEGGARYGYSLLWVILAANLMAMVIQNLSANLGIASGRNLPELIRERWPRPLVWFYWIQAELVAMATDLAEFLGAALAIQLLTGLPMFWGAVVTGVVTFWLLNLQKRGTRPLELAVGAFVLMIGVAYLVQVVLARPDLAAVGAGFVPRLQGPGSAYLAVGIIGATVMPHVIYLHSALTQGRIQTDTTEEKRRLVRLNRVDVIAAMGLAGLINMSMLAVAAATFHGKNVENAGDLTTAYQTLTPLLGPAASVLFAVALLASGLSSSAVGTMAGDVIMQGFMGFHIPLWLRRLITMLPAFIVILLGMDPSSVLILSQVILCFGVPFALVPLLLFTARRDVMGALVTRRSFTVIGWVIAVIIIALNGYLLWELLGG

SEQ ID NO: 8923 - DNA, 1667 bp, Lactobacillus brevis
  CDS (151)..(1545): transl_table=11
attcatctggtttaagtatacactcaatctttctcatttgttaactaatgattaaaatagattttggttgacataaactcattgatgtgtataataggttgtgggaattgattgagtgctcactcaaacaactgacctgaattcaactcaatgaaagagggtattgatatgcgtgagagcgtagcagaagaacctaagcataaattttttcaaagtacagaaggtgaaaacaagagtctggatgaagttaacggcagcgttaaagttccgaagaatgccggcttctggcgaacattatttgcctacaccggtccgggaattctaattgcagtggggtacatggatcctggtaattggattacgtcaattgctggtggtgcccagttcaagtacagcttattgtcggttatcttaatctccagcctaattgcaatgctgttgcaatcaatggctgctcggctgggaattgtcaccggtaaggatttagctcagctgacccgggaaagaaccagtaagacaatgggaatcattctttggttaattaccgaatcagcaattatggccacggacgttgcggaaattattggttccggaattgctatcaaattactatttaacattccgttagtcgttggcattttgatcaccactgctgatgttttgatcctgttgcttctgatgaaattgggattcaggaagattgaagcaattgttgcgacactggttgccgttattctgttggtcttcacctacgaagtattcttagcgggaccgcaacttgaccaaatgtttgccggttacatgccgaccaaagacattgtcactaataaatcaatgttgtatttggcacttggtatcgttggtgcaacggtgatgccccatgatttatatctgggttcgtctatctcacaaacccgggcagtcgatcgacatgatcgtcaggatgtggctaaagccattaaattcacgacgattgattccaatttgcaactgacaattgcattcattgtcaactctttgctgttaattttaggggctgcgttgttcttcggaaccaatagcacggtcgggcgattcgttgatttgtttaattcattgaacaactcgcacattgtgggggcaattgccagtccaatgttgagcatgctgttcgcggtggctctactttcctcaggtcaaagttccacgattaccgggacgctgtcaggccagatcattatggaaggattcattcatcttcgaatgccattatgggcgcaacggttacttactcgattattgtcagtaacgccagtgttgatttttgccatctattatcatggcaacgaagctaagattgaaaatctgctgactctgtcacaagttttcctgagtgtcgctttaccatttgcgattgtgccattggttaaattcaccagtagcaaggaattaatgggtgagtttgtgaataaagcctgggttaagtacagtgcttgggtagcaacagttgtactggtgagtttaaacatttacctcatcttacaaactgttggcgtgattggttaaaagaaagttgattaacatcagcgataaatcaattgggttgatggctaatgttagtagcctttcgtttaaaagattgatccttattttgggtcaatctttttttaaatgaaaattacattttt

SEQ ID NO: 8924 - protein, 464 aa, Lactobacillus brevis
MKEGIDMRESVAEEPKHKFFQSTEGENKSLDEVNGSVKVPKNAGFWRTLFAYTGPGILIAVGYMDPGNWITSIAGGAQFKYSLLSVILISSLIAMLLQSMAARLGIVTGKDLAQLTRERTSKTMGIILWLITESAIMATDVAEIIGSGIAIKLLFNIPLVVGILITTADVLILLLLMKLGFRKIEAIVATLVAVILLVFTYEVFLAGPQLDQMFAGYMPTKDIVTNKSMLYLALGIVGATVMPHDLYLGSSISQTRAVDRHDRQDVAKAIKFTTIDSNLQLTIAFIVNSLLLILGAALFFGTNSTVGRFVDLFNSLNNSHIVGAIASPMLSMLFAVALLSSGQSSTITGTLSGQIIMEGFIHLRMPLWAQRLLTRLLSVTPVLIFAIYYHGNEAKIENLLTLSQVFLSVALPFAIVPLVKFTSSKELMGEFVNKAWVKYSAWVATVVLVSLNIYLILQTVGVIG

SEQ ID NO: 8925 - DNA, 1620 bp, Lactobacillus plantarum
  CDS (148)..(1542): transl_table=11
ataattaataatagttgactaataggttaatggtgctatactaccaattggaattaaagtgagtgctcaattaaggggacgcactgttgaggatcacgtagtagtccacaacctgaattctaaaccaatagaagagagggtttcataatgaaatcagcaaaaacgaaggatcacgctaagatgaaagctgccgaagaaaaggcgattcattcaacgggtgccgatagtaagagcttggacgaagtcaatgggagtgtccgggtccctaaggatgccagcttctggcgaactttaattgcctacactggaccgggtgcactagttgcagttgggtacatggatcctgggaactggatcacatcaatcgcaggtggatcacagtacaaatatgcattactttctgtgatcctgttatcaagtttaattgccatgttgctacaagccatggccgctcgtctgggaattgtgacgggtaaagatttagcacaattgacgcgggaacgaacgtcaaaaggaatggggatttttctctggattattactgaactagcgattatggcgaccgatgttgctgaaatcattggttctgggattgctttgaagttattattcggatttccattaattgtcggtattttgattaccactgccgatgtcttgattctgttattattaatgaaacttggtttccggaaaatcgaagcaattgtggcaacgctggttgccgtgattctcttcgtcttcctgtatgaagttattatttcacaacctaatattccagaaatgttaaaagggtatgtcccaactagtcggattgtcagcaaccgttctatgctatttctagcactcggaattgttggggcaaccgttatgccgcataacttgtacttgggatcatcaatctcacaaacacgtcaagttgaccggagtgacgaaaaagaagttgccaaggctgttaagttcacgacaatcgactccaatattcaattgtcagtcgcgttcgttgttaatagtttgctattaattcttggcgccgcactgttctttggaactaagggggatcttggccggttcgttgacttgtacaatgcacttggcgatagtaaggtcgttggctcgattgcgagtccgttactcagtatgctctttgccattgcgctgttgtcttctggtcaaagttctacgattacggggacgttatctggtcagattatcatggaagggtttatccgtttgaagatgccactctgggcacaacggttactaactcggttaatctcggttacaccagtgttggcttttgcgatttattatcatggcaatgaagcgaaaattgaagatctgctgacgatgtcgcaagtcttcctgagtatcgcgttaccatttgccatgattccgctagtcatgttcacgagtaatcgggcgctgatggggaacttcaccaaccgtgtctgggtcaagtggacggcttggatcgtgacggtgattctaatcatcttaaacatttaccttattttacagactgtcggtctggttaaataatcaaacattaaaatgagctttccagggattgcaaagaattcctggaaagctcattttgtgttttgggaatagcggcaa

SEQ ID NO: 8926 - protein, 464 aa, Lactobacillus plantarum
MKSAKTKDHAKMKAAEEKAIHSTGADSKSLDEVNGSVRVPKDASFWRTLIAYTGPGALVAVGYMDPGNWITSIAGGSQYKYALLSVILLSSLIAMLLQAMAARLGIVTGKDLAQLTRERTSKGMGIFLWIITELAIMATDVAEIIGSGIALKLLFGFPLIVGILITTADVLILLLLMKLGFRKIEAIVATLVAVILFVFLYEVIISQPNIPEMLKGYVPTSRIVSNRSMLFLALGIVGATVMPHNLYLGSSISQTRQVDRSDEKEVAKAVKFTTIDSNIQLSVAFVVNSLLLILGAALFFGTKGDLGRFVDLYNALGDSKVVGSIASPLLSMLFAIALLSSGQSSTITGTLSGQIIMEGFIRLKMPLWAQRLLTRLISVTPVLAFAIYYHGNEAKIEDLLTMSQVFLSIALPFAMIPLVMFTSNRALMGNFTNRVWVKWTAWIVTVILIILNIYLILQTVGLVK

SEQ ID NO: 8927 - DNA, 1347 bp, Listeria innocua
  CDS (1)..(1347): transl_table=11
atgaaaaaggaaaaaacagaacgcacaaaacaaagctggagaaaagcacagaatgctcccagcttaagcgaagtaaataattcagtagcaattccaaaaaacgcaaagttcttccggaaattatttgcatttatgggaccaggtgctcttattgcagttggctatgttgatcctggaaactgggcgacatccattgccgggggttcggagtttggttacaccttattatctgttattttaatttctaatattttagccgttttactacaatcacttgcatcaaaattaggtatcgtgactgggcgcgatttagctcaagcatcaagcgatcatttttccaaaccgtttggctttgtcctatggattttagctgaattagccattattgcaactgatattgctgaagttatcggtagtgcgattgcacttaatttactctttggcattcctttgatttggggcgtttgtataacagcattagatatttttcttgtattatttttacaacataaaggtttccgctatatagaagttattgttattaccttaatggtgacgattcttgtatgttttggagctgaaatggtcatgtcacacccagatatgcaagctattgcgaaaggttttatcccgcaatcagaaatcgttacgaacccggcaatgctttatatcgcactcgggattcttggtgcaacagttatgccgcataatttatatttacactcatcgatcgtgcaaacaagacaatacgcgcgaacaaaagaagggaagagagaagcgattcgtttttcatttatcgattcaacgttctctttaactattgcgttattaattaatgcatctattttaattttagctgctgctgccttttatactactggacaacataacgtagctggaattgaagatgcctataaattacttaacccaacacttggaagtagcatcgccagtacggtgtttgcggtagctttacttgcttctggtcaaaattcgacattaacaggcacattagctggtcaaatcgttatggaaggtttcttaaatatccgtctaaaaccagtagtacgccgcttattaacccgtgtactagcaattgttccagcagttattattacagcactttatggagcaaatggaataaatgagttgcttattttcagccaagtaatactctccatgcaactatctttcgctgttattcccttagttatgttcacaagtgataaacagaagatgggcgaattcgttaactcaccatggttaaaaatagtgtcttggtctgttgcaatttttatcgcattcttaaatatctacttattattttacactttaacttcattataa

SEQ ID NO: 8928 - protein, 448 aa, Listeria innocua
MKKEKTERTKQSWRKAQNAPSLSEVNNSVAIPKNAKFFRKLFAFMGPGALIAVGYVDPGNWATSIAGGSEFGYTLLSVILISNILAVLLQSLASKLGIVTGRDLAQASSDHFSKPFGFVLWILAELAIIATDIAEVIGSAIALNLLFGIPLIWGVCITALDIFLVLFLQHKGFRYIEVIVITLMVTILVCFGAEMVMSHPDMQAIAKGFIPQSEIVTNPAMLYIALGILGATVMPHNLYLHSSIVQTRQYARTKEGKREAIRFSFIDSTFSLTIALLINASILILAAAAFYTTGQHNVAGIEDAYKLLNPTLGSSIASTVFAVALLASGQNSTLTGTLAGQIVMEGFLNIRLKPVVRRLLTRVLAIVPAVIITALYGANGINELLIFSQVILSMQLSFAVIPLVMFTSDKQKMGEFVNSPWLKIVSWSVAIFIAFLNIYLLFYTLTSL

SEQ ID NO: 8929 - DNA, 1329 bp, Ralstonia solanacearum
  CDS (1)..(1329): transl_table=11
atgttccgcctgcctgccctgccccgcatccccaccgcgccgttctgcccatccgaggtgcgcggctgcgtcgccatcccgcccgacctgccgctgtggaaaaagctgctgcgctttgccgggcccggactgctggtgtcggtcggctacatggacccgggcaactgggcgaccgacatcgaggccggctcccgctacggctattcgctgctgttcgtggtgctgctgtccagcctggcggcgatggtgctgcagtgcctgtcggcgcggctgggcatcgtcacgggcaaggacctcgcgcggctgtcgcgcgagcgctaccggcccggcgcggtgcgcgtgcagtggctgctggcggagctgtccatcgtggcctgcgacctggccgaggtgctgggctgcgcgctggccttccacctgctgctgggcgtgccgatcctgggcggcgtggcgctgacggcgctggacacgctgatcgtgctgggcctcaagggcaagaatttccgccagctcgaggccatcgtgctcggactgatcctgaccatcgggctgtgctacttcgtcgagctggcgctgatccggccgcactggccctccgtggccggcgctctggtgccgtcgtggcaggcgctgagcgcgcgggagccgctctacctggccatcggcatcctgggggcaacggtgatgccgcacaacctgtatctgcactcgtcgatcgtgcagacgcgcgtggtctcggagacggagccggcgcggcgcgaggcggtcggcctgtcgcggctcgataccatcgtctcgctgtcgctggcgctgctggtcaacggagccatcctggtgctggcggcggcggccttccacgccaacggccaccaggacgtggccgacatccaggacgcgcatcggctgctggagcccatcgtcggcacggcggtggcgggcgtgctgttcggcatcgcgctgctggcggccgggcagagctccaccttcaccggcaccatcgcgggccagatcctgatggaggggttcctcgagctgcgcatcccctgctggcagcggcggctcgccacgcgggcgctggcgctgattcccgccttcgtcggcgtggcgatgctgggcgaccatgccatcggcaggctgctggtgatcagccaagtagtgctgggcttccagctgccgttcgcgatgtttccgctgatccgcatgacgggcgaccgcgcgctgatgggcacgttcgccaacggccggctgacatcggcggtggcgtggtgcctgttcgcggtcatcagcgtggcgaacctgtggctggtgtggcaggtgctggcaggctga

SEQ ID NO: 8930 - protein, 442 aa, Ralstonia solanacearum
MFRLPALPRIPTAPFCPSEVRGCVAIPPDLPLWKKLLRFAGPGLLVSVGYMDPGNWATDIEAGSRYGYSLLFVVLLSSLAAMVLQCLSARLGIVTGKDLARLSRERYRPGAVRVQWLLAELSIVACDLAEVLGCALAFHLLLGVPILGGVALTALDTLIVLGLKGKNFRQLEAIVLGLILTIGLCYFVELALIRPHWPSVAGALVPSWQALSAREPLYLAIGILGATVMPHNLYLHSSIVQTRVVSETEPARREAVGLSRLDTIVSLSLALLVNGAILVLAAAAFHANGHQDVADIQDAHRLLEPIVGTAVAGVLFGIALLAAGQSSTFTGTIAGQILMEGFLELRIPCWQRRLATRALALIPAFVGVAMLGDHAIGRLLVISQVVLGFQLPFAMFPLIRMTGDRALMGTFANGRLTSAVAWCLFAVISVANLWLVWQVLAG

SEQ ID NO: 8931 - DNA, 1365 bp, Rhizobium loti
  CDS (1)..(1365): transl_table=11
atgtcagacgcagaagccacagcccctcgatcctcatggcggttcgccggacgggacgaggacgaccagcccagcctgcgcgaagtcaattccaccatcgcggtgccgagctcgggcgtctggttccgccggctgttcgccttcatggggccgggctatatggtttcggtcggctatatggatccgggcaactgggcgaccgacctcgccggcggcgcccagttcggctacacgctgctgttcgtcatcatgctgtccaacctgatggcgatcctgttgcaggcgctggccgcgcggcttggcatcgccaccggccgcgatctcgctcaggcctgccgcgcctattatccccgcccggtcaatttcgtgctgtggatcgcctgcgaactcgccatcatcgcctgtgacctcgccgaagtcatcggcaccgcgatcgcattgaagcttctgttcggcattccgctgatcggcggcgcgatcctcaccgcgctcgacgccttcctcgtgctgctgctgatgaacaaggggttccgctatctcgaagccttcgtcatcgcgcttttgatcatcatcttcagctgctttgccatccagatcttcgtcgccgctccaccggccggcacgatcctgcattcgatgttcgtgccgtcctcggagatcgtcaccaatccggcgatgctctacatcgccatcggcatcatcggcgccacggtcatgccgcacaatctctatctgcactcctcgatcgtgcagacccgtgcctatgagcgcaccgaaaagggcaagcgcgacgccatcaaatgggcgacgacggactccaccatcgccctgatgctggctctgttcgtcaacgccgccatcctgatcgtctcggccgtcgccttccacaacaccggccaccaggatgtcgccgagatcgaccaggctttcgagctgctgtcaccgctgctcggcctcggcatcgcctcgatcctgttcgccgtggcgctgctcgcctccggcctgaattcgacggtgacggcgacgcttgccggccagatcatcatggaaggctttctgcgcctgcgcatccccaactgggcgcgccggcttctgacgcgcggcctcgccatcgttcccgtggtggtcgtcaccgcgctctatggcgagaaaggcaccggccagctgctggtgttcagccaggtgatcctgtcgatgcaactgcccttcgcggtggtgccgctggtgcagttcgtttccgacaagaagaagatgggcaacctcgccattccgcgcggcgtcgcagccctcgcctgggtggttgccgccatcatcctcgtgctcaatttcaagctgctctacgacaccctgttcggggttggctga

SEQ ID NO: 8932 - protein, 454 aa, Rhizobium loti
MSDAEATAPRSSWRFAGRDEDDQPSLREVNSTIAVPSSGVWFRRLFAFMGPGYMVSVGYMDPGNWATDLAGGAQFGYTLLFVIMLSNLMAILLQALAARLGIATGRDLAQACRAYYPRPVNFVLWIACELAIIACDLAEVIGTAIALKLLFGIPLIGGAILTALDAFLVLLLMNKGFRYLEAFVIALLIIIFSCFAIQIFVAAPPAGTILHSMFVPSSEIVTNPAMLYIAIGIIGATVMPHNLYLHSSIVQTRAYERTEKGKRDAIKWATTDSTIALMLALFVNAAILIVSAVAFHNTGHQDVAEIDQAFELLSPLLGLGIASILFAVALLASGLNSTVTATLAGQIIMEGFLRLRIPNWARRLLTRGLAIVPVVVVTALYGEKGTGQLLVFSQVILSMQLPFAVVPLVQFVSDKKKMGNLAIPRGVAALAWVVAAIILVLNFKLLYDTLFGVG

SEQ ID NO: 8933 - DNA, 2154 bp, Salmonella typhimurium
  CDS (451)..(1692): transl_table=11
taactgaatgacgtaacgaatgcgaatttttttacggtcgctgctaaccagcagtgcgagtaccgcaacaacggcaagcgccaggacaaaatgaaggacgcggtccatatttgctccaaatatgaggcaggtttaattttcgtgcacattctatgcaacagccgtaaagaaaacgagatccaacacacactataataaggacctgtgacgagattcaaaattagtgatctgtaatacacttttactgtactgaatatgaaaatgaaaagttatatcagtgtgctaatcttgtaatgttaagccaaactgttctgatacaggtcgtcatcgtatcggtctatcgtttcacactatcaaagtaatcacccgtacccattgaaatgcacttgataatcattatcaataaacatagcatgaaacatagcaaaggctatgtttttgaggcaaaagatgactgacaatcgcgtagagaatagcagcggacgggcggcgcgcaagctaaggctcgcattaatgggacctgcgttcattgccgcgattggttatatcgatcctggtaacttcgcgaccaatattcaggccggcgccagctttggctatcagctactctgggtggtggtctgggcgaacctgatggcgatgctgattcaaatcctctcggcaaaactcgggatcgccaccggcaagaacctggcggagcaaattcgcgaccattatccgcgtccggtagtctggttttactgggtacaggcggaaatcatcgcgatggccaccgatttagctgaatttatcggcgcggcaataggttttaagctgatcctgggcgtctctttattacagggcgcggtattgaccggtatcgcgacgtttctgattttaatgttacagcgccgcggtcaaaaaccgcttgaaaaagtcatcggcggtttactgctttttgtcgccgccgcttacattgtggagctgtttttctctcagcctgatatggcgcagctcggcaaaggaatggttatcccggcgctaccgaacccggaagccgtattcttagccgccggcgtgcttggcgcgacgattatgccgcacgtgatttatctgcactcgtcattaacgcagcatctgcacggcggaacacggcaacaacggtactcagcaacgaaatgggatgtcgctattgctatgacgattgccggttttgtcaatctggcaatgatggcgaccgccgcggcggcgtttcattttagcggccacaccggcatcgccgacctcgatcaggcatacctgacgctggaaccgttactaagccatgcggcggcaacggtgtttggtcttagtctggtagctgcagggctttcctccactgtggtagggactctggcggggcaggtggtgatgcaagggtttgtccgttttcacattccgctgtgggtacggcgcaccattaccatgctgccctcatttattgtgattttgatggggctggaccctacccgaattctggtgatgagccaggtgctgctgagttttggtattgcgctggcgctggtgccgctcctgattttcaccagtaacgctacgctaatgggcgagctggtgaacacgcggcgggtaaaacaggttggctggataattgtcgtgctggtcgtcgccctgaatatctggttgctggttggaacggtgatggggttgtcataaagacagaaagatagcaggcccgatgcgtgggcgtcatcgggctgttattcagcaggaggcttagtgatgatgtttgtgaccccggcctcgcccgcgatgatcgtcgcgatcgcgccagccttcccgataaccgcgttcatacgctttacgcttatcccagccgcgatgatagccgttgtcatggcgccaccagcgatttttacgccattcataatggttgtgccagtaatcccggtcgcgccagcgaccaccgtcccagtagttaccgtaatcatcgcgatcgccaatctgtaattttattgagggcaacagggtgatttcgcccgcattcgcggcaagcggtgtaaaagccagcaaggctgccgccagaatcagtgacctgaacatactttctctccttcacgatcgagccgtcgccggcctgttaatgcaatattacaaagcagtaaagatttgtttcat

SEQ ID NO: 8934 - protein, 413 aa, Salmonella typhimurium
MTDNRVENSSGRAARKLRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELFFSQPDMAQLGKGMVIPALPNPEAVFLAAGVLGATIMPHVIYLHSSLTQHLHGGTRQQRYSATKWDVAIAMTIAGFVNLAMMATAAAAFHFSGHTGIADLDQAYLTLEPLLSHAAATVFGLSLVAAGLSSTVVGTLAGQVVMQGFVRFHIPLWVRRTITMLPSFIVILMGLDPTRILVMSQVLLSFGIALALVPLLIFTSNATLMGELVNTRRVKQVGWIIVVLVVALNIWLLVGTVMGLS

SEQ ID NO: 8935 - DNA, 1353 bp, Staphylococcus aureus
  CDS (1)..(1353): transl_table=11
atgaataataaacgacattcaacaaatgaacaattaagtttagacgaaataaacaatacaattaaattcgatcatcgcagttcaaataaacagaaatttttatcatttcttggacctgggttattagtcgctgttggttacatggatcccggaaactggataacatcaatgcaaggtggcgcccaatatggctatactttgctattcgtaattcttatttcaagtttatcagcaatgttacttcaaagcatgacagtgagattaggaatagcaacaggtatggacttagctcaaatgacacgacattatttatcaagacctattgctataatcttttggatcattgcagaactagcaattatcgctacagatattgctgaggttattggtagtgctattgctcttaatctcctatttaacatacctttaatcgtcggtgcactaataactgtacttgatgtatttttactactatttataatgaaatatggttttagaaaaattgaagctattgttggtacatttattttcacagtgttattcatctttatatttgaagtctatatttcatcaccacagttgaatgctgtgttaaatggatttataccacatagtgaaatcattacaaataacggcattctctatattgcattaggtattattggcgctacaattatgcctcataatttgtacttacattcatcaattgtacaatctagaacatactcaagacataacaatgaagaaaaggcgcaagcgattaaatttgctacgatagattcgaacattcagttatcaatcgcatttgtagtcaattgcttattattagtgttaggagcatcactatttttcaactcgaacgctgacgatttaggtggtttctatgatttatatcacgccttaaaaactgaacctgtactaggtgcaacaatgggtgcaatcatgagtacattatttgcagttgcattattagcgtcaggtcaaaattcaacgattactggtactttagcaggacaaattgtaatggaaggatttttaagattacacataccaaattggttaagacgtttaattacacgttcccttgctgtcattcctgttatcgtatgcttaatcatttttaaaggtaatgcagctaaaattgagcaactacttgtattctctcaagtatttttaagtattgctctgccattctgtttaataccattacaattagctactagtaataaagacttgatgggacctttctataataaaacatgggttaatatcatttcatggacacttattattattctaagtattttaaatgtctatttaatcgttcaaacattccaagaactacaaagttaa

SEQ ID NO: 8936 - protein, 450 aa, Staphylococcus aureus
MNNKRHSTNEQLSLDEINNTIKFDHRSSNKQKFLSFLGPGLLVAVGYMDPGNWITSMQGGAQYGYTLLFVILISSLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTFIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQS

SEQ ID NO: 8937 - DNA, 1353 bp, Staphylococcus aureus
  CDS (1)..(1353): transl_table=11
atgaataataaacgacattcaacaaatgaacaattaagtttagacgaaataaacaatacaattaaattcgatcatcgcagttcaaataaacagaaatttttatcatttcttgggcctgggttattagtcgctggtggttacatggattccggaaactggataacatcaatgcaaggtggcgcgcaatatggctatactttgctattcggaaatcttatttcaaggttatcagcaatgttacttcaaagcatgacagtgagattaggaatagcaacaggtatggacttagctcaaatgacacgacattatttatcaagacctattgctataatcttttggattattgcagaactagcaattatcgccacagatattgctgaggttattggtagtgctattgctctcaatctcctatttaacatacctttaattgtcggtgcactaattactgtacttgatgtatttttactactatttataatgaaatatggttttagaaaaattgaagctattgttggtacattaattttcacagtgttattcatctttatatttgaagtctatatttcatcaccacagttgaacgctgtgttaaatggatttattccacatagtgaaatcattacaaataacggcattctctatattgcattaggtattattggagcaacaattatgcctcataatttgtacttacattcatcaattgtacaatctagaacatactcaagacataacaatgaagaaaaggcgcaagcgattaaatttgctacgatagattcgaacattcagttatcaatcgcatttgtagtcaattgcttattattagtgttaggagcatcactatttttcaactcaaacgctgacgatttaggtggtttctatgatttatatcacgccttaaaaactgaacctgtactaggtgcaacaatgggtgcaatcatgagtacattatttgcagttgcattattagcgtcaggtcaaaattcaacgattactggtactttagcaggacaaattgtaatggaaggatttttaagattacacataccaaattggttaagacgtttaattacacgttcccttgctgtcattcctgttatcgtatgtttaatcatttttaaaggtaatgcagctaaaattgagcaactacttgtattctctcaagtatttttaagtattgctctgccattctgtttaataccattacaattagctactagtaataaagacttgatgggacctttctataataaaacatgggttaatatcatttcatggacacttattattattctaagtattttaaatgtctatttaatcgttcaaacattccaagaactacaaggttaa

SEQ ID NO: 8938 - protein, 450 aa, Staphylococcus aureus
MNNKRHSTNEQLSLDEINNTIKFDHRSSNKQKFLSFLGPGLLVAGGYMDSGNWITSMQGGAQYGYTLLFGNLISRLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTLIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQG

SEQ ID NO: 8939 - DNA, 1362 bp, Staphylococcus epidermidis
  CDS (1)..(1362): transl_table=11
atgggggtgattttattgaattccaataataacaatcatgaacaacaacgaagtttagatgaaatcaataacaccataaacttcaatcataatgatagtgcaagtcaaaaatttctggcttttttaggaccgggattgcttgttgcagttggttacatggatcctggaaattggattacatccatgcaaggaggagcacaatatggctataccttgttattcataatcttaatctctagcttatctgctatgctgttacaaagtatgactgtgagattaggaatagcaactggtatggatttagcacaaatgacacgtcattttttaaataagcctgtagcaattatgttctggattattgcagaattagcaattatcgctactgatattgcagaagttataggtagcgctatcgcattagatttaatcttcggcataccattaattgtaggcgcattaatcactgtatttgatgtatttttattattattcatcatgaaatttggctttagaaagattgaagctatcgtgggaacgttaatctttaccgtattggccatttttgtatttgaagtttatatttcttctccacaaataacagatatgcttaatggttttgtgcctcataaagaaattattacaaaccaagggatactttatattgcactaggtatcataggtgctactattatgccacataacttatatttacattcttctattgtacaatctcgaaaatatgatagacacagtattcatgaaaaagcacaagcgattaagtatgctactatcgactctaatatacagctatccatcgcttttgtagtcaattgcttattacttacacttggtgcagcgctattttttggaactaaaactgaagatttgggtggtttttatgatctttatttggctctaaaaacagaacctgctttaggtgcaacgcttggcggtattatgagtactttatttgctgttgcccttttagcttctggtcaaaattcaactataacgggaacgttagcaggccaaattgtgatggaaggatttcttaaattatccattccaaattggttacgtcgtcttatcactcggtctttagcagtgatacctgttatcatttgtcttatagtatttaaaggaaatactgaaaaaattgaacaattacttgtcttttctcaagtgttcttgagtattgctttgccattttcgttaataccgcttcaattagctacaagtaatcaaaatcttatgggtccttttaagaataaaacatggattaacatcatttcttggttactcataattgtcttaagtggacttaacgtatatcttatcattcaaacattccaagaattatga

SEQ ID NO: 8940 - protein, 453 aa, Staphylococcus epidermidis
MGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPQITDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 8941 - DNA, 1362 bp, Staphylococcus epidermidis
  CDS (1)..(1362): transl_table=11
atgggggtgattttattgaattccaataataacaatcatgaacaacaacgaagtttagatgaaatcaataacaccataaacttcaatcataatgatagtgcaagtcaaaaatttctggcttttttaggaccgggattgcttgttgcagttggttacatggatcctggaaattggattacatccatgcaaggaggagcacaatatggctataccttgttattcataatcttaatctctagcttatctgctatgctgttacaaagtatgactgtgagattaggaatagcaactggtatggatttagcacaaatgacacgtcattttttaaataagcctgtagcaattatgttctggattattgcagaattagcaattatcgctactgatattgcagaagttataggcagcgctatcgcattagatttaatcttcggcataccattaattgtaggcgcattaatcactgtatttgatgtatttttattattattcatcatgaaatttggctttagaaagattgaagctatcgtgggaacattaatctttaccgtattggccatttttgtatttgaagtttatatttcttctccacatataatagatatgcttaatggttttgtgcctcataaagaaattattacaaaccaagggatactttatattgcactaggcatcataggtgctactattatgccacataacttatatttacattcttctattgtacaatctcgaaaatatgatagacacagtattcatgaaaaagcacaagcgattaagtatgctaccatagactctaatatacagctatccatcgcttttgtagtcaattgcttattacttacacttggtgcagcactattttttggaactaaaactgaagatttgggtggtttttatgatctttatttggctctaaaaacagaacctgctttaggtgcaacgcttggcggtattatgagtactttatttgctgttgcccttttagcttctggtcaaaattcaactataacaggaacgttagcaggccaaattgtgatggaaggatttcttaaattatccattccaaactggttacgtcgtcttatcactcggtctttagcagtgatacctgttatcatttgtcttatagtatttaaaggaaatactgaaaaaattgaacaattacttgtcttttctcaagtgttcttgagtattgctttgccattttcgttaataccgcttcaattagctacaagtaatcaaaatcttatgggtccttttaagaataagacatggattaacatcatttcttggttactcataattgtcttaagtggacttaacgtatatcttatcattcaaacattccaagaattatga

SEQ ID NO: 8942 - protein, 453 aa, Staphylococcus epidermidis
MGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPHIIDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 8943 - DNA, 1230 bp, Yersinia pestis
  CDS (1)..(1230): transl_table=11
atgcttaatggccgtgctgtcgatacatctcgtcgcccattaaggaagattaaactctccttgatggggcctgcttttattgctgccattgcttatattgatcccggcaatttcgcaactaatattcaggcgggggccacgtttggctataccttgctatgggttgtcgtgtgggccaacgtcatggcgatgttagtccagttgctgtccgccaagctgggtatcgctaccggtaaaaatttggctgagcatatccgggaccgtttccctcgtccagtggtatgggcctactgggtgcaagccgaaattatcgtgatggcgaccgatttggctgagtttatcggggcggctattggctttaaattgctgtttggtgtgacgctactgcaaggggcggtgctgaccggtattgccacctttcttattcttatgttgcaaaatagggggcaaaagcctctcgaattggtgattggtgggctgctattgtttgtcgccgcggcttatattgttgaactgatcttctctcagccagatattgcggctcttggccgtgggatgctgatcccaaatttacctgatggtaacgccgtatttttagctgcgggggtgttgggggcgactattatgccgcatgtgatttacctgcattcagcattaacacaaaccgggggggaagagtctaaaactgagcgctatgcctcgaccaagtttgatgtagcgattgccatgacgattgcgggctttgttaatttggcgatgatggcaaccgccgctgcggcttttcatttcaatggttatgagaacattgctgaaatcgaagaggcttatataaccttgcagccgctgttgggtaatgctgcggccactgtttttggtttgagcttaatcgccgccgggctttcatcaacggtcgtgggtacgctggcggggcaagtggtcatgcagggttttgtgcggttttatattccaatgtgggtgcgccgtatagtcactatgttgccttcttttattgttattttagctgggatggatgcgacacagatattggtgatgagtcaggttttactgagttttggtattgcactggcactggtgccattattggttttcaccggtaataaagagttgatgggggagctggttgatacaaaaaccacccagattttaggtaaattggtggttctgatcgtggttgggttaaatgcctatttactgattagcctgctttag

SEQ ID NO: 8944 - protein, 409 aa, Yersinia pestis
MLNGRAVDTSRRPLRKIKLSLMGPAFIAAIAYIDPGNFATNIQAGATFGYTLLWVVVWANVMAMLVQLLSAKLGIATGKNLAEHIRDRFPRPVVWAYWVQAEIIVMATDLAEFIGAAIGFKLLFGVTLLQGAVLTGIATFLILMLQNRGQKPLELVIGGLLLFVAAAYIVELIFSQPDIAALGRGMLIPNLPDGNAVFLAAGVLGATIMPHVIYLHSALTQTGGEESKTERYASTKFDVAIAMTIAGFVNLAMMATAAAAFHFNGYENIAEIEEAYITLQPLLGNAAATVFGLSLIAAGLSSTVVGTLAGQVVMQGFVRFYIPMWVRRIVTMLPSFIVILAGMDATQILVMSQVLLSFGIALALVPLLVFTGNKELMGELVDTKTTQILGKLVVLIVVGLNAYLLISLL

SEQ ID NO: 8945 - DNA, 1599 bp, Arabidopsis thaliana
  CDS (1)..(1599)
atggcggctacaggatctggacggtctcaattcatttccagttccggcggtaaccgaagcttctccaattctccactcatcgagaactctgattctaatcagattattgtctctgagaagaagagctggaagaatttctttgcttacttaggccctggttttcttgtttcaatcgcatatattgatcctggaaactttgagactgatctgcaagctggagcacactacaagtatgaattactttggatcatattggtggcctcatgtgcggctttggtgattcaatctctggctgctaatcttggtgttgtcacaggaaaacatttggctgagcaatgtagagccgagtactccaaagttccaaactttatgttatgggtcgttgctgaaattgcagtagttgcttgtgacataccggaagttatcggaacagcttttgctctgaacatgctctttagcataccggtgtggatcggtgttcttctgacaggcttaagtacgctgattcttctcgcacttcaaaaatacggggtgagaaagctggagttcttgatagcgtttcttgtgttcacaattgcaatatgcttctttgttgagcttcattactcaaagccagacccaggagaagtcctacatggtctctttgttcctcaacttaaaggaaatggtgcaactggtctcgcaatctctttgctcggagccatggttatgccgcataatctcttcctccactcggccttggttctctcgaggaaaatccctcgttccgcttctggtatcaaggaagcttgcaggttttacttgatagaaagtggattggctctaatggtggcctttctcataaacgtctctgtaatatcagtaagcggggctgtttgtaatgcccccaacttaagccctgaagatcgagctaattgtgaggatttggacttaaacaaggcttcgtttctgctacggaacgttgtgggaaaatggagctcaaagctatttgcaatcgcgcttcttgcttctggtcagagctcgacgataaccggaacttatgctggacaatatgtaatgcagggctttcttgatctcagactcgagccatggctcagaaacttactaacaagatgtttagctataatcccgagtctaattgttgctctcatcggtggttcagctggagctggaaagttaatcatcattgcctcgatgatcttatcctttgagctcccgtttgcgttggttcctcttctcaaattcacaagttgcaaaaccaagatgggttcacatgtcaacccaatggcgattacagctttgacttgggtcattggtggtttaatcatgggaataaacatatactatctagtaagcagtttcatcaaactgcttatccacagtcatatgaagcttatcctcgtcgtcttctgtggaattcttgggttcgcaggcattgctctctatttagccgccatagcttaccttgtcttccggaaaaacagagtagccacttctcttcttatttcaagagactcacaaaatgtggagacacttccaagacaggacattgtcaacatgcagttaccatgtagagtatctacctccgatgttgactga

SEQ ID NO: 8946 - protein, 532 aa, Arabidopsis thaliana
MAATGSGRSQFISSSGGNRSFSNSPLIENSDSNQIIVSEKKSWKNFFAYLGPGFLVSIAYIDPGNFETDLQAGAHYKYELLWIILVASCAALVIQSLAANLGVVTGKHLAEQCRAEYSKVPNFMLWVVAEIAVVACDIPEVIGTAFALNMLFSIPVWIGVLLTGLSTLILLALQKYGVRKLEFLIAFLVFTIAICFFVELHYSKPDPGEVLHGLFVPQLKGNGATGLAISLLGAMVMPHNLFLHSALVLSRKIPRSASGIKEACRFYLIESGLALMVAFLINVSVISVSGAVCNAPNLSPEDRANCEDLDLNKASFLLRNVVGKWSSKLFAIALLASGQSSTITGTYAGQYVMQGFLDLRLEPWLRNLLTRCLAIIPSLIVALIGGSAGAGKLIIIASMILSFELPFALVPLLKFTSCKTKMGSHVNPMAITALTWVIGGLIMGINIYYLVSSFIKLLIHSHMKLILVVFCGILGFAGIALYLAAIAYLVFRKNRVATSLLISRDSQNVETLPRQDIVNMQLPCRVSTSDVD

SEQ ID NO: 8947 - DNA, 1593 bp, Arabidopsis thaliana
  CDS (1)..(1593)
atggaaaacgacgtcaaagagaatctcgaagaagaggaagaccgtcttcttcctcctcctcctccttcacaatctctcccatccaccgattccgaatccgaagcggctttcgaaacaaacgaaaagatcctaatcgtcgatttcgaatcacccgacgatccaacaaccggagacacaccaccgccattctcatggcggaagctctggttattcaccggtccaggtttcttaatgagtatagcgtttttggatccagggaatctagaaggagatctacaagctggtgcaatcgctggctattctctgttgtggctactaatgtgggcaacagctatggggttgttgattcagatgttgtcagctagagtcggtgtagctactggtcgtcatttagctgagctttgtcgtgatgagtatcctacttgggctaggtatgtgctttggtctatggcggaacttgctttgattggtgctgatattcaagaggttattggtagtgctattgctattcagattcttagccgtggcttcttgcctctttgggctggtgttgttattactgcttccgattgttttttatttttgtttctagagaattacggtgtgaggaagttagaagctgtttttgcagttttgatcgcaactatgggtttgtcctttgcttggatgtttggtgaaacaaaaccgagtgggaaagaacttatgataggtattttactaccgagacttagctcaaagacaattaggcaagctgtaggtgttgttggctgtgttataatgcctcacaatgtgtttttgcattcggctcttgtacaatcgaggaaaatcgatccgaagaggaaatcccgggttcaagaagcgcttaattactatttgatcgagtcatccgtcgcacttttcatctccttcatgattaacttgtttgtgactactgtctttgcaaaggggttttatggaactgagaaagctaataacattggcctagttaatgctggtcagtatcttcaagaaaagtttggaggcgggcttcttccgattctttatatctggggtatcgggttgttagcagccggacaaagcagtacgataactggtacatatgctggacagtttataatgggcggttttctgaatctccggcttaagaaatggatgagggcagtaataacaagaagctgtgctattgtgcctacaatgattgtggcaatcgtgttcaatacttctgaagcttccttggatgttttgaatgaatggctcaatgtccttcagtctgtacaaattccttttgctcttctccctcttctaaccttggtatccaaagaagaaattatgggagacttcaagattgggcctattctccagagaatagcttggactgtggctgcacttgtaatgatcatcaatgggtatcttctgttggatttctttgtatcagaagtcgacgggtttctgtttggagttacggtctgcgtctggacgactgcttatatcgcctttatagtgtacctcatttcacacagcaacttttttccttctccttggtcatcctcttccatagaacttcccaaaagagtgtccgtctccaatagctag

SEQ ID NO: 8948 - protein, 530 aa, Arabidopsis thaliana
MENDVKENLEEEEDRLLPPPPPSQSLPSTDSESEAAFETNEKILIVDFESPDDPTTGDTPPPFSWRKLWLFTGPGFLMSIAFLDPGNLEGDLQAGAIAGYSLLWLLMWATAMGLLIQMLSARVGVATGRHLAELCRDEYPTWARYVLWSMAELALIGADIQEVIGSAIAIQILSRGFLPLWAGVVITASDCFLFLFLENYGVRKLEAVFAVLIATMGLSFAWMFGETKPSGKELMIGILLPRLSSKTIRQAVGVVGCVIMPHNVFLHSALVQSRKIDPKRKSRVQEALNYYLIESSVALFISFMINLFVTTVFAKGFYGTEKANNIGLVNAGQYLQEKFGGGLLPILYIWGIGLLAAGQSSTITGTYAGQFIMGGFLNLRLKKWMRAVITRSCAIVPTMIVAIVFNTSEASLDVLNEWLNVLQSVQIPFALLPLLTLVSKEEIMGDFKIGPILQRIAWTVAALVMIINGYLLLDFFVSEVDGFLFGVTVCVWTTAYIAFIVYLISHSNFFPSPWSSSSIELPKRVSVSNS

SEQ ID NO: 8949 - DNA, 1530 bp, Arabidopsis thaliana
  CDS (1)..(1530)
atgccacaactcgagaacaacgagccacttctaatcaacgaggaagaagaagaagaaacagcgtacgatgaaacagagaaggtacatatcgtaagaaacgaagaggaggacgatctagaacacggcgtcggatgcggcggcgcaccaccgttctcatggaagaagctatggttattcaccggacctgggtttttaatgagcattgcgtttttagatccagggaatctcgaaggagatcttcaagccggtgcggttgctgggtactctttgttatggcttctcatgtgggcaacagcaatgggtcttttggttcagcttttgtcggctaggcttggtgttgcgacaggtcgtcacttagctgagctttgtcgtgatgagtatcctacttgggcaagaatggttttgtgggttatggctgaattggctttgattggatctgatattcaagaagttattggtagtgctattgctatcaagattttgagtaatgggattttgcctctttgggctggtgttgttattactgctcttgattgtttcgtcttcttgtttcttgagaactacggaataaggaagctcgaggctgtgtttgcagttcttatcgctacaatgggagtctcattcgcttggatgtttggtcaagctaagccaagtggctctgagcttctcattgggattttggtaccgaaactgagttcaagaacgatacagaaagcagttggagttgtgggttgcattataatgccacacaatgtgtttcttcactcagctcttgttcaatctagagaagtcgataaacgacagaaataccgagtccaagaagcgctaaactactacacaatagaatccacaattgctcttttcatctcctttttgatcaatctgtttgtcacaactgttttcgccaaagggttttataatactgacctcgccaatagcatcggtttggttaacgcgggacagtatcttcaggagaaatatggaggcggtgtgttcccgatactatacatttgggcgatcgggctattagctgctggccaaagcagcactattaccggtacatatgcgggacagttcataatgggcgggtttcttaatttcaaaatgaagaaatggttgagagctttgatcacacgaagctgcgctatcattccaactattatcgttgcgctagtgtttgattcatcggaagctacactcgatgtcttaaacgagtggcttaacgtgcttcagtccattcaaatcccctttgcactcattcccttactttgtttggtctccaaggaacaaatcatgggtagcttcaagattggtcctttgtacaagacaatcgcgtggcttgttgctgcgctcgtgataatgatcaacggttatcttttgttggagttcttctccaatgaggttagtggcatagtctataccggttttgtgacactgttcacagcttcttatggtgcattcatcctctacctcattgctcgtggcatcactttcactccttggccgttcaaagcggagtctagtcattga

SEQ ID NO: 8950 - protein, 509 aa, Arabidopsis thaliana
MPQLENNEPLLINEEEEEETAYDETEKVHIVRNEEEDDLEHGVGCGGAPPFSWKKLWLFTGPGFLMSIAFLDPGNLEGDLQAGAVAGYSLLWLLMWATAMGLLVQLLSARLGVATGRHLAELCRDEYPTWARMVLWVMAELALIGSDIQEVIGSAIAIKILSNGILPLWAGVVITALDCFVFLFLENYGIRKLEAVFAVLIATMGVSFAWMFGQAKPSGSELLIGILVPKLSSRTIQKAVGVVGCIIMPHNVFLHSALVQSREVDKRQKYRVQEALNYYTIESTIALFISFLINLFVTTVFAKGFYNTDLANSIGLVNAGQYLQEKYGGGVFPILYIWAIGLLAAGQSSTITGTYAGQFIMGGFLNFKMKKWLRALITRSCAIIPTIIVALVFDSSEATLDVLNEWLNVLQSIQIPFALIPLLCLVSKEQIMGSFKIGPLYKTIAWLVAALVIMINGYLLLEFFSNEVSGIVYTGFVTLFTASYGAFILYLIARGITFTPWPFKAESSH

SEQ ID NO: 8951 - DNA, 1593 bp, Arabidopsis thaliana
  CDS (1)..(1593)
atgacgggatccaccgtttcccgccaagaaaacagccctaagagaccaaacgacagtaacggcgaattcaaacgtctattagttcccgaaacctctcagccagaggaggacgagcttcacgaatcgccaccggagaatcagatcctgaacgtagaagaagacagagacaaaacctacgattcagttccgccattctcatgggcaaagctatggaaattcaccggacctggatttctcatgagcatcgcgtttctagatccaggaaatatcgaaggagatttacaagccggagctgtggctggttactctctcctatggcttcttctatgggcgacgctaatgggacttctgatgcagcttctctctgctcgtatcggtgtcgccacgggtcgacatttagcggagatttgtcgaagtgagtatccttcgtgggcgcgaatcttgctttggttcatggcggaggttgctttgatcggagctgatattcaagaagtcatcggaagcgcgatcgctcttcagattttgactcgagggtttttacctatttgggttggtgttatcatcacatcatttgattgcttcttgatttcgtatttggagaaatgtggaatgaggaaattagaaggtcttttcgcggttttgattgcgacaatggcgctttcgttcgcttggatgtttaatgaaactaagccaagtgttgaagaactattcataggtattattattccgaaactcggatcaaagacgattagagaagctgttggagttgtgggatgtgtaataacgcctcacaatgtgttcttgcattcagctttagtgcagtctaggaagacggatccaaaggagataaacagagttcaagaagctcttaactactatacaatcgaatcgtcagccgcgctttttgtttcgttcatgatcaatttgtttgtaactgcggttttcgcgaaagggttttatggaaccaaacaagctgatagtataggactggttaacgcgggatattacctacaagagaaatatggcggtggtgttttcccgatactatacatttgggggattggtttattagctgctggacaaagcagtactataaccgggacttatgctggacagtttataatggaagggttcttagatcttcaaatggaacaatggctatcagcttttataacgagaagctttgctattgtacctactatgtttgttgctattatgtttaacacatccgagggctcgctcgatgttttaaacgaatggcttaacattcttcagtcgatgcagattcctttcgcggttattcctcttttgactatggtttctaatgaacatatcatgggtgtcttcaagatcggaccttcgcttgagaagctagcttggactgtggcggtgtttgtgatgatgataaatgggtatcttcttctagatttcttcatggctgaagtggaagggtttcttgttgggtttctggtttttggtggagtagttggatacatcagtttcatcatctatcttgtttcttatagaagctcacaatcttcttcctggtcgagtttagaaatgtcagagagagttgtttccacagagacgtag

SEQ ID NO: 8952 - protein, 530 aa, Arabidopsis thaliana
MTGSTVSRQENSPKRPNDSNGEFKRLLVPETSQPEEDELHESPPENQILNVEEDRDKTYDSVPPFSWAKLWKFTGPGFLMSIAFLDPGNIEGDLQAGAVAGYSLLWLLLWATLMGLLMQLLSARIGVATGRHLAEICRSEYPSWARILLWFMAEVALIGADIQEVIGSAIALQILTRGFLPIWVGVIITSFDCFLISYLEKCGMRKLEGLFAVLIATMALSFAWMFNETKPSVEELFIGIIIPKLGSKTIREAVGVVGCVITPHNVFLHSALVQSRKTDPKEINRVQEALNYYTIESSAALFVSFMINLFVTAVFAKGFYGTKQADSIGLVNAGYYLQEKYGGGVFPILYIWGIGLLAAGQSSTITGTYAGQFIMEGFLDLQMEQWLSAFITRSFAIVPTMFVAIMFNTSEGSLDVLNEWLNILQSMQIPFAVIPLLTMVSNEHIMGVFKIGPSLEKLAWTVAVFVMMINGYLLLDFFMAEVEGFLVGFLVFGGVVGYISFIIYLVSYRSSQSSSWSSLEMSERVVSTET

SEQ ID NO: 8953 - DNA, 1584 bp, Arabidopsis thaliana
  CDS (1)..(1584)
atggcggctgaaacagcaagtggcagcaacagaagtatctcaaactctcctctcatagaaaactctgattctaatcagattcttgtccctgagaaaaagagctggaaaaacttcttctcatacttaggccctggatttcttgtctcaattgcttacattgatcctggaaactttgaaactgatctgcaatcaggagctcaatacaagtatgagttactctggatcatattggtggcatcatgtgcagctttagtgattcaatctctggctgcaaatcttggtgttgtcacaggaaagcacttagcagagcattgtagagctgagtactccaaggttccaaactttatgttatgggtagttgctgaaatcgctgtagtagcttgtgatattccagaagtaattggaacagcatttgctttaaacatgctattcaatatcccggtttggattggtgttcttctcacaggacttagtacattgattcttctagcacttcaacaatatgggattagaaagctcgagttcttgatcgcttttcttgtgttcaccattgccctatgcttctttgttgagcttcattactcaaagccagacccaaaagaagtcctctatggtctctttgttcctcagttgaagggtaatggtgcaactggtttagcgatatctctcctcggtgccatggttatgccgcacaatctctttctccactcagctttagttctctctaggaaaattcctcgttcagtaaccggcatcaaggaagcttgtcggtattacttgatagaaagcggattagcacttatggtggcatttctcatcaatgtctctgtgatatcagtgagtggtgcagtttgtaatgcctcagatttgagtccagaagatcgagctagttgccaagatttggacttaaacaaagcttcatttctgctacgtaacgttgtgggtaaatggagctcaaagctatttgcaattgcgttgcttgcttccggtcagagttcaaccataaccggaacatatgctggacaatacgttatgcaggggtttcttgatttaagactagaaccatggctcagaaacttcctaaccagatgcttggctataatcccaagtttgatcgttgctttgataggtggctcagctggagccggaaagttaatcatcattgcctcgatgatcttatcctttgaactcccatttgctttagtcccacttctcaaattcacaagcagtaaaaccaaaatgggctcacacgccaattcacttgtgatttcatcggtgacttggataattggtggacttattatgggtataaacatttactatcttgtaagcagcttcatcaagttgcttctccatagtcacatgaaccttgtagccattgttttcttaggagttcttggattctcaggcattgccacttacttagctgccatcagttaccttgtcctccgtaaaaacagagagtcctcgtccacacatttcctagacttcagtaactctcagaccgaggaaacacttcctagagaagatattgccaacatgcagttacctaatagagtagcggttataggagacttaaattga

SEQ ID NO: 8954 - protein, 527 aa, Arabidopsis thaliana
MAAETASGSNRSISNSPLIENSDSNQILVPEKKSWKNFFSYLGPGFLVSIAYIDPGNFETDLQSGAQYKYELLWIILVASCAALVIQSLAANLGVVTGKHLAEHCRAEYSKVPNFMLWVVAEIAVVACDIPEVIGTAFALNMLFNIPVWIGVLLTGLSTLILLALQQYGIRKLEFLIAFLVFTIALCFFVELHYSKPDPKEVLYGLFVPQLKGNGATGLAISLLGAMVMPHNLFLHSALVLSRKIPRSVTGIKEACRYYLIESGLALMVAFLINVSVISVSGAVCNASDLSPEDRASCQDLDLNKASFLLRNVVGKWSSKLFAIALLASGQSSTITGTYAGQYVMQGFLDLRLEPWLRNFLTRCLAIIPSLIVALIGGSAGAGKLIIIASMILSFELPFALVPLLKFTSSKTKMGSHANSLVISSVTWIIGGLIMGINIYYLVSSFIKLLLHSHMNLVAIVFLGVLGFSGIATYLAAISYLVLRKNRESSSTHFLDFSNSQTEETLPREDIANMQLPNRVAVIGDLN

SEQ ID NO: 8955 - DNA, 1566 bp, Schizosaccharomyces pombe
  CDS (1)..(1566)
atgtctagccaatcctattatatgaatgacttggatgatttgagatcattagaatcatcaactcttaataaaaaagataccgcgatcaatgaattaaatcctgagcaaaatgacactcgccgatccacagatcttcttttagaagacaaatatgggattcaaacagggttttccaaatattggaagaaatgtacttatggaatccgtgagtattgcaagttcatcggccctggattccttatagctgttgcatatattgatccaggtaactactcaaccgatttagatgctggttcaaggtttcaatacaagttactgttcatcgtttttctctccaatctgtttgctgtgtatttgcaatcattatgtattagacttggatccgtaacgggtatggatttagccagaaattgccgcgaacactataatagatatatctgttggtcattttacgttcttgcagaaattgcaattatagctactgatattgccgaagttatcggcacggctgtcgcgcttaaaattttaatgcacattcctttggtagctggcgttgtaattaccatcttagacgttttactggtccttattgcctggcgtcctgaaggttctatgctcagtgtacgtatctttgagactgctgttgctcttttggttctagttgttgctatttcatttgcagtcgttttaggccgcgtccacatcgggggcgctggtactgtctttaaagggttcctaccttcttctaccgttttttcaagagagggactttacagcagcattggaattttgggtgctactgtcatgccccactcactattcctaggttctggccttgttcaaactagacttcgtgatttggatgtccgtcgtgggaattatacacctgttggtgattgctctgattacagacctacccatgaaaccattaagcattctttaacatattcaatagtcgaggttgctttatccctttttacgtttgcattatttactaattctagtatcctaatcgtcgctggtgctgtattttacaatactagcggcgctgacacctccgatcttttttcaatttatgatttactgaaagaatatgtgtctatatcttgtggtcgactttttgccgtcgcccttttattctcaggcatgagtgcaggatatgtttgtaccatcgcaggtcaaatagttagtgagggttacataaattggaatttacgtccttggcttcgaagagtaataacacgtgctattgcaattatcccatgcttagttgtttcggctgctgttggacagagtggtcttaatcaagtactgaacgctagtcaggtttgtctttctattttattaccttttcttacctttccacttgtaatgttcacttgctctcgaaaagttatgcgtgttgttagtgattctaccaatgaagaaactggacaattgataagagaaactcacgattatagcttaggatggactatgactattgttacatgggcaatttggctctttttgactgctttaaatttattactcattgtttggttgggcatgggagtctccttctaa

SEQ ID NO: 8956 - protein, 521 aa, Schizosaccharomyces pombe
MSSQSYYMNDLDDLRSLESSTLNKKDTAINELNPEQNDTRRSTDLLLEDKYGIQTGFSKYWKKCTYGIREYCKFIGPGFLIAVAYIDPGNYSTDLDAGSRFQYKLLFIVFLSNLFAVYLQSLCIRLGSVTGMDLARNCREHYNRYICWSFYVLAEIAIIATDIAEVIGTAVALKILMHIPLVAGVVITILDVLLVLIAWRPEGSMLSVRIFETAVALLVLVVAISFAVVLGRVHIGGAGTVFKGFLPSSTVFSREGLYSSIGILGATVMPHSLFLGSGLVQTRLRDLDVRRGNYTPVGDCSDYRPTHETIKHSLTYSIVEVALSLFTFALFTNSSILIVAGAVFYNTSGADTSDLFSIYDLLKEYVSISCGRLFAVALLFSGMSAGYVCTIAGQIVSEGYINWNLRPWLRRVITRAIAIIPCLVVSAAVGQSGLNQVLNASQVCLSILLPFLTFPLVMFTCSRKVMRVVSDSTNEETGQLIRETHDYSLGWTMTIVTWAIWLFLTALNLLLIVWLGMGVSF

SEQ ID NO: 8957 - DNA, 2577 bp, Saccharomyces cerevisiae
  CDS (607)..(2334)
atataaaatctataatttatatatatatactactactacaattatcatcatacaagtaataataaagtttaaaagctacaacgaggaggggaatcctattgcgaagtttggtgtcacatggtttgaagagccttgttaacgcgctcttctcagttctactttcttcttcaattttgttggccgattttcttctttatttggctagccagtaattttttttactgcatatagtaaccgcaacgccagtagcttggaaggagcgttgtttaaacgacagccgtaaacttagaatagtacagagtacttctgtagtagtaatgcgcgccagaaaccagcttgcttagatgttaaatcatcggaatcaatcctgttcgcattcctgtgccgaaaatatttcgacgtactacgtggaccctagcgtccctaaatgcaacagttttttctaatttaggatttgttaactccgccggggtgatttgatgctgcaatataaatatacatagaataatatttggctgctcatcattgtgcgagcatattaatatttcatgaataggtagaaagatatatatcagcagaaaaactaactttctcaattaggtcaaaatggtgaacgttggtccttctcatgctgcagttgctgtggatgctagcgaagcccgcaaaagaaatatttcagaagaagtattcgaactgagggataagaaagattctacagtggtaattgagggtgaagccccggtaagaacttttaccagtagctctagtaaccatgaaagagaggatacgtatgtttctaaaaggcaggtaatgagagatatttttgctaaatacttgaagttcattggacctggattgatggttagtgtggcttacatcgatcccggtaattactctactgccgtcgatgcaggtgcctctaatcaattttccctactttgtatcattttgttatcaaactttattgccatatttttgcaatgtctgtgtatcaagttgggttccgttacgggactagatctaagtcgagcttgcagagagtatttaccacggtggctcaactggacattgtatttttttgcagaatgtgccgttatagccaccgatatagctgaagtgattggtacagcgattgccttgaatatcctgatcaaagtgccccttccagcgggcgtggccattactgttgtggatgtgtttttgattatgtttacatataaacctggtgcgtcatcaattaggttcattagaatatttgaatgttttgttgcagtattagttgttggcgtgtgcatttgtttcgcaatagaattggcttatatcccgaagagtacgtccgttaaacaagtgttcagaggatttgtgccatctgcccaaatgtttgaccacaatggtatttataccgctatttccatcttaggtgctactgttatgccacattcgttgtttttgggttccgctttagtgcagccaaggcttttagattatgacgttaaacacggtaattatactgtttctgaagaacaagataaagtgaaaaaatctaaatccactgaagagattatggaagaaaaatattttaattatagacccacgaacgctgctatcaaatattgcatgaaatattctatggtcgaattaagcataactctcttcaccctagcgcttttcgtcaattgtgccatcctagttgttgcgggctccactctatataactcaccagaagcagatggggcagatttgtttactattcatgaattattatcaagaaatctggcacccgcagcaggtacgattttcatgctcgcacttttattaagtggtcaatccgcaggtgtagtgtgtactatgtcgggtcaaattgtaagtgagggtcatattaattggaagttgcagccatggcaaagaagattggccactagatgtatttcgataatcccttgtttggtcatctctatctgtatcggtagagaagctttatcaaaggccttaaatgcttcccaagttgttttatccatagttctgccatttttggtagcacctttaattttcttcacatgtaaaaaatcaatcatgaaaaccgaaattaccgtcgaccatactgaagaagatagccataaccatcaaaataacaacgatagatctgcaggtagcgtaatcgagcaagatggttctagtggcatggagatagaaaatggaaaagatgtcaaaatcgtttatatggcaaacaattggattatcactgttattgctataattgtgtggcttttcttatctttactgaacgtttatgccattgttcaattaggcatgtctcatggtgatatcagttaatgtctgcctcttacattcttgcgcacaataacattaagattatttgtaagctttatgacagctgtacttcaagtagagcttgtgattatacattctagcatagtgaaaaaaaaataataactattcgaaactaatacacgtacatgtatatatatattataaattgcttatgcttatttaatagaagggttgttgaattatacaagaaaacttttctctagttttctacacttttcttttttt

SEQ ID NO: 8958 - protein, 575 aa, Saccharomyces cerevisiae
MVNVGPSHAAVAVDASEARKRNISEEVFELRDKKDSTVVIEGEAPVRTFTSSSSNHEREDTYVSKRQVMRDIFAKYLKFIGPGLMVSVAYIDPGNYSTAVDAGASNQFSLLCIILLSNFIAIFLQCLCIKLGSVTGLDLSRACREYLPRWLNWTLYFFAECAVIATDIAEVIGTAIALNILIKVPLPAGVAITVVDVFLIMFTYKPGASSIRFIRIFECFVAVLVVGVCICFAIELAYIPKSTSVKQVFRGFVPSAQMFDHNGIYTAISILGATVMPHSLFLGSALVQPRLLDYDVKHGNYTVSEEQDKVKKSKSTEEIMEEKYFNYRPTNAAIKYCMKYSMVELSITLFTLALFVNCAILVVAGSTLYNSPEADGADLFTIHELLSRNLAPAAGTIFMLALLLSGQSAGVVCTMSGQIVSEGHINWKLQPWQRRLATRCISIIPCLVISICIGREALSKALNASQVVLSIVLPFLVAPLIFFTCKKSIMKTEITVDHTEEDSHNHQNNNDRSAGSVIEQDGSSGMEIENGKDVKIVYMANNWIITVIAIIVWLFLSLLNVYAIVQLGMSHGDIS

SEQ ID NO: 8959 - DNA, 1650 bp, Saccharomyces cerevisiae
  CDS (1)..(1650)
atgacgtcccaagaatatgaacctattcaatggagcgatgaatcccaaacaaataatgatagtgtcaacgatgcgtatgccgacgtgaataccactcatgagtcgcgtcgaagaacaactttgcagccaaactcaacatcccagagcatgatcggaacattgagaaaatatgctaggttcatcggtcctggtttgatggtatctgtatcgtacatggatcctggtaactatagtacagctgtagcagcgggttctgctcatcggtacaagcttttattttctgtcttagtttctaatttcatggctgctttttggcagtacctctgcgccagattgggtgctgtcactggcctagatctggcacaaaattgtaagaaacatttgccctttggacttaacattactctttatattctggcggagatggcaattattgccacagatctggcagaagtggtaggaaccgctatttctttgaatatccttttccatatacctctcgccctaggtgtgatacttactgtggtagacgttttaattgttctgctagcttacaaacctaacggttccatgaagggtatcagaatatttgaagcttttgtttctttattggtggttcttaccgtagtttgctttactgttgaactgttttatgccaaactgggacctgccaaagaaatattttctgggttcttacccagtaaagccgtttttgaaggtgatgggttatacttaagtctggcaattctgggcgccacggtaatgcctcattcattatatttggggtcaggtgtggttcaaccaagattaagagagtatgatatcaaaaacggacattacttgccagacgcgaatgatatggataacaatcacgataattacaggccatcctatgaggccatcagtgaaactctgcactttactataacggaattactgatctcgctgttcacggtggcattatttgtcaattgtgccattcttatcgtgtctggcgctacactatacgggtccactcaaaatgctgaggaagctgacttattttctatttacaacttactctgtagtactctttccaagggagcgggaacggtattcgtgctggcattgttgttttcaggacagagtgccggtatcgtgtgtacgttgagtggacaaatggttagtgaagggttcttaaattggactgtttctccggcattgagaagatccgccacaagagcggtagccatcacgccttgtttgattttagtgcttgtagctggacgtagcggcctctctggtgcactaaatgcttcccaagtggtactttctctcttgctgccttttgtttctgcacctttactttacttcacttcaagcaagaagattatgcgtgtacagcttaaccgtaccaaagaactttcaagaactacagacaaaaaacccgtggccgaccgaaccgaagatgatgagaccattgagctcgaagaaatgggcataggcagcagctcacaggagcgcagcttagtttctcctgctccagaatacaaagacatgagcaatggaatgatcgtcaccgtgctcgcaatcatagtatggttgattatctccggactgaacttttatatgttactgggctttactacgggcaaagaagtacacctctaa

SEQ ID NO: 8960 - protein, 549 aa, Saccharomyces cerevisiae
MTSQEYEPIQWSDESQTNNDSVNDAYADVNTTHESRRRTTLQPNSTSQSMIGTLRKYARFIGPGLMVSVSYMDPGNYSTAVAAGSAHRYKLLFSVLVSNFMAAFWQYLCARLGAVTGLDLAQNCKKHLPFGLNITLYILAEMAIIATDLAEVVGTAISLNILFHIPLALGVILTVVDVLIVLLAYKPNGSMKGIRIFEAFVSLLVVLTVVCFTVELFYAKLGPAKEIFSGFLPSKAVFEGDGLYLSLAILGATVMPHSLYLGSGVVQPRLREYDIKNGHYLPDANDMDNNHDNYRPSYEAISETLHFTITELLISLFTVALFVNCAILIVSGATLYGSTQNAEEADLFSIYNLLCSTLSKGAGTVFVLALLFSGQSAGIVCTLSGQMVSEGFLNWTVSPALRRSATRAVAITPCLILVLVAGRSGLSGALNASQVVLSLLLPFVSAPLLYFTSSKKIMRVQLNRTKELSRTTDKKPVADRTEDDETIELEEMGIGSSSQERSLVSPAPEYKDMSNGMIVTVLAIIVWLIISGLNFYMLLGFTTGKEVHL

SEQ ID NO: 8961 - DNA, 1479 bp, Oryza sativa
  CDS (1)..(1479)
atgagcggcccaatgcaacgctcgtcgcagccacagtttatctctagcgtcgagcggaacaatcaatcgaatggtcctggcactcctcttattgacagcatagatgttgatcagattgttattccagagaaaaatagttggaagaacctattttcatacatagggcccggatttcttgtctctattgcgtatattgatcctggaaattttgagacagacctacaggctggagcacagtacaaatatgagcttctttggatcatacttattgcgtcatgtgctgctcttataattcaatcacttgcagctaggctaggagtcgtgactgggaagcacctggccgagcattgcagagctgaatatccaaaggctacaaatttcatattatggattcttgcggaactagctgtagttgcatgcgacattcctgaagtaattggaactgcttttgctttgaacatgctctttaaaatccctgtgtggtgtggtgttctgataactggactcagcactctgatgctactgttactacaacaatatggggtccgtaaactggaatttctgatagctattctggtgtcattaatagcaacttgtttcttagttgagcttgggtattctaaaccaaattcttcagaagttgtgaggggcctttttgttcctgaacttaaagggaatggagccacaggtcttgctatctcactacttggtgctatggtgatgccgcataatctttttctccactcagcattggtactatcaagaaaagtgccacggtcagttcatgggatcaaaaatgtcctcggaaactggagctcaaagttatttgcagtagccttgttggcgtctggccagagttctacaattacaggaacttatgcgggacaatatgtcatgcaggggtttctagatcttcggatgacaccctggatacggaaccttctaactaggtccttggcaattctgccaagtctgattgtttcgataattggaggttcctcagcagctggacagttgattatcattgcatcgatgatactgtcatttgagcttccttttgctctagttccactcctaaaattcacaagcagcaggacaaaaatggggcagcacacaaattcaaaagccatttctgtgataacatggggaattggttcgtttatcgttgtcatcaacacctacttcctgataacaagctttgtcaagctgcttctccacaacggtctatcgactgtatcccaagtattctccgggatattcggtttcctggggatgctcatatacatggctgcaattctctacctcgttttccggaagaacaggaaagctaccctgccattgctggagggcgattcgacggtccgcatagtaggtcgcgacacggccactgaaggagaaggttctcttggccatctgccccgggaggacatctccagcatgcagcttcctcagcagcgaactgcttctgatctcgattag

SEQ ID NO: 8962 - protein, 492 aa, Oryza sativa
MSGPMQRSSQPQFISSVERNNQSNGPGTPLIDSIDVDQIVIPEKNSWKNLFSYIGPGFLVSIAYIDPGNFETDLQAGAQYKYELLWIILIASCAALIIQSLAARLGVVTGKHLAEHCRAEYPKATNFILWILAELAVVACDIPEVIGTAFALNMLFKIPVWCGVLITGLSTLMLLLLQQYGVRKLEFLIAILVSLIATCFLVELGYSKPNSSEVVRGLFVPELKGNGATGLAISLLGAMVMPHNLFLHSALVLSRKVPRSVHGIKNVLGNWSSKLFAVALLASGQSSTITGTYAGQYVMQGFLDLRMTPWIRNLLTRSLAILPSLIVSIIGGSSAAGQLIIIASMILSFELPFALVPLLKFTSSRTKMGQHTNSKAISVITWGIGSFIVVINTYFLITSFVKLLLHNGLSTVSQVFSGIFGFLGMLIYMAAILYLVFRKNRKATLPLLEGDSTVRIVGRDTATEGEGSLGHLPREDISSMQLPQQRTASDLD

SEQ ID NO: 8963 - DNA, 1599 bp, Brassica napus
  CDS (1)..(1599)
atggcggcttcagcatctgaacgtcctcaattcatatcgagtaacggtgggaacagaagcttctccaacgctccactcatcgacaactctgatcctaatcagattattgtccccgagaaaaagagctggaagaatttctttgcatacttaggacctgggtttcttgtttcaatcgcatatattgatcctggaaactttgagactgatcttcaagcaggagcacaatacaagtatgagttactttggatcatattggtggcttcttgtgccgctttggtgattcaatctctggctgcaaatcttggtgttgtcacaggaaaacatttggctgagcactgtagagctgaatactccaaagttccaaactttttgctatgggttgttgcagaaattgcagtagttgcttgtgacattccagaagttattggaacagcttttgctctgaacatgctctttagcatacctgtttggattggtgttcttctcacaggcttaagtacactgatgcttcttgcacttcaacaatacggggtgagaaagctggagttcttgattgcatttctggtgttcacaattgctctatgctttgtcattgagctacactactcaaaaccagacccaggagaagtcctacatggtctctttgttccacaactcaaaggaaatggtgcaactggtcttgcaatctctttgcttggagccatggttatgccgcacaacctcttcctccactctgccttggttctctccaggaaaatcccacgttcatctactgggatcaaggaggcttgcaggttttacttgatagaaagcggattggctctaatgatagcctttctcataaacgtctctgtgatatcagtaagtggtgctgtttgcaatgcccctgacctaacccccgaagaccgtgctaaatgtgaggatttggacttaaacaaggcttcgtttctgctacgaaacgtggtgggtaaatggagctcaaagctattcgccatcgcgcttcttgcttcagggcagagctcaactataactggaacttatgctgggcaatacgtgatgcaagggtttcttgatctaagactcgagccatggctcagaaacttcttaactagatgtttagctattatccctagtctcatagttgctctcatcggtggttctgctggagctggaaagttaatcatcattgcctcgatgatcttatcctttgagctcccatttgcgctagttcctcttctcaagttcactagctgcaaaaccaagatgggttcacatgtaaaccatatggcgattacaactttgacttgggtcattggtgctctaattatggggataaacatatactacatagtaagcagtttcactaagctgctcatccatagtcacatgaagcttgcccttgtcatcttttgtggaattcttgggttctcaggcattgctatctacttggcctccatagcttatcttgtcttccggaaaaacagaaaagctagtcctcttcttgcttcaacaaactcacaaacagtggagacacttccaagacaagacattgttgacatgcagttacatggtaaagcggctgcctcagatcttgattga

SEQ ID NO: 8964 - protein, 532 aa, Brassica napus
MAASASERPQFISSNGGNRSFSNAPLIDNSDPNQIIVPEKKSWKNFFAYLGPGFLVSIAYIDPGNFETDLQAGAQYKYELLWIILVASCAALVIQSLAANLGVVTGKHLAEHCRAEYSKVPNFLLWVVAEIAVVACDIPEVIGTAFALNMLFSIPVWIGVLLTGLSTLMLLALQQYGVRKLEFLIAFLVFTIALCFVIELHYSKPDPGEVLHGLFVPQLKGNGATGLAISLLGAMVMPHNLFLHSALVLSRKIPRSSTGIKEACRFYLIESGLALMIAFLINVSVISVSGAVCNAPDLTPEDRAKCEDLDLNKASFLLRNVVGKWSSKLFAIALLASGQSSTITGTYAGQYVMQGFLDLRLEPWLRNFLTRCLAIIPSLIVALIGGSAGAGKLIIIASMILSFELPFALVPLLKFTSCKTKMGSHVNHMAITTLTWVIGALIMGINIYYIVSSFTKLLIHSHMKLALVIFCGILGFSGIAIYLASIAYLVFRKNRKASPLLASTNSQTVETLPRQDIVDMQLHGKAAASDLD

SEQ ID NO: 8965 - DNA, 1602 bp, Brassica napus
  CDS (1)..(1602)
atggaaaatgacgtcaaggtcgcggagaaagtggaggaagctgaccgccttcttcctccccagtctcttccctctaattccgacgaggaagaacccgaatccgaatccgaagcagaggccgcgttcgaatctcgtgacaagatcgtgatcgtcgatttcgaatcagccggcgatcccgccgcagcacctcctttctcgtggcggaaactgtggctgttcacgggtccaggcttcctgatgagcatagccttcttagatccagggaatctagaaggagatctacaagctggtgccatcgctggctactctctcctatggctcctaatgtgggccaccgctatggggttactgattcagatgctctccgctagagtcggtgtcgccaccggtcgacatctggctgagctctgccgcgacgagtatccgacttgggcgaggtatgtgctttggtctatggccgagctcgctctgatcggagctgatattcaagaggtcatcggtagtgcgatagcgattcagattcttagccgtggcgtcttgcctctctgggccggtgttgtcattacggcgtcggattgttttttatttttgtttctagagaattatggtgtgaggaagttagaagctgtttttgcagttttgattgcaactatgggtttgtcttttgcttggatgtttggtgaaaccaagccaagtggaaaagaacttatgataggtattttacttccaagacttagctcaaagacaattagacaagctgtaagtgttgttggctgtgtcataatgcctcacaacgtgttcttgcattcggctcttgtacagtcgaggcaaatagacccaaagaggaaatcacgggtccaagaagcgctaaattactatttgatcgagtcatctctcgcgctcttcatctctttcatgatcaacttgtttgtgactactgtctttgcaaaagggttttacggaaccgagaaagctaacaacattggcttagttaatgctggtcagtatcttcaagagaagtttggaggtgggcttcttccgattctctatatctggggaatagggctgttagcagccggacaaagcagtacgataaccggtacatatgctggacagtttataatgggagggtttctgaacctccgccttaagaaatggatgagggcagcgataacaagaagctgtgctattgtgccgaccatgattgtagcaatcgtgttcaacacttctgaagcttccttggatgttttgaatgaatggctcaatgtgcttcagtctgtacagattccttttgctcttctccctcttctaacattggtatccaaagaagaagttatgggagacttcaagattggacctattctccagagaatagcttggactgtggctgcacttgtaatgatcatcaatgggtactttctgttggatttctttgtatcagaagttaacgggtttatgtttggagttacggtctgtgtctggacaaccgcttatgttgcctttatagtctacctcatttcacacagcaactttattccttctccttggtcttcttcctcttccatagaacttcccaaaagagtgacagtttccaatagctag

SEQ ID NO: 8966 - protein, 533 aa, Brassica napus
MENDVKVAEKVEEADRLLPPQSLPSNSDEEEPESESEAEAAFESRDKIVIVDFESAGDPAAAPPFSWRKLWLFTGPGFLMSIAFLDPGNLEGDLQAGAIAGYSLLWLLMWATAMGLLIQMLSARVGVATGRHLAELCRDEYPTWARYVLWSMAELALIGADIQEVIGSAIAIQILSRGVLPLWAGVVITASDCFLFLFLENYGVRKLEAVFAVLIATMGLSFAWMFGETKPSGKELMIGILLPRLSSKTIRQAVSVVGCVIMPHNVFLHSALVQSRQIDPKRKSRVQEALNYYLIESSLALFISFMINLFVTTVFAKGFYGTEKANNIGLVNAGQYLQEKFGGGLLPILYIWGIGLLAAGQSSTITGTYAGQFIMGGFLNLRLKKWMRAAITRSCAIVPTMIVAIVFNTSEASLDVLNEWLNVLQSVQIPFALLPLLTLVSKEEVMGDFKIGPILQRIAWTVAALVMIINGYFLLDFFVSEVNGFMFGVTVCVWTTAYVAFIVYLISHSNFIPSPWSSSSSIELPKRVTVSNS

SEQ ID NO: 8967 - DNA, 1602 bp, Brassica napus
  CDS (1)..(1602)
atggaaaatgacgtcaaggtcgcggagaaagtggaggaagctgaccgccttcttcctccccagtctcttccctctaattccgacgaggaagaacccgaatccgaatccgaagcagaggccgcgttcgaatctcgtgacaagatcgtgatcgtcgatttcgaatcagccggcgatcccgcggcagtacctcctttctcgtggcggaaactgtggctgttcacgggtccaggtttcctgatgagcatagccttcttagatccagggaatctagaaggagatctacaagctggtgccatcgctggctattctctcctatggctcctaatgtgggccaccgctatggggttactgattcagatgctctccgctagagtcggtgtcgccaccggtcgacatctggctgagctctgccgcgacgagtatccgacttgggcgaggtatgtgctttggtctatggccgagctcgctctgatcggagctgatattcaagaggttatcggtagtgcgatagcgattcagattcttagccgtggcgtcttgcctctctgggccggtgttgtcattacggcgtcggattgttttttatttttgtttctagagaattatggtgtgaggaagttagaagctgtttttgcagttttgattgcaactatgggtttgtcttttgcttggatgtttggtgaaaccaagccaagtggaaaagaacttatgataggtattttacttccaagacttagctcaaagacaattagacaagctgtaagtgttgttggctgtgtcataatgcctcacaacgtgttcttgcattcggctcttgtacagtcgaggcaaatcgacccaaagaggaaatcacgggtccaagaagcgctaaattactatttgatcgagtcatctgtcgcgctcttcatctctttcatgatcaacttgtttgtgactactgtctttgcaaaagggttttacggaaccgagaaagctaacaacattggcttagttaatgctggtcattatcttcaagagaagtttggaggtgggcttcttccgattctctatatctggggaatagggttgttagcagccggacaaagcagtacgataaccggtacatatgctggacagtttataatgggagggtttctgaacctccggcttaagaaatggatgagggcagtgataacaagaagctgtgctattgtgccgaccatgattgtagcaatcgtgttcaacacttctgaagcttccttggatgttttgaatgaatggctcaatgtgcttcagtctgtacagattccttttgctcttctccctcttctaacattggtatccaaagaagaagttatgggggacttcaagattggacctgttctccagagaatagcttggactgtggctgcacttgtaatgatcatcaatgggtactttctgttggatttctttgtatcagaagttaacgggtttatgtttggagttacggtctgtgtctggacaaccgcttatgttgcctttatagtctacctcatttcacacagcaactttattccttctccttggtcttcttcctcttccatagaacttcccaaaagagtgacagtttccaatagctag

SEQ ID NO: 8968 - protein, 533 aa, Brassica napus
MENDVKVAEKVEEADRLLPPQSLPSNSDEEEPESESEAEAAFESRDKIVIVDFESAGDPAAVPPFSWRKLWLFTGPGFLMSIAFLDPGNLEGDLQAGAIAGYSLLWLLMWATAMGLLIQMLSARVGVATGRHLAELCRDEYPTWARYVLWSMAELALIGADIQEVIGSAIAIQILSRGVLPLWAGVVITASDCFLFLFLENYGVRKLEAVFAVLIATMGLSFAWMFGETKPSGKELMIGILLPRLSSKTIRQAVSVVGCVIMPHNVFLHSALVQSRQIDPKRKSRVQEALNYYLIESSVALFISFMINLFVTTVFAKGFYGTEKANNIGLVNAGHYLQEKFGGGLLPILYIWGIGLLAAGQSSTITGTYAGQFIMGGFLNLRLKKWMRAVITRSCAIVPTMIVAIVFNTSEASLDVLNEWLNVLQSVQIPFALLPLLTLVSKEEVMGDFKIGPVLQRIAWTVAALVMIINGYFLLDFFVSEVNGFMFGVTVCVWTTAYVAFIVYLISHSNFIPSPWSSSSSIELPKRVTVSNS

SEQ ID NO: 8969 - DNA, 1611 bp, Glycine max
  CDS (1)..(1611)
atgcctcctcaacagacccaacaacctctgttatcggaggagcaagaagagacagcctacgattcctcggagaaggtggtggtggtcggaatcgacgaccacgacggcgacttggaggcgccgccgttctcatggcggaacctgtggctcttcaccgggcccgggtttctcatgagcatcgcgtttctggatcccgggaacctcgagggggatcttcagtccggtgccattgctgggtactcgctcctgtggctcctcatgtgggccacggctatgggccttattatccagcttctatcggctcggctcggcgtggctacgggaaggcacttagccgaactctgcagagaagagtatcccacatgggctaggattgttctgtggttgatgactgagattgctcttattggcgctgacatacaagaggttattgggagcgctattgctatcaggattctcagtaacggcgtcgttccactctgggccggggtcgtcattacagcttttgattgttttatttttctctttcttgagaactacggtgtgaggaaactggaagcgtttttcgctgttctgattggtgtaatggctctctcatttgcctggatgtttggtgaagccaagcccaatggtgttgatgttcttgttggtattttggttcctaaacttagctccagaactatacagcaagctgttggagttgtgggttgcattattatgcctcacaatgtgtacttgcattctgcgcttgttcaatcaaggcaggttgatcccagcaagaaaggccgtgttcaggaagctcttaattactactccatagagtccaccattgcccttatagtgtcctttgtcattaatatatttgtcacaactgtgtttgctaagggcttttatggtactgaaatagcaaatagcattggtcttgtaaatgcagggcagtaccttcaggagaagtatgggggtggactattcccaatcctgtatatatggggtattgggttgttagcagccggccagagtagcacaattactggtacatatgctggacagtttatcatggggggttttctgaatttaaggttgaaaaagtggataagggcattaataacacgaagttttgcaatcatcccaaccataatagttgctcttatatttgatacctcagaggaatcattagatgttctgaatgaatggcttaatgttctccagtcagttcaaatcccctttgcacttgttcccttgctttgcttggtgtccaaagaacagataatgggcagtttcagaattggccctgtcctcaagattatttcctggcttgtggctgctctagtgatagtgataaatggctatctattgctggaattcttctcctctgaagtgaatggggcagtgtttgccactgtagtgtgtgtattaacagctgcatatgttgcatttgtactttaccttatttcacgggccattacctatacaccgtggcaaagtttaacccgatcaaagacaggctaccacagagagttgagcagtcaaattccaattcctgaaaaccatggagtaggaaatgctttgcagctgaaggctttcacaagtacttttcctcgatttttttag

SEQ ID NO: 8970 - protein, 536 aa, Glycine max
MPPQQTQQPLLSEEQEETAYDSSEKVVVVGIDDHDGDLEAPPFSWRNLWLFTGPGFLMSIAFLDPGNLEGDLQSGAIAGYSLLWLLMWATAMGLIIQLLSARLGVATGRHLAELCREEYPTWARIVLWLMTEIALIGADIQEVIGSAIAIRILSNGVVPLWAGVVITAFDCFIFLFLENYGVRKLEAFFAVLIGVMALSFAWMFGEAKPNGVDVLVGILVPKLSSRTIQQAVGVVGCIIMPHNVYLHSALVQSRQVDPSKKGRVQEALNYYSIESTIALIVSFVINIFVTTVFAKGFYGTEIANSIGLVNAGQYLQEKYGGGLFPILYIWGIGLLAAGQSSTITGTYAGQFIMGGFLNLRLKKWIRALITRSFAIIPTIIVALIFDTSEESLDVLNEWLNVLQSVQIPFALVPLLCLVSKEQIMGSFRIGPVLKIISWLVAALVIVINGYLLLEFFSSEVNGAVFATVVCVLTAAYVAFVLYLISRAITYTPWQSLTRSKTGYHRELSSQIPIPENHGVGNALQLKAFTSTFPRFF

SEQ ID NO: 8971 - DNA, 1551 bp, Glycine max
  CDS (1)..(1551)
atgtctgggagccaccaagagcagccactgttagagaactcgttcatagaagaagacgagccgcaagaaacagcttatgattcgtcggagaagatagtggtggtcggagccgacgagtccgatgacgaggagaattgggggagagtgccccgattctcgtggaagaagctatggctgttcaccgggccgggctttctgatgagcatagcgtttctggaccctggaaacttagagggggaccttcaggcgggtgccattgcagggtactcattgttgtggcttctgatgtgggccacagcaatgggcctcctgatccagctcctctcggcacggctcggcgtggccacagggaagcacctcgccgagctctgccgagaggagtatcctccgtgggcccggatagtgctctggatcatggcggaactcgctctcattggctccgatattcaggaggttattgggagcgctattgcaatcaggattcttagtcatggggttgtgcccctttgggctggggttgtcattactgctcttgattgttttatttttctctttcttgagaactatggtgtgaggactttggaagctttttttgctattctcattggtgtgatggcaatctcgttcgcatggatgtttggtgaagccaagcccagtggcaaggaacttcttcttggagttttgattccaaaactcagctccaaaactatacagcaggctgttggagttgtggggtgccttattatgcctcacaatgtgttcttgcactctgctcttgttcagtcaaggcaggttgaccgcagcaagaaaggccgagttcaagaagctcttaattattactcgatagagtccacccttgcccttgtagtctcctttatcataaatatatttgtaacaacagtgtttgctaagggattttatggctctgaacttgcaaacagcataggccttgtaaatgcaggacagtatctagaggagacatatgggggtggactatttccaattttatacatatggggtattggattattagcagcaggccaaagtagcactattactgggacttatgcaggacaattcatcatgggaggttttctaaatttaaggttaaagaagtggatgagggcgttgattacccgaagttgtgcaataattccaactatgatagttgctcttttattcgatacctcggaggaatcgttagatgttttgaatgagtggcttaatgttcttcagtcagtccagatcccctttgcacttattcccttgctttgtctggtgtcaaaggagcagataatgggcactttcagaattggtgctgtcctcaagactacttcatggctcgtggctgctctggtgatagtgattaatggctatcttttgacggaattcttttcctctgaagtgaatggaccaatgattggcactgtagtgggtgtaataactgctgcatatgttgccttcgtagtataccttatttggcaagccatcacctatttaccttggcaaagtgtaacacaaccaaagacaattgctcattcagagggttga

SEQ ID NO: 8972 - protein, 516 aa, Glycine max
MSGSHQEQPLLENSFIEEDEPQETAYDSSEKIVVVGADESDDEENWGRVPRFSWKKLWLFTGPGFLMSIAFLDPGNLEGDLQAGAIAGYSLLWLLMWATAMGLLIQLLSARLGVATGKHLAELCREEYPPWARIVLWIMAELALIGSDIQEVIGSAIAIRILSHGVVPLWAGVVITALDCFIFLFLENYGVRTLEAFFAILIGVMAISFAWMFGEAKPSGKELLLGVLIPKLSSKTIQQAVGVVGCLIMPHNVFLHSALVQSRQVDRSKKGRVQEALNYYSIESTLALVVSFIINIFVTTVFAKGFYGSELANSIGLVNAGQYLEETYGGGLFPILYIWGIGLLAAGQSSTITGTYAGQFIMGGFLNLRLKKWMRALITRSCAIIPTMIVALLFDTSEESLDVLNEWLNVLQSVQIPFALIPLLCLVSKEQIMGTFRIGAVLKTTSWLVAALVIVINGYLLTEFFSSEVNGPMIGTVVGVITAAYVAFVVYLIWQAITYLPWQSVTQPKTIAHSEG

SEQ ID NO: 8973 - DNA, 1569 bp, Glycine max
  CDS (1)..(1569)
atgagtgctccatcgcgagaagaggagtccaaggaggaggagagggaccaggaaccgaaccggcttctacaagaagaagaagaagcagaatcatcatcagaagagggggagaagatcctggtggcggatttggagttcgacagggtggacgatgggagcgttcctcctcctttctcgtggaagaagctctggctgttcacggggcctgggttcttgatgagcatagcgtttttggatccagggaatctagagggggatctccaggctggggccatcgcgggctactcgcttctatggctcctcatgtgggccaccttcatgggcctcttgatccagcttctctccgccagggtcggcgtcgccacgggccgccacctcgccgagctctgcagggacgagtatcccaattgggcccgcctcgtgctctggttcatggccgagctcgccctgattggcgccgacattcaagaggttattggaagtgccattgccatccaaattctcagccgcggcttcttccctctctgggctggagttctaatcactgctgcagattgcttttactttctatttcttgagaactatggagtgaggaagttggaagctgcttttgcggttctcatcgctgtcatgggtctttcttttgcctggatgttcggtgatgctcaacctaatagaaaagagcttttaatgggtattttggttccaagacttggctcaaaaacaattcgtcaggctgtgggtgttgtgggttgtgtcattatgcctcacaatgtattcctgcattctgctttggttcaatcaaggaaggttgatcctaaaaagataggtcgggtacaggaggctctcaactactattcaattgagtcatcggctgcacttgcagtctccttcatgatcaatctttttgtcacaacagtttttgctaagggtttttatggaacaaaacaggcagatagcataggattggtcaatgcagggcagtatcttgaagagaagtatgggggaggagtcttccctattctttatatatgggggattgggttattggcagctgggcagagtagcaccatcactggcacatatgctgggcaattcataatggggggtttcctcaaccttcgtttaaagaaatggttgagggcattgatcactcgaagttttgcaattgtgccaactataattgtagctattgtttttaatagatccgaaggctcattggatgttttgaatgaatggctcaatgtgcttcagtcaatgcaaattccctttgctctaattcccctcctcacattggtctccaaagagcagatcatgggaacctttagggttgggcctgttcttgagagagtagcatggactgttgctggactgataataataattaatggatatctcttgttagatttcttcgtttctgaggtgaatggcatcttgcttggtcttttagcctgctcctgcacaacagcctatattgcgttcattgtatatttggtttcacagagcggtattcttccttctgcttgggttaatcgtcttcccaaaggattttcttcttgtgggaattaa

SEQ ID NO: 8974 - protein, 522 aa, Glycine max
MSAPSREEESKEEERDQEPNRLLQEEEEAESSSEEGEKILVADLEFDRVDDGSVPPPFSWKKLWLFTGPGFLMSIAFLDPGNLEGDLQAGAIAGYSLLWLLMWATFMGLLIQLLSARVGVATGRHLAELCRDEYPNWARLVLWFMAELALIGADIQEVIGSAIAIQILSRGFFPLWAGVLITAADCFYFLFLENYGVRKLEAAFAVLIAVMGLSFAWMFGDAQPNRKELLMGILVPRLGSKTIRQAVGVVGCVIMPHNVFLHSALVQSRKVDPKKIGRVQEALNYYSIESSAALAVSFMINLFVTTVFAKGFYGTKQADSIGLVNAGQYLEEKYGGGVFPILYIWGIGLLAAGQSSTITGTYAGQFIMGGFLNLRLKKWLRALITRSFAIVPTIIVAIVFNRSEGSLDVLNEWLNVLQSMQIPFALIPLLTLVSKEQIMGTFRVGPVLERVAWTVAGLIIIINGYLLLDFFVSEVNGILLGLLACSCTTAYIAFIVYLVSQSGILPSAWVNRLPKGFSSCGN

SEQ ID NO: 8975 - DNA, 1551 bp, Zea mays
  CDS (1)..(1551)
atggcgtcgagcgacctcgccgagagcctcctccccggcggcgggggcggagcctccgcctcacatgacgaatacgaggagcgcgcgtacgactccgaggacaagatctccatcgccgtctcggattccgacggtgaagacgacggcgcgccggcgtcgcgcccgcccttctcgtggcggaagctctggcgcttcacgggcccgggtttcctcatgtgcatcgcgttcctggacccgggcaatctggagggggacctacaggcgggcgccgcggcggggtaccagctgctgtggctgctcttgtgggcgacgatcatgggcgcgctgatgcagctgctctccgcccggctcggcgtggccacggggaagcacctcgccgagctctgccgccaggagtaccctccctgggccactcgcgcgctctgggccatgacggagctcgcgctcgtcggcgcagacatacaggaggtgattggcagcgcgattgccatcaagatcctctcggggggtgccgtaccgctctggggtggcgtcgtcatcaccgcgctcgattgcttcatctttctcttcctggagaattatggcgtgaggaaactcgaggcatttttcgctgtactgattgcaactatggctgtttcatttgcggttatgtttggtgaaacaaagcctagtggcaaggaacttctgatcggtttggtggttccaaaattgagttcaaagacaattaagcaagcggttggaattgtgggctgcatcatcatgcctcacaatgttttcttgcattcagcactagtgcagtccaggaagattgacacaaacaagaaatctcgtgttctagaagcagtttactactataacatcgagtcaattcttgcactcatcgtgtccttcttcattaacatctgtgtcacaactgtttttgccaaaggattttatgggtctaaacaggctgacagtataggtcttgagaatgctgggcagtacttacaagaaaaatatggaactgcattctttcccatcctctatatctgggctgttggtttgttagcatctgggcagagtagcacaattactggcacatatgcaggacagtttgttatgggaggtttccttaatcttcgattgaagaagtggctacgggcaatgattactcgaagttttgccattattccaactatgattgtggctttatttttcgatactgaagatcctactatggacattctgaatgaagcactcaatgttcttcagtccatacagattccgtttgctctaattcctctcatcaccctcgtttcaaaggagcaaatcatggggtcgttcgtaattggtcccatcaccaaagtgattagctggattgttacggtatttctgatgcttatcaacgggtatcttatactatctttctacattactgatgtccggggtgcattgcttcgctcaagcttgtgtgttgtgttggttgtttaccttgcattcatcgtctatcttattgtgcgaaatacttcgctgtattctcgcctttgctcatcaacgtcaaagagctcgtga

SEQ ID NO: 8976 - protein, 516 aa, Zea mays
MASSDLAESLLPGGGGGASASHDEYEERAYDSEDKISIAVSDSDGEDDGAPASRPPFSWRKLWRFTGPGFLMCIAFLDPGNLEGDLQAGAAAGYQLLWLLLWATIMGALMQLLSARLGVATGKHLAELCRQEYPPWATRALWAMTELALVGADIQEVIGSAIAIKILSGGAVPLWGGVVITALDCFIFLFLENYGVRKLEAFFAVLIATMAVSFAVMFGETKPSGKELLIGLVVPKLSSKTIKQAVGIVGCIIMPHNVFLHSALVQSRKIDTNKKSRVLEAVYYYNIESILALIVSFFINICVTTVFAKGFYGSKQADSIGLENAGQYLQEKYGTAFFPILYIWAVGLLASGQSSTITGTYAGQFVMGGFLNLRLKKWLRAMITRSFAIIPTMIVALFFDTEDPTMDILNEALNVLQSIQIPFALIPLITLVSKEQIMGSFVIGPITKVISWIVTVFLMLINGYLILSFYITDVRGALLRSSLCVVLVVYLAFIVYLIVRNTSLYSRLCSSTSKSS

SEQ ID NO: 8977 - DNA, 1629 bp, Zea mays
  CDS (1)..(1629)
atggagatcgagacggaagctccgggtagcgagaaggcgaggagctggagagctaatgcggcggcggcgcagcaagtctctaacacgacgaagcctgacggcggtgaccagccgatgaaggagcctgcatggaagaggttcctggctcatgttgggccagggtttatggtgtcattggcatacctggatcctggcaacttggagacggacctgcaagcaggagcgaaccaccgatacgagctcctctgggtgatcctcattggcctcatcttcgcgctcgtcatccagtcgctagctgctaatctcggagtggtgacagggaggcatctcgccgagatatgcaagagcgagtaccccaagttcgtgaggatttgcctgtggatcctcgcggaggtcgcggtgatcgccgccgatatcccggaagttatagggacagccttcgctttcaacctcttgttccacatccccgtgtgggtgggggtcctcatcaccggctccagcactcttctgctcctaggcctacagagatacggggtgcggaagctggagttcctgatctcgatgctggtgttcgtcatggcggcgtgcttcttcggggagctgagcttcgtgaagccgccggcggtggacgtggtcaaggggctcttcatccccaggctcaagggcgacggcgccaccgcggacgccattgcgctcctcggagctctcgtcatgccgcacaacctgttcctgcactccgcgctggtgctgtcgaggaagacgccgtcgtcggtgagggggatcaaggacgcgtgccggttcttcctctacgagagcggcttcgcgctgttcgtggcgctgctcatcaacatcgccgtcatctccgtctccggcaccgtctgcttctccggcaacctgtcgccggaggacgccggcaagtgcagcgacctctcgctcgactcttcctccttcctcctcaagaacgtgctgggcaggtcgagttcgatcgtgtacggcgtggcgctcttggcgtctgggcagagctccaccataacaggcacctactccggccagtacatcatgcagggttttctggacatcaggatgaagaagtggctgaggaacctgatgacacgctgcatcgccatcgcgcccagcctagtcgtctccatcatcggcggctccagtggcgccggccgtctcatcatcatcgcttcgatgatcctgtccttcgagctgccgttcgctctcatcccgctcctcaagttcagcagcagcagtagcaagatggggccccacaagaactccatctatatcatggtgttctcgtggctgctggggctgatgatcatcggcatcaacatgtacttcctgagcaccagcttcgtggggtggctcgtccacaactcgctccccaagtacgccaacgtgctcgtcggcctgctcgtcttccccctcatgctcgtctacgtcgtcgccgtcatctacctcaccttcaggaaggacaccgtcgtcaccttcgtcgccgactccgcccagctggccgtggtcgacgccgagaaggccaacaaggcgacggccgccggcgacgacgatgaccggcccgtgccgttccggcaggacctggcggacatccctctgccggagtag

SEQ ID NO: 8978 - protein, 542 aa, Zea mays
MEIETEAPGSEKARSWRANAAAAQQVSNTTKPDGGDQPMKEPAWKRFLAHVGPGFMVSLAYLDPGNLETDLQAGANHRYELLWVILIGLIFALVIQSLAANLGVVTGRHLAEICKSEYPKFVRICLWILAEVAVIAADIPEVIGTAFAFNLLFHIPVWVGVLITGSSTLLLLGLQRYGVRKLEFLISMLVFVMAACFFGELSFVKPPAVDVVKGLFIPRLKGDGATADAIALLGALVMPHNLFLHSALVLSRKTPSSVRGIKDACRFFLYESGFALFVALLINIAVISVSGTVCFSGNLSPEDAGKCSDLSLDSSSFLLKNVLGRSSSIVYGVALLASGQSSTITGTYSGQYIMQGFLDIRMKKWLRNLMTRCIAIAPSLVVSIIGGSSGAGRLIIIASMILSFELPFALIPLLKFSSSSSKMGPHKNSIYIMVFSWLLGLMIIGINMYFLSTSFVGWLVHNSLPKYANVLVGLLVFPLMLVYVVAVIYLTFRKDTVVTFVADSAQLAVVDAEKANKATAAGDDDDRPVPFRQDLADIPLPE

SEQ ID NO: 8979 - DNA, 1551 bp, Zea mays
  CDS (1)..(1551)
atggcgtcgagcgacctcgccgagagcctcctccccggcggcgggggcggagcctccgcctcacatgacgaatacgaggagcgcgcgtacgactccgaggacaagatctccatcgccgtgtcggattccgacggcgaagacgacggcacgccggcgtcgcgcccgcccttctcgtggcggaagctctggcgcttcacgggcccgggttttctcatgtgcatcgcgttcctggacccgggcaatctggagggggacctacaggcgggcgccgcggcggggtaccagctgctgtggctgctcttgtgggcaacgatcatgggcgcgctgatgcagctgctctccgcccggctaggcgtggccacggggaagcacctcgccgagctctgccgccaggagtaccctccctgggccactcgcgcgctctgggccatgacggagctcgcgctcgtcggcgcagacatacaggaggtgattggcagcgcgattgccatcaagatcctctcggggggtgccataccgctctggggtggcgtcgtcatcaccgcgctcgattgcttcatctttctcttcctggagaattatggcgtgaggaaactcgaggcatttttcgctgtactgattgcaactatggctgtttcatttgcggttatgtttggtgaaacaaagcctagtggcaaggaacttctgatcggtttggtggttccaaaattgagttcaaagacaattaagcaagcggttggaattgtgggctgcatcatcatgcctcacaatgttttcttgcattcagcactagtgcagtccaggaagattgacacaaacaagaaatctcgtgttctagaagcagtttactactataacatcgagtcaattcttgcactcatcgtgtccttcttcattaacatctgtgtcacaactgtttttgccaaaggattttatgggtctaaacaggctgacagtataggtcttgagaatgctgggcagtacttacaagaaaaatatggaactgcattctttcccatcctctatatctgggctgttggtttgttagcatctgggcagagtagcacaattactggcacatatgcaggacagtttgttatgggaggtttccttaatcttcgattgaagaagtggctacgggcaatgattactcgaagttttgccattattccaactatgattgtggctttatttttcgatactgaagatcctactatggacattctgaatgaagcactcaatgttcttcagtccatacagattccgtttgctctaattcctctcatcaccctcgtttcaaaggagcaaatcatggggtcgttcgtaattggtcccatcaccaaagtgattagctggattgttacggtatttctgatgcttatcaacgggtatcttatactatctttctacattactgatgtccggggtgcattgcttcgctcaagcttgtgtgttgtgttggttgtttaccttgcattcatcgtctatcttattgtgcgaaatacttcgctgtattctcgcctttgctcatcaacgtcaaagagctcgtga

SEQ ID NO: 8980 - protein, 516 aa, Zea mays
MASSDLAESLLPGGGGGASASHDEYEERAYDSEDKISIAVSDSDGEDDGTPASRPPFSWRKLWRFTGPGFLMCIAFLDPGNLEGDLQAGAAAGYQLLWLLLWATIMGALMQLLSARLGVATGKHLAELCRQEYPPWATRALWAMTELALVGADIQEVIGSAIAIKILSGGAIPLWGGVVITALDCFIFLFLENYGVRKLEAFFAVLIATMAVSFAVMFGETKPSGKELLIGLVVPKLSSKTIKQAVGIVGCIIMPHNVFLHSALVQSRKIDTNKKSRVLEAVYYYNIESILALIVSFFINICVTTVFAKGFYGSKQADSIGLENAGQYLQEKYGTAFFPILYIWAVGLLASGQSSTITGTYAGQFVMGGFLNLRLKKWLRAMITRSFAIIPTMIVALFFDTEDPTMDILNEALNVLQSIQIPFALIPLITLVSKEQIMGSFVIGPITKVISWIVTVFLMLINGYLILSFYITDVRGALLRSSLCVVLVVYLAFIVYLIVRNTSLYSRLCSSTSKSS

SEQ ID NO: 8981 - DNA, 1653 bp, Zea mays
  CDS (1)..(1653)
atgagtgtcccaggtcaatgctcatcccagccacaatttatcaccagcgttgggaggagtaaccgctccaatggccccggcactcctcttatcgaaagcatagatgttgatcaaattgttattccagagaaaaacagttggaagaacttattctcatacatagggcctggatttctcgtctcaattgcatatattgatcctggaaactttgagacggatctacaggctggagcacagtacaaatatgagcttctttggatcatacttgttgcatcctgtgctgctcttattattcaatcacttgcagccaggctaggggttgtgacagggaaacatcttgcagagcattgcagggctgagtatcccaaggtcacaaattttgtcttatggattcttgcagaacttgctgttgttgcatgtgacattcctgaagtaattggaactgcttttgctctaaacatgctgttcagaatcccagtatggtgtggtgttctaataactggactcagcactctaatgctcttattgctgcagcaatatggggtccgtaagctagaatttctgattgcatttctggtgttcttaatagcaacatgtttcttagttgaacttgggtattctaaaccaaatgctccagaagttgttaggggcctttttgttcctgaacttaaaggaaatggagctacaggccttgctatctcattacttggtgctatggtgatgccgcacaatctttttctgcactcagcattagtattgtcaagaaaagtgccacggtctgttcatgggattaaggaggcctgcagattctatacgattgaaagtgcatttgcccttacagttgcttttctcatcaacatatctatcatatctgtcagtggttctgtctgtggttcaggtaatttaaacccagaagatcaagcaaattgcagtgatctggacctaaataaggcttcatttttgttaaagaatgtccttggaaactggagctcaaagttgtttgcagttgctttgttggcatctggtcagagttctacaattacggggacatatgctggacaatatgtcatgcaggggtttttagatcttcggatgaaaccctggatacgcaatcttgtcacgaggtccttggctatcctgccaagtttgatcgtgtcaattattggtggttcttcagcagctggccagttgattatcattgcatcgatgatactgtcatttgaactcccttttgctttagttccactccttaaattcaccagcagcaaaacaaagatggggcagcatacaaattcaatattcactgctgtgctgacatggatgatcggctcgtttattgttgtcatcaacacctactttctgataacaagctttgtgaaattgctcgtccagagcgggctgaccaccatttctcaagtattttccggtattttcgggtttttgggcatgctgatttacatagttgcgatcctatacctcgtctttaggaggaacaggaagtccacccagccattgctggagagcgatgctgagcttgcagtatcgggtagcagtgctgatgccggagcagaatgctcgctgggccatttgccccgtgaggacatctccagcatgcaacttccgcagcagcgttcagcttctgatctagattag

SEQ ID NO: 8982 - protein, 550 aa, Zea mays
MSVPGQCSSQPQFITSVGRSNRSNGPGTPLIESIDVDQIVIPEKNSWKNLFSYIGPGFLVSIAYIDPGNFETDLQAGAQYKYELLWIILVASCAALIIQSLAARLGVVTGKHLAEHCRAEYPKVTNFVLWILAELAVVACDIPEVIGTAFALNMLFRIPVWCGVLITGLSTLMLLLLQQYGVRKLEFLIAFLVFLIATCFLVELGYSKPNAPEVVRGLFVPELKGNGATGLAISLLGAMVMPHNLFLHSALVLSRKVPRSVHGIKEACRFYTIESAFALTVAFLINISIISVSGSVCGSGNLNPEDQANCSDLDLNKASFLLKNVLGNWSSKLFAVALLASGQSSTITGTYAGQYVMQGFLDLRMKPWIRNLVTRSLAILPSLIVSIIGGSSAAGQLIIIASMILSFELPFALVPLLKFTSSKTKMGQHTNSIFTAVLTWMIGSFIVVINTYFLITSFVKLLVQSGLTTISQVFSGIFGFLGMLIYIVAILYLVFRRNRKSTQPLLESDAELAVSGSSADAGAECSLGHLPREDISSMQLPQQRSASDLD

SEQ ID NO: 8983 - DNA, 25 bp, Artificial sequence
  primer
atgcgatcttatatgcagattcttc

SEQ ID NO: 8984 - DNA, 25 bp, Artificial sequence
  primer
ttaaaaatggatgtcggcacctaag

SEQ ID NO: 8985 - protein, 651 aa, Artificial sequence
  consensus sequence
  Variant (3)..(9): Xaa in position 3 to 9 is any amino acid
  Variant (11)..(11): Xaa in position 11 is any amino acid
  Variant (16)..(22): Xaa in position 16 to 22 is any amino acid
  Variant (23)..(23): Xaa in position 23 is any or no amino acid
  Variant (25)..(28): Xaa in position 25 to 28 is any amino acid
  Variant (30)..(30): Xaa in position 30 is any amino acid
  Variant (33)..(41): Xaa in position 33 to 41 is any amino acid
  Variant (43)..(45): Xaa in position 43 to 45 is any amino acid
  Variant (47)..(51): Xaa in position 47 to 51 is any amino acid
  Variant (54)..(55): Xaa in position 54 to 55 is any amino acid
  Variant (58)..(59): Xaa in position 58 to 59 is any amino acid
  Variant (61)..(76): Xaa in position 61 to 76 is any amino acid
  Variant (77)..(81): Xaa in position 77 to 81 is any or no amino acid
  Variant (83)..(85): Xaa in position 83 to 85 is any amino acid
  Variant (87)..(90): Xaa in position 87 to 90 is any amino acid
  Variant (92)..(92): Xaa in position 92 is any amino acid
  Variant (94)..(95): Xaa in position 94 to 95 is any amino acid
  Variant (97)..(98): Xaa in position 97 to 98 is any amino acid
  Variant (100)..(100): Xaa in position 100 is any amino acid
  Variant (102)..(106): Xaa in position 102 to 106 is any amino acid
  Variant (108)..(110): Xaa in position 108 to 110 is any amino acid
  Variant (111)..(112): Xaa in position 111 to 112 is any or no amino acid
  Variant (114)..(116): Xaa in position 114 to 116 is any amino acid
  Variant (118)..(120): Xaa in position 118 to 120 is any amino acid
  Variant (122)..(128): Xaa in position 122 to 128 is any amino acid
  Variant (130)..(134): Xaa in position 130 to 134 is any amino acid
  Variant (135)..(142): Xaa in position 135 to 142 is any or no amino acid
  Variant (144)..(145): Xaa in position 144 to 145 is any amino acid
  Variant (147)..(151): Xaa in position 147 to 151 is any amino acid
  Variant (153)..(159): Xaa in position 153 to 159 is any amino acid
  Variant (161)..(175): Xaa in position 161 to 175 is any amino acid
  Variant (176)..(182): Xaa in position 176 to 182 is any or no amino acid
  Variant (184)..(185): Xaa in position 184 to 185 is any amino acid
  Variant (186)..(186): Xaa in position 186 is any or no amino acid
  Variant (188)..(196): Xaa in position 188 to 196 is any amino acid
  Variant (197)..(207): Xaa in position 197 to 207 is any or no amino acid
  Variant (209)..(212): Xaa in position 209 to 212 is any amino acid
  Variant (215)..(216): Xaa in position 215 to 216 is any amino acid
  Variant (220)..(222): Xaa in position 220 to 222 is any amino acid
  Variant (226)..(230): Xaa in position 226 to 230 is any amino acid
  Variant (232)..(241): Xaa in position 232 to 241 is any amino acid
  Variant (242)..(326): Xaa in position 242 to 326 is any or no amino acid
  Variant (328)..(330): Xaa in position 328 to 330 is any amino acid
  Variant (332)..(341): Xaa in position 332 to 341 is any amino acid
  Variant (342)..(390): Xaa in position 342 to 390 is any or no amino acid
  Variant (392)..(394): Xaa in position 392 to 394 is any amino acid
  Variant (397)..(398): Xaa in position 397 to 398 is any amino acid
  Variant (400)..(401): Xaa in position 400 to 401 is any amino acid
  Variant (403)..(406): Xaa in position 403 to 406 is any amino acid
  Variant (408)..(409): Xaa in position 408 to 409 is any amino acid
  Variant (412)..(413): Xaa in position 412 to 413 is any amino acid
  Variant (415)..(415): Xaa in position 415 is any amino acid
  Variant (418)..(421): Xaa in position 418 to 421 is any amino acid
  Variant (422)..(426): Xaa in position 422 to 426 is any or no amino acid
  Variant (428)..(430): Xaa in position 428 to 430 is any amino acid
  Variant (432)..(433): Xaa in position 432 to 433 is any amino acid
  Variant (434)..(437): Xaa in position 434 to 437 is any or no amino acid
  Variant (439)..(457): Xaa in position 439 to 457 is any amino acid
  Variant (458)..(466): Xaa in position 458 to 466 is any or no amino acid
  Variant (468)..(468): Xaa in position 468 is any amino acid
  Variant (471)..(473): Xaa in position 471 to 473 is any amino acid
  Variant (475)..(478): Xaa in position 475 to 478 is any amino acid
  Variant (481)..(486): Xaa in position 481 to 486 is any amino acid
  Variant (487)..(489): Xaa in position 487 to 489 is any or no amino acid
  Variant (492)..(511): Xaa in position 492 to 511 is any amino acid
  Variant (512)..(650): Xaa in position 512 to 650 is any or no amino acid
GPXXXXXXXYXDPGNXXXXXXXXGXXXXYXLLXXXXXXXXXAXXXQXXXXXLGXXTGXXLXXXXXXXXXXXXXXXXXXXXXWXXXEXXXXAXDXXEXXGXAXXXXXLXXXXXPXXXGXXXTXXXXXXXLXXXXXXXXXXXXXRXXEXXXXXLXXXXXXXFXXXXXXXXXXXXXXXXXXXXXXGXXXPXXXXXXXXXXXXXXXXXXXXAXXXXGAXXMPHXXXLHSXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXNXXXXXXXXXXXXXXXXXXXXXXXXXXXXXXXXXXXXXXXXXXXXXXXXXXXXXXXXXXXFXXXLLXXGXXSXXXXTXXGQXXMXGFXXXXXXXXXRXXXTXXXXXXPXXXXXXXXXXXXXXXXXXXXXXXXXXXXVXLSXXXPXXXXPLXXXXXXXXXMGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 8986 - protein, 15 aa, Artificial sequence
  protein pattern
  Variant (3)..(3): Xaa in position 3 is any amino acid
  Variant (4)..(4): Xaa in position 4 is Ile or Val
  Variant (8)..(8): Xaa in position 8 is any amino acid
  Variant (9)..(10): Xaa in position 9 to 10 is any or no amino acid
  Variant (12)..(12): Xaa in position 12 is any amino acid
  Variant (13)..(14): Xaa in position 13 to 14 is any or no amino acid
GAXXMPHXXXLXXXL

SEQ ID NO: 8987 - protein, 15 aa, Artificial sequence
  protein pattern
  Variant (3)..(3): Xaa in position 3 is Ala or Gly
  Variant (4)..(4): Xaa in position 4 is any amino acid
  Variant (5)..(5): Xaa in position 5 is Ile, Leu, Met or Val
  Variant (6)..(6): Xaa in position 6 is Ala, Ile or Val
  Variant (7)..(7): Xaa in position 7 is Ala or Ser
  Variant (8)..(8): Xaa in position 8 is Ile, Leu or Val
  Variant (9)..(9): Xaa in position 9 is Ala, Gly or Ser
  Variant (11)..(11): Xaa in position 11 is Ile, Leu, Met or Val
GPXXXXXXXYXDPGN

SEQ ID NO: 8988 - protein, 23 aa, Artificial sequence
  protein pattern
  Variant (2)..(2): Xaa in position 2 is any amino acid
  Variant (3)..(3): Xaa in position 3 is Ala, Cys, Ser or Thr
  Variant (4)..(4): Xaa in position 4 is Gly or Ser
  Variant (5)..(6): Xaa in position 5 to 6 is any amino acid
  Variant (7)..(7): Xaa in position 7 is Ala, Ser or Thr
  Variant (8)..(8): Xaa in position 8 is Ala, Gly, Ser or Thr
  Variant (9)..(10): Xaa in position 9 to 10 is any amino acid
  Variant (11)..(11): Xaa in position 11 is Ala, Cys, Gly, Ser or Thr
  Variant (13)..(13): Xaa in position 13 is any amino acid
  Variant (14)..(14): Xaa in position 14 is Ala, Ser or Thr
  Variant (16)..(16): Xaa in position 16 is Asp, Glu, Gln or Ser
  Variant (17)..(17): Xaa in position 17 is any amino acid
  Variant (18)..(18): Xaa in position 18 is Ile, Leu or Val
  Variant (19)..(20): Xaa in position 19 to 20 is any amino acid
  Variant (22)..(22): Xaa in position 22 is any amino acid
  Variant (23)..(23): Xaa in position 23 is Ile, Leu, Met or Val
LXXXXXXXXXXTXXGXXXXXGXX

SEQ ID NO: 8989 - protein, 22 aa, Artificial sequence
  protein pattern
  Variant (2)..(2): Xaa in position 2 is Ala, Ile, Leu or Val
  Variant (3)..(3): Xaa in position 3 is any amino acid
  Variant (4)..(4): Xaa in position 4 is Ala, Ile, Leu or Val
  Variant (5)..(5): Xaa in position 5 is any amino acid
  Variant (6)..(6): Xaa in position 6 is Ala or Gly
  Variant (7)..(7): Xaa in position 7 is Ala, Cys, Ser or Thr
  Variant (9)..(9): Xaa in position 9 is Ile, Leu or Val
  Variant (10)..(10): Xaa in position 10 is any amino acid
  Variant (12)..(12): Xaa in position 12 is Phe, Leu or Val
  Variant (13)..(13): Xaa in position 13 is Ile, Leu or Val
  Variant (15)..(15): Xaa in position 15 is Ala, Cys, Gly, Ser or Thr
  Variant (17)..(18): Xaa in position 17 to 18 is any amino acid
  Variant (19)..(21): Xaa in position 19 to 21 is any or no amino acid
EXXXXXXDXXEXXGXAXXXXXL

SEQ ID NO: 8990 - protein, 16 aa, Artificial sequence
  protein pattern
  Variant (2)..(2): Xaa in position 2 is any amino acid
  Variant (3)..(3): Xaa in position 3 is Leu or Met
  Variant (4)..(4): Xaa in position 4 is Ala, Cys or Ser
  Variant (5)..(6): Xaa in position 5 to 6 is any amino acid
  Variant (9)..(9): Xaa in position 9 is any amino acid
  Variant (10)..(10): Xaa in position 10 is Ala, Gly, Ile or Val
  Variant (11)..(14): Xaa in position 11 to 14 is any amino acid
  Variant (16)..(16): Xaa in position 16 is Ala, Pro or Ser
QXXXXXLGXXXXXXLX

SEQ ID NO: 8991 - DNA, 486 bp, Saccharomyces cerevisiae
  CDS (1)..(486)
atgaagatcagtcaatttggctctttagctttcgccccaattgtgctactacaactgttcattgttcaagcgcaacttctcacagattcaaatgctcaggatttgaatactgcccttggacagaaagtgcaatacacctttcttgacactggaaattctaacgatcaactacttcatcttccaagcaccacctcttccagcattattactggttcattagctgctgctaatttcaccggttcttcatcatcgtcgtctataccaaaagtcacttccagcgtcataacatctataaattaccaatcctcaaattctacggtagtcacccagttcacgccattgccttcttcgtcgagaaatgaaacaaaaagctctcaaacaactaatactataagttcaagtacaagcacaggaggtgtaggttcagtcaagccatgtctttacttcgttttaatgttagaaacaatcgcttatttgttttcttaa

SEQ ID NO: 8992 - protein, 161 aa, Saccharomyces cerevisiae
MKISQFGSLAFAPIVLLQLFIVQAQLLTDSNAQDLNTALGQKVQYTFLDTGNSNDQLLHLPSTTSSSIITGSLAAANFTGSSSSSSIPKVTSSVITSINYQSSNSTVVTQFTPLPSSSRNETKSSQTTNTISSSTSTGGVGSVKPCLYFVLMLETIAYLFS

SEQ ID NO: 8993 - DNA, 25 bp, Artificial sequence
  primer
atgaagatcagtcaatttggctctt

SEQ ID NO: 8994 - DNA, 27 bp, Artificial sequence
  primer
ttaagaaaacaaataagcgattgtttc

SEQ ID NO: 8995 - DNA, 327 bp, Saccharomyces cerevisiae
  CDS (1)..(327)
atggatatgcttcataataaatgtagtgatgctatcaaaagcacctccaatagcaatttgagtaatgaggtagacaaacaaaaattgcaatacgatgacctcgggaacaccggattttctgaactatttgagatggaatctcaagataataatgatagcatagaggatttcttgttctttaatataaatttaacccaggaggttgagttcgagaaccaaagacaatatgagcacacgaaaaagacaaagaagcataacccattctatgtaccgtcagaggtagtgcgagagatggtcaagaaacacgcattgaatggcagaatatag

SEQ ID NO: 8996 - protein, 108 aa, Saccharomyces cerevisiae
MDMLHNKCSDAIKSTSNSNLSNEVDKQKLQYDDLGNTGFSELFEMESQDNNDSIEDFLFFNINLTQEVEFENQRQYEHTKKTKKHNPFYVPSEVVREMVKKHALNGRI

SEQ ID NO: 8997 - DNA, 27 bp, Artificial sequence
  primer
atggatatgcttcataataaatgtagt

SEQ ID NO: 8998 - DNA, 25 bp, Artificial sequence
  primer
ctatattctgccattcaatgcgtgt

SEQ ID NO: 8999 - DNA, 1410 bp, Saccharomyces cerevisiae
  CDS (1)..(1410)
atgccttacactctatccgacgctcatcataagttgatcacctctcatttggtggacaccgaccctgaagtggactccattatcaaggatgaaattgaaagacaaaagcactccatcgatttgattgcttctgaaaatttcacctcaacctccgttttcgatgcccttggaactccattgtccaacaaatactctgaaggttatccaggtgctcgttactacggtggtaatgaacacattgacagaatggaaattctatgtcaacaaagagctttgaaagctttccatgttactccagacaaatggggtgttaacgtccaaactttatctggttctcctgctaacttgcaggtttatcaagctattatgaagcctcatgaaagattgatgggtctatacctaccagatggtggtcatttgtctcacggttacgctactgaaaacagaaaaatttctgctgtttccacatacttcgaatctttcccatacagagttaacccagaaaccggtattatcgactacgatactttagaaaagaacgccatcctatatagaccaaaggttcttgttgctggtacttcagcatactgtcgtttaattgactacaagagaatgagagaaatcgccgacaaatgtggtgcttacttgatggtagacatggcccacatttctggtttgatcgccgcaggtgtcatcccatctcctttcgaatacgctgatatcgttaccaccaccactcacaagtctttgagaggtccacgtggtgctatgattttcttcagaagaggtgtgagatctatcaaccctaagaccggtaaggaagttctatacgacttggaaaacccaattaacttctctgttttcccaggtcaccaaggtggtccacacaaccataccattgctgctttggccactgctttgaagcaagctgccactccagaattcaaggaataccaaactcaagtcttgaagaatgctaaggctttggaaagtgaatttaagaacttgggctacagattagtttccaacggtaccgattctcacatggttctagtatccttgagagaaaagggtgttgatggtgctcgtgttgaatacatttgtgaaaagattaacattgctttgaacaaaaactctattccaggtgacaaatctgctttggttccaggtggtgtccgtattggggctccagccatgaccactagaggaatgggtgaagaagatttccacagaattgttcaatacattaacaaggctgtagaattcgctcaacaagttcaacaaagcttgccaaaggatgcttgtagattaaaggacttcaaagccaaggtcgacgaaggctctgatgttttgaacacctggaaaaaggaaatttacgactgggctggcgaatacccattggctgtgtaa

SEQ ID NO: 9000 - protein, 469 aa, Saccharomyces cerevisiae
MPYTLSDAHHKLITSHLVDTDPEVDSIIKDEIERQKHSIDLIASENFTSTSVFDALGTPLSNKYSEGYPGARYYGGNEHIDRMEILCQQRALKAFHVTPDKWGVNVQTLSGSPANLQVYQAIMKPHERLMGLYLPDGGHLSHGYATENRKISAVSTYFESFPYRVNPETGIIDYDTLEKNAILYRPKVLVAGTSAYCRLIDYKRMREIADKCGAYLMVDMAHISGLIAAGVIPSPFEYADIVTTTTHKSLRGPRGAMIFFRRGVRSINPKTGKEVLYDLENPINFSVFPGHQGGPHNHTIAALATALKQAATPEFKEYQTQVLKNAKALESEFKNLGYRLVSNGTDSHMVLVSLREKGVDGARVEYICEKINIALNKNSIPGDKSALVPGGVRIGAPAMTTRGMGEEDFHRIVQYINKAVEFAQQVQQSLPKDACRLKDFKAKVDEGSDVLNTWKKEIYDWAGEYPLAV

SEQ ID NO: 9001 - DNA, 1302 bp, Bradyrhizobium sp. ORS278
  CDS (1)..(1302): transl_table=11
atgaccgcttctgccaagcccgtatcgtcagtcgattccttcttttccgccaccctggccgaggctgatcccgagatcgccgccgccatcaggggcgaactcggtcggcaacggcacgaaatcgagctgatcgcttcggaaaacatcgtcagccgggcggtcctggaggcccagggctcggtgatgaccaacaagtatgccgagggctatccgggcgctcggtattacggcggctgcgaatgggtcgacgtcgccgagaacctcgcgatcgaccgcgccaagaagctgttcggcgccaatttcgccaacgtccagccgaactcgggcagccagatgaatcaggccgtgttcctggcgctgctgcagccgggcgacaccttcatgggcctcgacctcgccgcgggcggtcatctcacccacggttcgccggtcaatatgtccggcaagtggttcaaggccgcgcattacaccgtgcgccgcgacgaccacctcatcgacatggatgcggtggccaagcaggccgaagaggtgaagccgaagctgatcatcgccggcggcagtgcctattcgcgcccgtgggacttcaagcgcttccgcgagatcgcggacagcgtcggcgcctatctgctggtcgacatggcccacttcgccggcctcgtcgctggtggcgtgcatgcctcgccggtgccttacgctcacatcaccaccaccacgacccataagtcgctgcgcggtccgcgcggcggcctgatgctctggaatgacgagcagttcaccaagaagttcaactcggcgatcttcccgggacttcagggcggtccgctcatgcacgtgatcgcggccaaggcggtggcgttcgccgaggcgctgcggccggagttcaaggcctacgcgaagaacgtcgtggagaatgcgaaggcgctggcggaatcgctgcgcgcgcaaggcttcgacatcgtctccggcggcaccgacaaccacctgatgctggtcgatcttcggcccaagggcctgaagggcaacgtgtccgagaaggcgctcgtccgcgccgccatcacctgcaacaagaacggcattccgttcgaccccgagaagccgttcgtcacctccggcctgcgcctgggcacgccggcagcgaccacccgcggcttcggcgtcgctgaattccagcaggtcggcagtctgatcgccgaggtgctgaacgcgatcgcgcagggccctgacggcagcgcgccgctggtcgaagccgcggtcaaggagaaggtgaaggcgctgaccgaccggttcccgatctatcagtaa

SEQ ID NO: 9002 - protein, 433 aa, Bradyrhizobium sp. ORS278
MTASAKPVSSVDSFFSATLAEADPEIAAAIRGELGRQRHEIELIASENIVSRAVLEAQGSVMTNKYAEGYPGARYYGGCEWVDVAENLAIDRAKKLFGANFANVQPNSGSQMNQAVFLALLQPGDTFMGLDLAAGGHLTHGSPVNMSGKWFKAAHYTVRRDDHLIDMDAVAKQAEEVKPKLIIAGGSAYSRPWDFKRFREIADSVGAYLLVDMAHFAGLVAGGVHASPVPYAHITTTTTHKSLRGPRGGLMLWNDEQFTKKFNSAIFPGLQGGPLMHVIAAKAVAFAEALRPEFKAYAKNVVENAKALAESLRAQGFDIVSGGTDNHLMLVDLRPKGLKGNVSEKALVRAAITCNKNGIPFDPEKPFVTSGLRLGTPAATTRGFGVAEFQQVGSLIAEVLNAIAQGPDGSAPLVEAAVKEKVKALTDRFPIYQ

SEQ ID NO: 9003 - DNA, 1254 bp, Dichelobacter nodosus VCS1703A
  CDS (1)..(1254): transl_table=11
atgtttacaaaagcaatgaacatcgctgattttgataatgaattagcccaagcaatcgctgatgaagccactcgtcaggaagatcatattgaattgatcgcttctgaaaactattgcagtccgcgcgtcatggaagcacaaggcagttgtttaaccaataaatatgccgaaggttatccgcggaaacgttattatggtggctgtgaatacgttgatatcgttgaagaattagcaattgcgcgcgttaaaatgttatttgctgctgattatgccaacgtacaaccccacagcggttctcaagccaatgctgccgtatttttagctttattagaaccaggtgataccgttttaggtatggatttggatcacggcggacatttaacccacggttcaaaagtcagcttttctggaaaaacttataattccatcggctacggcattgatgataaaggcttaattgattatgacgctgtggcgcaattagccgaaaaacatcgtcctaaaatgattattgccggcttttctgcttattcacaagttcttgatttccaacggttccgcgaaattgccgacagcgttggcgcttatttaatggtcgatatggcgcacgttgctggattagtagcagcaggtttatatcccaatcctgttcctttcgctgatgtggtcacttcaaccacgcataaaacattgcgcggcccgcgcggcggcatcattttagccaaagccaatcccaccattgaaaagaaattaaattctgccattttcccaggatctcaaggtggcccgttaatgcatgtgattgcggcaaaagccgttgcgtttaaagaagcgctggaaccgtctttccaaaaatatcaagaacaagttgtggaaaacgcgaaaaccatggcaaaagtatttatcgcgcgcggttacgatatcgtctccggcggcacgcaaaaccacttaatgctggtgagtttgatcaataaaggattaaccggtaaagcggcaaacgatgcattatctcgcgctcatattacggtaaacaaaaactccgtgcccaacgatccgcaatcgcctttcgtcaccagcggaatccgcattggtacaccggcaattaccacacgcggttttggcgttaatgaagtgaaaaaagttgccaactggatttgcgacgttttagatgacattgacaatgaagaagtcattcttaacgtgcgcaataaagtagcggaattgtgcgctgaatttccagtttatggtcaataa

SEQ ID NO: 9004 - protein, 417 aa, Dichelobacter nodosus VCS1703A
MFTKAMNIADFDNELAQAIADEATRQEDHIELIASENYCSPRVMEAQGSCLTNKYAEGYPRKRYYGGCEYVDIVEELAIARVKMLFAADYANVQPHSGSQANAAVFLALLEPGDTVLGMDLDHGGHLTHGSKVSFSGKTYNSIGYGIDDKGLIDYDAVAQLAEKHRPKMIIAGFSAYSQVLDFQRFREIADSVGAYLMVDMAHVAGLVAAGLYPNPVPFADVVTSTTHKTLRGPRGGIILAKANPTIEKKLNSAIFPGSQGGPLMHVIAAKAVAFKEALEPSFQKYQEQVVENAKTMAKVFIARGYDIVSGGTQNHLMLVSLINKGLTGKAANDALSRAHITVNKNSVPNDPQSPFVTSGIRIGTPAITTRGFGVNEVKKVANWICDVLDDIDNEEVILNVRNKVAELCAEFPVYGQ

SEQ ID NO: 9005 - DNA, 1248 bp, Dehalococcoides sp. BAV1
  CDS (1)..(1248): transl_table=11
atgagctttttaaagacctcggatccggcagtttataatgccataatgcaggaaaccacccgcctgaaagaaacaattgacctcatagcttcagaaaactataccagcaaggctgttttggaagctcaaggttcagttttcaccaataaatacgccgaaggataccccggcaaacgatattacgcaggctgtgaatacgcagacgccgtagaggaactggctatagacagggcaaagaccctgttccatgccgaacatgccaacgttcagccccattctggggctcaggctaatatggccgcctatttcgccatggtaaaacccggtgataccataatgggacttaccctttcccacggcggacacctgacccatggttcaaaggtcaattttaccggcaagctttaccatgtaattgagtacgggctgaatgccgaaaccgagcggattgactatgataatctggaaaaactggctatggaacatcgcccccgcatgattgtgaccggtgcttcagcctatccccgaatactggattttgaacgttttagggctatctgtgacaaggtggacgccaaactgatggtggatatcgcccatattgccggtctggtagccgccgggcttcatccttcaccagtgccatacgctgatgtggttacctctaccagccataaaaccctgcgcggcccgcgcggcggctttatactctgcaaagagcaatatgccaaggctattgaccaggcagtattcccggtaatgcagggcggacctcttatgcaggtagttgccgctaaagcagtggcttttcaggaagccatgcagcccggttttgtcacttaccagaaaaaaactcttgagaatacccaggtaatggctgaggaactacgcaagctgggactccgcctggtttcaggcggtaccgacaaccatctggtattggtagacttaagcccaataggggtaaacggttatgacgcccagctggcactgcgcagagccggcattgtaatcaaccgcaataccgtaccctttgccgaaaaccaaactgccaacgtaccggcaggcatacgcctgggctgcccggcagcaaccagccgcggatttggtccggctgaaatccgccagactgttggctggattggcaagatacttaaaaacataggtaacgaagacgtagaaaaacaggtactggccgaggtaattcacctctgccgcaaattccctgtacccggcatagatatataa

SEQ ID NO: 9006 - protein, 415 aa, Dehalococcoides sp. BAV1
MSFLKTSDPAVYNAIMQETTRLKETIDLIASENYTSKAVLEAQGSVFTNKYAEGYPGKRYYAGCEYADAVEELAIDRAKTLFHAEHANVQPHSGAQANMAAYFAMVKPGDTIMGLTLSHGGHLTHGSKVNFTGKLYHVIEYGLNAETERIDYDNLEKLAMEHRPRMIVTGASAYPRILDFERFRAICDKVDAKLMVDIAHIAGLVAAGLHPSPVPYADVVTSTSHKTLRGPRGGFILCKEQYAKAIDQAVFPVMQGGPLMQVVAAKAVAFQEAMQPGFVTYQKKTLENTQVMAEELRKLGLRLVSGGTDNHLVLVDLSPIGVNGYDAQLALRRAGIVINRNTVPFAENQTANVPAGIRLGCPAATSRGFGPAEIRQTVGWIGKILKNIGNEDVEKQVLAEVIHLCRKFPVPGIDI

SEQ ID NO: 9007 - DNA, 1290 bp, Synechococcus sp. WH 7803
  CDS (1)..(1290): transl_table=11
atggtggatttcgaaaccgctccgatcaatgcaccactggcagagtctgatccagcgattgcccgtttgatcgatcaggagcgcgatcgccaggaaacccatctcgagctgattgcctcggaaaacttcgcatcgagcgccgtgatggctgctcagggctcggtgttgaccaataaatacgcggaaggcctgccgaacaagcgctactacggcggttgtgagcacgtggatgccattgaagacctggcgattgagcgggccaaggaactcttcggtgctgcctgggccaacgttcagccgcacagtggtgctcaggccaatttcgctgtcttcctggccctgctgcagcccggcgacacgatcatgggtctggacctgtcccatgggggccacctgacccatggctcaccggtgaatgtgagcggcaaatggttcaacgttgtccagtacggggtcgacaaagagacccagcgcttggatatggaggcgatccgtcagctcgccctcgagcacaagcccaagctgatcgtttgcggtttttcggcttacccccgcaccatcgattttgcggcgttccgtgcgattgctgatgaggttggggcttacctcctggctgatatggcccatatcgcaggcctggtggcagccggcgtccatcccagcccggtcccccattgcgatgtggtcaccaccaccacgcacaaaaccctgcgcggtccccgcggtggtctgatcctttgccgggatgccgagttcgccaaaaagttcgacaaggccgttttccccggttcgcaaggtggaccccttgagcatgtgatcgcagccaaagccgtggcctttggcgaggcactccgtcctgcgttcaaggcttacagccaacaggtggtggccaatgcccaggccctggccgaccgcctgatggcccgtggcatcgatgtggtgagcggagggaccgataaccatgtggtgctgcttgatctgcgcagcatcggcatgaccgggaaggtggccgacctgctggtcagcgatgtgcacatcaccgcgaacaagaacacggttccgtttgatccagaatcacccttcgtcaccagcggtctgcgcttaggaaccgctgcgctcacgacccgtggcttcgatgctgacgcgttcgctgaagtggccgaggtgattgctgatcgtttgctcaatccagaagacgatgccattcaggcccgttgcctggagcgggtggccagtctctgtcggcgttttcccctctacgcgatggcaacggaaccggcgcttgtctga

SEQ ID NO: 9008 - protein, 429 aa, Synechococcus sp. WH 7803
MVDFETAPINAPLAESDPAIARLIDQERDRQETHLELIASENFASSAVMAAQGSVLTNKYAEGLPNKRYYGGCEHVDAIEDLAIERAKELFGAAWANVQPHSGAQANFAVFLALLQPGDTIMGLDLSHGGHLTHGSPVNVSGKWFNVVQYGVDKETQRLDMEAIRQLALEHKPKLIVCGFSAYPRTIDFAAFRAIADEVGAYLLADMAHIAGLVAAGVHPSPVPHCDVVTTTTHKTLRGPRGGLILCRDAEFAKKFDKAVFPGSQGGPLEHVIAAKAVAFGEALRPAFKAYSQQVVANAQALADRLMARGIDVVSGGTDNHVVLLDLRSIGMTGKVADLLVSDVHITANKNTVPFDPESPFVTSGLRLGTAALTTRGFDADAFAEVAEVIADRLLNPEDDAIQARCLERVASLCRRFPLYAMATEPALV

SEQ ID NO: 9009 - DNA, 1803 bp, Oryza sativa (japonica cultivar-group)
  CDS (1)..(1803)
atggatctctcgcggccggaatcgtcggacctgtcgctgggtttccactcgctcggccacgcccgcgggcacgcggtcacggggccgctgcggctgttcgatgacatggaggacgccaagccggagaagagcgtcggtggcggcggaggaggagggggaggaggaggcgaggaggaggatggggaggaagggggcgaccagcacttctccctcctcggccacgcgctctgcgtcaagcgtccacgccgcgcgctctacggaggcggaggcggaggcggggcaggaggtggaggaggaggaggaggggaggcgtcctcctgctcgtcttcctcctcgtcgctgcacccggcgaagcggcaggcgacggcggagcgcggcgcggatctggaggcccgccgcggcgccgtccgcgcgtggggcaaccaggcgctggcggaggccgacccggacgtgcacgcgctgatggagctcgagcgcgaccgccaggtgcgcgggatcgagctgatcgcgtcggagaacttcgtctgccgcgcggtgctcgaggcgctcggcagccacctcaccaacaagtactctgagggccatcccggggctcggtactatggcgggaaccagcacatcgacggcatcgagcgcctctgccatgagcgcgccctcgccgccttcggtctcgaccccgcctgctggggggtcaacgtccagccatactcctgcacctctgcaaacctagctgtttacacaggtctcctcctgcccaaggaccgtatcatggggctcgagccgccttccggtggccatgtcagccacgggtactacacaccaagtggtaagaaggtgtctggagcatccatattcttcgagagcttgtcgtacaaggtgaatccgcagactgggtatattgattacgacaagcttgaggagcgggcaatggatttccaccctaagattctcatatgtggtgggagctcataccccagggagtgggattttgcacggatgaggctcattgctgataagtgcggtgcggtgctcatgtgcgatatggcacatatcagcgggcttgttgcggccaaggaatgccgtagtccctttgattactgtgatgtggttacatcaactactcacaagaatctgagaggtcctagaggtggtataatatttttcaggagagggaaaaacttaaggaggcgtactggatctttttctcaagcggatgagaatgattatgacttcgaggacaggataaattttgcagttttcccttcaatgcaaggaggaccccataataatcatattgcagccttggcgataactctgaagcaagtagcaacacctgaatacaaagcatacatcatacaagttaagaaaaatgcccaagctttggcatcagccttactcagaagaaaatgcagattggttactggtggcaccgataaccacttggtactttgggacctcagaaatttaggcttgactggaaagaactttgagaaggtctgtgaggcatgccacatctccataaataagatgccgatatatggggataatggctcaatatctcctgggggtgttcggattggaacacctgcaatgactactagaggttgcttggaagatgactttgaggtgatcgcagatttcctcatcagagccacccaaatagctagtaatcttatgaaagaacatggaaaaatgcagaaggaattcctgagaggcctacagaacaataaagatatcatagaactccgtaaccaggttgagaattttgcatcgcagtttgcaatgccaggttttgatgtatga

SEQ ID NO: 9010 - protein, 600 aa, Oryza sativa (japonica cultivar-group)
MDLSRPESSDLSLGFHSLGHARGHAVTGPLRLFDDMEDAKPEKSVGGGGGGGGGGGEEEDGEEGGDQHFSLLGHALCVKRPRRALYGGGGGGGAGGGGGGGGEASSCSSSSSSLHPAKRQATAERGADLEARRGAVRAWGNQALAEADPDVHALMELERDRQVRGIELIASENFVCRAVLEALGSHLTNKYSEGHPGARYYGGNQHIDGIERLCHERALAAFGLDPACWGVNVQPYSCTSANLAVYTGLLLPKDRIMGLEPPSGGHVSHGYYTPSGKKVSGASIFFESLSYKVNPQTGYIDYDKLEERAMDFHPKILICGGSSYPREWDFARMRLIADKCGAVLMCDMAHISGLVAAKECRSPFDYCDVVTSTTHKNLRGPRGGIIFFRRGKNLRRRTGSFSQADENDYDFEDRINFAVFPSMQGGPHNNHIAALAITLKQVATPEYKAYIIQVKKNAQALASALLRRKCRLVTGGTDNHLVLWDLRNLGLTGKNFEKVCEACHISINKMPIYGDNGSISPGGVRIGTPAMTTRGCLEDDFEVIADFLIRATQIASNLMKEHGKMQKEFLRGLQNNKDIIELRNQVENFASQFAMPGFDV

SEQ ID NO: 9011 - DNA, 1542 bp, Oryza sativa (japonica cultivar-group)
  CDS (1)..(1542)
atggccatggcgacggcgctccgcaagctctcctccgacgccctccgccgccagccgctctcccgcatcaccccgctctactacatggcgtccctgccggcgacggaggagagatccggagtcacctggccgaagcagctgaacgcgccgctggaggaggtggatcccgagatcgccgacatcatcgagcacgagaaggcccgccaatggaagggtctggagctcatcccgtcggagaacttcacctcggtgtcagtgatgcaggcggtgggatccgtcatgaccaacaagtacagcgaggggtaccccggcgcgagatactacggtggaaacgaatacattgatatggccgagtcattgtgccagaaacgtgctttggaggccttccgcttggacccagcgaaatggggagtgaatgtgcaacctctatcagggtcacctgccaacttccatgtttacactgccctattgaaaccacatgagagaatcatggctttggatcttcctcatggtggacatctttctcacggctaccagactgatactaagaagatttcagcagtttcgatattctttgagacaatgccctacagattggatgaaagcactggcttgattgattatgatcagatggagaaaagtgccgttctttttaggccaaagttgatcgttgcgggtgcaagtgcatatgcgcgtctttatgactatgaccgcatgcggaaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggttatgtatgactttgaggacaagatcaatgctgctgtcttcccaggtctgcaaggtggaccacataatcataccattactggcttagctgttgcgcttaagcaggcaactactccggagtacagagcttatcaagagcaagttatgagtaactgtgcaaaatttgcacagagcttgacagcaaaaggctacgaacttgtctctggtgggactgacaaccatttagtgttggtaaatctcaagagcaagggcatagatggttcaagagtggagaaggttttagaaaacgtgcacattgcagcaaacaagaacacagttcctggtgatgtttcagctatggtaccaggaggcatcaggatgggaaccccagcactgacctcaagaggatttgttgaggaggactttgctaaggttgctgatttcttcgatgcagcagtgaacttggctttgaaggttaaggctgcagcaggtggaacaaaactgaaggactttgttgccactttgcaatctgatagcaacattcaatccgagattgcaaaacttcgccatgatgtggaggaatatgcaaaacagttccccacaattgggtttgagaaagaaaccatgaagtacaagaactaa

SEQ ID NO: 9012 - protein, 513 aa, Oryza sativa (japonica cultivar-group)
MAMATALRKLSSDALRRQPLSRITPLYYMASLPATEERSGVTWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMVPGGIRMGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 9013 - DNA, 1764 bp, Oryza sativa (japonica cultivar-group)
  CDS (1)..(1764)
atgctcgatcgcgcgacgggggggcggcgccgcgccgcgggcgaagggatggaccatcggcccgacctgtccctcgccctccacccgccgccgccgcccgagggctcgtccgccgccgccgccgaggaggtgggggaggaggaggccgaaggcggcgaggggcggttctccctcatgggccagccgctcttcctcaagcggccgcggccgcggcccccgcgcccgccccgcgcgcgcggggtgggggacgacgtcgacgtcgacgtcgacgacgactcatccccgtgctgctcctcctcctgcctctcgcccgcggcgaagcggcgggcggcggcgggaggactcgaggcgcgccgcgcggccgtgcgcgcgtggggatgccagccgctcacggaggcggacccggacgtgcacgagctgatggagcgggagcggcgccggcaggcgggcggggtcgagctcatcgcctccgagaactacgcctgccgcgcggtgctcgacgcgctcggcagccacctcaccaacaagtactccgagggcctccccggcgcgcgctactactgcggcaaccagcacatcgacgccatcgagcgcctctgctgcgaccgcgcgctcgccgccttcggcctcgacccgtcgcgctggggcgtcaacgtgcagccctactcctgcacctccgccaacttcgccgtctacacggggctcctcctccccaacgacaggatcatgggcctcgactcgccgtccggcggccacgtcagccacgggtactacacgcccagcggcaagaaggtctccggcgcctccatcttcttcgagaacctctcctacagggtgaacccgcacaccgggtacatcgattacgataaggtagaggagaaggccgtggatttccaccccaagattctcatctgcggcgcgagctcgtatccaagggattgggactatgcacggatgcggcttgttgctgataagtgcggcgcagtactcatgtgtgacatggcacaaatcagtggtcttgtggcagcgaaggaatgtcgaaatccctttgactactgcgatattgttacttcaaccacacacaagagcttgaggggtcctagaggtggtataatatttttcaggaaagggaaaaatctaaggaaacgggtcggatctttaactcaagtggttgaaaatgatcagtatgattttgaggaccgtataaattttgctgttttcccttcaatgcaaggtggaccccacaataaccatattgctgctctggctatagctctaaaacaagtagccatgccagaattcaaagcatacattcaacaagtcaagaaaaatgcccaagctttggcgatggccttgctcaggaggaaatgcagactggttactggtggcacagataatcatttgatgctctgggacctaagaacatttggcttgacagggaagaactttgagaaggtctgtgaggcatgtcatatctctcttaataaaacaccaatatatggagataatggttcgatttctcctggaggtgtgcggattggaactcctgccatgacaactagaggttgcttggagagtgactttgagataatggcagaattccttttgagggcagcacatatagcaagtattgttttgaaggagcatggaaggcttcagaaggattttctgaaaggtctggagaacaataatgacattattgaactccggaatcaggtggagacatttgccttacaatttgccatgccgggatttgatgtataa

SEQ ID NO: 9014 - protein, 587 aa, Oryza sativa (japonica cultivar-group)
MLDRATGGRRRAAGEGMDHRPDLSLALHPPPPPEGSSAAAAEEVGEEEAEGGEGRFSLMGQPLFLKRPRPRPPRPPRARGVGDDVDVDVDDDSSPCCSSSCLSPAAKRRAAAGGLEARRAAVRAWGCQPLTEADPDVHELMERERRRQAGGVELIASENYACRAVLDALGSHLTNKYSEGLPGARYYCGNQHIDAIERLCCDRALAAFGLDPSRWGVNVQPYSCTSANFAVYTGLLLPNDRIMGLDSPSGGHVSHGYYTPSGKKVSGASIFFENLSYRVNPHTGYIDYDKVEEKAVDFHPKILICGASSYPRDWDYARMRLVADKCGAVLMCDMAQISGLVAAKECRNPFDYCDIVTSTTHKSLRGPRGGIIFFRKGKNLRKRVGSLTQVVENDQYDFEDRINFAVFPSMQGGPHNNHIAALAIALKQVAMPEFKAYIQQVKKNAQALAMALLRRKCRLVTGGTDNHLMLWDLRTFGLTGKNFEKVCEACHISLNKTPIYGDNGSISPGGVRIGTPAMTTRGCLESDFEIMAEFLLRAAHIASIVLKEHGRLQKDFLKGLENNNDIIELRNQVETFALQFAMPGFDV

SEQ ID NO: 9015 - DNA, 1416 bp, Oryza sativa (japonica cultivar-group)
  CDS (1)..(1416)
atggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcgtcaacgtgcagccctactccggctcgccggccaccttcgccgcctacacggcgctcctcaacccgcacgaccgcatcatggggctcgacctcccctccggtggccacctcacccatggctactacaccgcgggcgggaagaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggcaacaaggttgagaagatgtgtgacctttgcagcattacacttaacaagaatgctgtctttggtgacagcagtgcattggctcctggcggtgtccgcattggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaggacatcgagaacctcaagctggaggtcgagaagttcgccacctccttcgacatgcccggcttcaccctcgacagcatgaagtacaaggagtag

SEQ ID NO: 9016 - protein, 471 aa, Oryza sativa (japonica cultivar-group)
MDSVASWGLTPLAAADPLVHDLLEREKRRQRSGIELIASENFTSFAVMEALGSALTNKYSEGMPGARYYGGNDVIDEIENLCRDRALAAFRLDAASWGVNVQPYSGSPATFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMTPGFKAYAKQVKANAVAIGKYLMSKGYKMVTDGTENHLVLWDLRPLGLTGNKVEKMCDLCSITLNKNAVFGDSSALAPGGVRIGTPAMTSRGLVEKDFEQIGEFLHQAVTICLNIQKEHGKLLKDFSKGLVNNKDIENLKLEVEKFATSFDMPGFTLDSMKYKE

SEQ ID NO: 9017 - DNA, 1413 bp, Arabidopsis thaliana
  CDS (1)..(1413)
atggaaccagtctattcttggggaaacacgcatcttgacttcgtcgatccggagatctacgacctaatcgagaaggagaaacatcgtcaatgtcgaggaatcgaactcatagcagccgagaatttcacttccgtggccgtcatggaagctctcggaagttgcttaaccaacaaatactcggaaggtatgcctggtaatcgttactacggaggtaccgagttcatcgatgagatagagagtctctgccgctcacgctctctcgaagccttccattgcaatccagagaaatggggcgttaacgttcagccttactctggttcccctgcgaatttcgcagcctacaccgccttgctccagcctcatgatcgtatcatggggcttgatttgccatcaggtggtcatataacgcatggttactatagctctggtgggaagaacatctccgcgacctcgatctactttgaaaaccttccctacaaggtggattccaagactggttacattgattacgacaaacttgaggagaaagctatggattttaggcctaagttaattatctgtggaggcacttcttaccctagggaatgggattacgcgagattcagggctgtcgccgacaaggttggagcttttttgctctgtgatatggctcataacagtgccctcgttgctgctcaggaagccgcagacccgttcgagtactgtgacgttgtgacaacgtcaactcacaagagcttgagaggtccaagggctggtatgatcttttatagaaagggaccaaaaccagccaagaagggccaacccgagggtgaagtctacgatttcgacgcaaaaatcaactctgcggtattccctgcgcttcaaagtggtcctcacaataacaagattggtgctctagctgttgcgttgaagcaggttatggctcctagcttcaaagtttatgcaaaacaggtgaaagctaatgctgcttgccttgcaagctacctaataaataagggatatactcttgtaaccgatggaactgataaccaccttattctttgggatcttcgccctcttggattgaccggtaacaaggttgagaaggtttgtgaattgtgctacattactttgaacaggaatgcggtattcggagacactagttttcttgctcccggaggtgtaagaatcggtacaccggcgatgacatcgagaggattggtggagaaggactttgagaagataggagagttcctgcaccgtgccgtgacaatcacgttggacatccaggagcagtacggtaaggtgatgaaggacttcaacaagggtttggtgaacaacaaggagatcgatgagataaaggctgacgttgaggagttcacgtacgattttgatatgcctggatttttcatctctgagtcaaggaacgattag

SEQ ID NO: 9018 - protein, 470 aa, Arabidopsis thaliana
MEPVYSWGNTHLDFVDPEIYDLIEKEKHRQCRGIELIAAENFTSVAVMEALGSCLTNKYSEGMPGNRYYGGTEFIDEIESLCRSRSLEAFHCNPEKWGVNVQPYSGSPANFAAYTALLQPHDRIMGLDLPSGGHITHGYYSSGGKNISATSIYFENLPYKVDSKTGYIDYDKLEEKAMDFRPKLIICGGTSYPREWDYARFRAVADKVGAFLLCDMAHNSALVAAQEAADPFEYCDVVTTSTHKSLRGPRAGMIFYRKGPKPAKKGQPEGEVYDFDAKINSAVFPALQSGPHNNKIGALAVALKQVMAPSFKVYAKQVKANAACLASYLINKGYTLVTDGTDNHLILWDLRPLGLTGNKVEKVCELCYITLNRNAVFGDTSFLAPGGVRIGTPAMTSRGLVEKDFEKIGEFLHRAVTITLDIQEQYGKVMKDFNKGLVNNKEIDEIKADVEEFTYDFDMPGFFISESRND

SEQ ID NO: 9019 - DNA, 1416 bp, Arabidopsis thaliana
  CDS (1)..(1416)
atggaaccagtctcttcatggggtaacacctctctcgtctccgtagatccagagatccacgacctaatcgagaaggagaaacgtcggcaatgtcgaggaatcgaacttatcgcttccgagaatttcacttccttcgccgtcatcgaagctctcggaagtgccttaaccaacaaatactccgaaggtattcctggtaatcgttattacggaggtaacgaattcatcgatgagatcgagaatctttgccgttcaagagctctcgaagctttccattgtgatccagcagcgtggggcgttaatgttcagccgtattctggatctccggcaaatttcgctgcttacacggctttgcttcagcctcacgatcgtatcatggggcttgatttgccttcaggtggtcatttgactcatggttactatacatctggtggtaagaagatctctgcgacttcgatctactttgagagtcttccgtataaggtgaatttcaccactggttacattgattacgataagcttgaagagaaggcgttggatttcaggcctaagttgcttatctgtggtggtagtgcgtatcctagggattgggattacgctagatttagagctattgctgataaggttggagctcttttgctttgtgacatggctcacatcagtggtctcgttgctgctcaggaagctgcaaacccatttgagtactgtgacgttgtgacaaccacaacccacaagagtttgaggggtccaagggctggtatgattttctacaggaagggtccaaaaccaccaaagaagggtcaacccgagggtgcagtctatgattttgaggacaaaatcaactttgctgtattccctgcgcttcaaggtggtcctcacaatcaccagattggtgctctagctgttgcgttgaagcaggctaatactcctgggttcaaggtctacgcaaaacaagtgaaagccaatgctgttgcccttggaaactacctaatgagcaagggttaccagattgtgaccaatggaactgagaaccaccttgttctctgggatcttcgccctcttggattgaccggaaacaaggttgagaagctctgcgatctgtgcagcattacattgaacaagaacgcagtatttggagacagtagtgctcttgctcctggaggtgtaagaatcggtgcacccgcgatgacatcgagaggattggtggagaaggactttgagcagataggagaattcctgagccgtgcagtgacactgacgttggacatccaaaagacatacggtaagttgttgaaggacttcaacaagggtttggtgaacaacaaagatctcgatcagctcaaggctgatgtcgagaagttctcggcgtcttatgagatgcctggattcctcatgtctgagatgaagtacaaggattag

SEQ ID NO: 9020 - protein, 471 aa, Arabidopsis thaliana
MEPVSSWGNTSLVSVDPEIHDLIEKEKRRQCRGIELIASENFTSFAVIEALGSALTNKYSEGIPGNRYYGGNEFIDEIENLCRSRALEAFHCDPAAWGVNVQPYSGSPANFAAYTALLQPHDRIMGLDLPSGGHLTHGYYTSGGKKISATSIYFESLPYKVNFTTGYIDYDKLEEKALDFRPKLLICGGSAYPRDWDYARFRAIADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALGNYLMSKGYQIVTNGTENHLVLWDLRPLGLTGNKVEKLCDLCSITLNKNAVFGDSSALAPGGVRIGAPAMTSRGLVEKDFEQIGEFLSRAVTLTLDIQKTYGKLLKDFNKGLVNNKDLDQLKADVEKFSASYEMPGFLMSEMKYKD

SEQ ID NO: 9021 - DNA, 1308 bp, Vibrio cholerae O1 biovar eltor str. N16961
  CDS (1)..(1308): transl_table=11
gtggagtcattgtgtggtttttttgcaatttcagtcaatctgagtcaggagatacagatgcttaagcgtgatatgaacatcgctgattacgatccggagctatacgctgccattcaggaagagacgcttcgtcaagaagaacatattgaacttattgcttcagaaaactacaccagcccgcgtgtaatgcaagcacaaggttctcaactgaccaacaagtacgccgaaggttatccaggtaagcgttactatggtggttgtgagtacgtggacaaagcagaagctttagcgattgatcgtgcttgccaactgtttggctgtgaatacgcgaacgttcagccgcactctggatctcaagcgaacagcgctgtgtacatggcgctgctcaacccaggtgacaccgtgctaggtatgagccttgctcacggtggtcatttgactcacggttcaccggttaacttctcgggtaagcactacaatgtgatcccttacggtatcgatgaagcgggtcaaattaactacgatgaaatggaagccttagcactggagcataagccaaagatgatcatcggtggcttctcggcttactcacaaatcgtggattggaaacgcatgcgtgaaatcgccgataaagtgggtgcttacctgtttgttgacatggcgcacgttgcgggtctgattgcggcgggtgtttacccaagcccagtgccttttgcacacgttgtcacgaccaccacgcataaaacactggcaggtccacgcggtggcttgatcttgtcaaatgccggtgaggagatgtacaagaagctgaactctgcagtattccctggcggccaaggcggtcctttgatgcacgtgattgcggctaaagcggtggcgttcaaagaagcaatggagcctgagtttaaagagtatcaagcgcgtgtggtgaaaaacgccaaagccatggtggcgcagttccaagaacgtggttacaagatcgtctctaacagcacggaaaaccatttgttccttgttgatctgattgataaaaacatcacaggtaaagaagctgatgccgctctgggcgctgccaatatcacggttaacaagaactcggtaccaaatgacccacgcagcccgtttgtgacttcaggtatccgtgtcggtacaccagcaatcactcgccgtggttttaccgagcaagacgcaaaagatctcgccaactggatgtgtgatgttctagacaacatcaatgatcaaggtgtgattgaagcgacgaaacaaaaagtattggcgatctgtcaacgtctgcctgtttacgcttaa

SEQ ID NO: 9022 - protein, 435 aa, Vibrio cholerae O1 biovar eltor str. N16961
MESLCGFFAISVNLSQEIQMLKRDMNIADYDPELYAAIQEETLRQEEHIELIASENYTSPRVMQAQGSQLTNKYAEGYPGKRYYGGCEYVDKAEALAIDRACQLFGCEYANVQPHSGSQANSAVYMALLNPGDTVLGMSLAHGGHLTHGSPVNFSGKHYNVIPYGIDEAGQINYDEMEALALEHKPKMIIGGFSAYSQIVDWKRMREIADKVGAYLFVDMAHVAGLIAAGVYPSPVPFAHVVTTTTHKTLAGPRGGLILSNAGEEMYKKLNSAVFPGGQGGPLMHVIAAKAVAFKEAMEPEFKEYQARVVKNAKAMVAQFQERGYKIVSNSTENHLFLVDLIDKNITGKEADAALGAANITVNKNSVPNDPRSPFVTSGIRVGTPAITRRGFTEQDAKDLANWMCDVLDNINDQGVIEATKQKVLAICQRLPVYA

SEQ ID NO: 9023 - DNA, 1311 bp, Deinococcus radiodurans R1
  CDS (1)..(1311): transl_table=11
gtgcccggcgttgccgtaagtagagggccgttctttctggacaccccacagtcagctgggggccgcaggctttaccatctgttcatgaccactgccgaccagcctcaggccgtccgcgacgacgcggtcttcgacctgattgcccaggaagccgagcgccagcgcaccggccttgagctgattgcctccgagaacttcacctccgccgccgtgcgcgaggcccagggcagcgtgctgaccaacaagtacgccgagggctaccccggcaagcgctggtacggcggctgtgaagtggtggatcaggtggagcagctcgccatcgaccgcgtcaagcagctctttaacgccgagtgggccaacgtgcagccgcactcgggctcgagcgccaacctcgcggtgtacaacgccctgattcagcccggcgacacggtgctcggcatggacctttcgcacggcgggcacctgacacacggcaacaaggccaacttctcggggatgcgctaccagatggtcgcttaccagcttgaccgcgaaaccgagcgcatcgacatggaagaagtgcgccgcctcgcccacgagcacaagcccaagatgattattgccggggcgagcgcctacagccgcgtcatcgactttgccgccttccgcgaaattgccgatgaggtgggcgccctgctcttcgccgacatcgcccacatcgcgggcctgatcgcggcaggcgaacaccccaacgcgctgccgcacgcgcacgtcgtcgcctcgaccacccacaagaccctgcgcgggccacgcggcggcatcatcctggcgaacgaccccgaaatcgccaagcagctcgaccgcacggtgtttcccggctaccagggcggccccctcgaacacgtcatcgcggccaaggcggtggccttcggtgaggcgctgcgtcccgagttcaaggactatgcccggcagatcatcaagaatgcccaggcgctggcgggcgagttccagcaaaagggctaccgcgtcgtctcgggcggcaccgacaaccacctttttctgctcgacctgcgcccccaggggctgaacggcaccaaggcgacgcggctgctcgacgccaaccacatcaccatttccaagtccaccctgccctacgacaccgagaaaatcctgcacggcggcggcatccgcatcggcacgcccgccgtcaccacgcgcggcatgaccgaagcgcacatgacgcaggtggccgacctgattgaccgtgccctgaaaggcgaggacgtgcaggccaaggtccacgactttgccggtggcttcccactgccctga

SEQ ID NO: 9024 - protein, 436 aa, Deinococcus radiodurans R1
MPGVAVSRGPFFLDTPQSAGGRRLYHLFMTTADQPQAVRDDAVFDLIAQEAERQRTGLELIASENFTSAAVREAQGSVLTNKYAEGYPGKRWYGGCEVVDQVEQLAIDRVKQLFNAEWANVQPHSGSSANLAVYNALIQPGDTVLGMDLSHGGHLTHGNKANFSGMRYQMVAYQLDRETERIDMEEVRRLAHEHKPKMIIAGASAYSRVIDFAAFREIADEVGALLFADIAHIAGLIAAGEHPNALPHAHVVASTTHKTLRGPRGGIILANDPEIAKQLDRTVFPGYQGGPLEHVIAAKAVAFGEALRPEFKDYARQIIKNAQALAGEFQQKGYRVVSGGTDNHLFLLDLRPQGLNGTKATRLLDANHITISKSTLPYDTEKILHGGGIRIGTPAVTTRGMTEAHMTQVADLIDRALKGEDVQAKVHDFAGGFPLP

SEQ ID NO: 9025 - DNA, 1476 bp, Agrobacterium tumefaciens str. C58
  CDS (1)..(1476): transl_table=11
gtgtggcttggccgcgcatcatcgaagcgccgcctttattttccgtcgtatcctgtttttcataaaaacatctgtcacttttcgccgcaacgtcgcagtttgacgggcaaatctcgctggccgtattgctcttgttcgggcagggcgctaagacgccatcgcattactgtttcaggagccttcaccatgtcgaacacagatgctttcttctcccgtccgcttgccgaagtcgatccggatattttcggcgcgatcgagaaggaactgggtcgccagcgccacgagatcgaactgatcgcctcggaaaacatcgtttcccgcgctgtgcttgaagcgcagggttcgatcatgaccaacaaatatgcggaaggttatccgggcaagcgttattacggcggctgccagttcgtcgatatcgctgaagagcttgccatcgagcgcgccaagaagctgttcggcgtcaacttcgccaacgttcagccgaactccggttcgcagatgaatcaggccgtgttcctcgcgcttttgcagccgggcgataccttcatgggtctcgatctgaactcggggggccacctgacgcatggttcgccggtcaacatgtccggtaaatggttcaacgtcgtgtcctacggcgtgcgtgaaggcgacaacctgctcgacatggacgaagtggagcgcaaggccaaggaaacccggccgaagctgatccttgccggcggcaccgcctattcgcgcgtctgggactggaagcgcttccgcgagatcgccgatgaagtcggcgcctatctgatggtcgacatggcccacatcgccggtctcgttgccggtggccagcacccgtcgccgttcccgcattgccatgttgccaccaccacgacgcacaagtctctgcgcggcccgcgtggcggcatgatcctcaccaatgacgaggatctggccaagaagttcaactcggccgtattccccggcctgcagggtggcccgctgatgcatgtcatcgccgccaaggccgttgccttcggcgaagcgctgcagccggaattcaaggactatgccgcgcaggtcgtgaagaacgccaaggcgctggccgaaaccctgatcgaaggcggtctcgatgtcgtctccggcggcaccgacaaccacctgatgctggtcgatcttcgcaagaagaacgccaccggcaagcgcgcggaagcagcccttggccgcgcttacatcacctgcaacaagaacggcattcctttcgacccggaaaaacccttcgtcacgtcgggtgtccgtctcggcacgccggccggcacgacgcgcggtttcaaggaagcggaattccgcgaaatcggcaagctgatcgtcgaggttctcgacggcctgaaggttgccaattcggatgaaggtaatgcctccgtcgaggctgccgtgcgcgaaaaggtcgtcggtttgaccgaccgtttcccgatgtatccgtacatgtaa

SEQ ID NO: 9026 - protein, 491 aa, Agrobacterium tumefaciens str. C58
MWLGRASSKRRLYFPSYPVFHKNICHFSPQRRSLTGKSRWPYCSCSGRALRRHRITVSGAFTMSNTDAFFSRPLAEVDPDIFGAIEKELGRQRHEIELIASENIVSRAVLEAQGSIMTNKYAEGYPGKRYYGGCQFVDIAEELAIERAKKLFGVNFANVQPNSGSQMNQAVFLALLQPGDTFMGLDLNSGGHLTHGSPVNMSGKWFNVVSYGVREGDNLLDMDEVERKAKETRPKLILAGGTAYSRVWDWKRFREIADEVGAYLMVDMAHIAGLVAGGQHPSPFPHCHVATTTTHKSLRGPRGGMILTNDEDLAKKFNSAVFPGLQGGPLMHVIAAKAVAFGEALQPEFKDYAAQVVKNAKALAETLIEGGLDVVSGGTDNHLMLVDLRKKNATGKRAEAALGRAYITCNKNGIPFDPEKPFVTSGVRLGTPAGTTRGFKEAEFREIGKLIVEVLDGLKVANSDEGNASVEAAVREKVVGLTDRFPMYPYM

SEQ ID NO: 9027 - DNA, 1797 bp, Arabidopsis thaliana
  CDS (1)..(1797)
atggatttgagtcgttctcaaacaaattttcaattagggtttggttgttcacacgcatcaatgactccaacaccaacaccaagagctccaatcgcagacgattcgattaatctacaagtcgatcaaagtttccgatcattaccaacaactttctctccgattccgttacaattactcgaacaaaaagccgagaagaccaccaccgttgatgagccaaagaaagatggaggaggaggaggagatcaaaaggaagacgagcatttcagaatcttaggtcaccatatgtgtctcaaaaggcaaagagattgtccacttttgttaacgcaatcaaagcatccgaagagaagttccatcggtgattcagatctggaatcgcgacgtgctgctgtacgagcttggggtgatcaaccgattcatttggcggatcctgatattcatgagcttatggagaaagagaagcaacgacaagtaagaggaattgaattgattgcttctgagaatttcgtgtgtagagctgtaatggaagctttaggtagtcatttaacgaataaatactctgaaggtatgcctggagctagatactatactgggaatcaatatattgatcagattgagaatctctgtattgagcgtgctcttactgcgtttggtcttgaatctgataaatggggtgttaatgttcagccttattcttgtacttctgctaacttcgcggtgtataccggacttttattgcccggtgaacggattatggggcttgattcgccttctggtggtcatatgagtcatggttattgtactcctggtgggaagaagatttcggctgcttccatcttctttgagagttttccttataaagtgaatcctcaaactgggtatattgattatgataagcttgaagataaggcgcttgattaccgtcctaagattcttatttgtggtgggagttcttatcctagggattgggattttgcaagggttagacagattgcagataagtgtggagctgttttgatgtgtgatatggctcatattagcggtcttgttgcaactaaggaatgttcaaatccatttgatcactgtgacatagtaacctccactactcacaaaggtctacgtggtcctagaggaggtatcatcttctacaggagaggcccaaagataagaaagcagggccatcactctagccattgtgacacttccacgcattacgatctagaggaaaagatcaactttgctgtttttccatctctacaaggaggtccacacaacaaccatatcgctgctcttgccattgcattgaaacaagtggccactccagagtacaaagcttacatacaacagatgaagaaaaacgcccaagctttagcagcagctcttcttagaagaaaatgcagactggttactggtggtacagacaaccatttgttgctgtgggatctcactcctatgggcttaacagggaaagtctacgagaaagtgtgtgagatgtgccatatcactttaaacaagacggctatattcggggacaatggtacaatatctcctggaggtgtaagaatagggacacccgcaatgacaacccgaggctgtatagagtctgatttcgagacaatggcggattttctgataaaggcggctcagataacaagtgcgttgcagagagagcatggaaagtcacacaaggagtttgtgaaaagtttatgcaccaacaaagacatagctgagcttagaaaccgagtcgaagcatttgctttgcagtatgagatgcctgcttctcttattcgaattgaatga

SEQ ID NO: 9028 - protein, 598 aa, Arabidopsis thaliana
MDLSRSQTNFQLGFGCSHASMTPTPTPRAPIADDSINLQVDQSFRSLPTTFSPIPLQLLEQKAEKTTTVDEPKKDGGGGGDQKEDEHFRILGHHMCLKRQRDCPLLLTQSKHPKRSSIGDSDLESRRAAVRAWGDQPIHLADPDIHELMEKEKQRQVRGIELIASENFVCRAVMEALGSHLTNKYSEGMPGARYYTGNQYIDQIENLCIERALTAFGLESDKWGVNVQPYSCTSANFAVYTGLLLPGERIMGLDSPSGGHMSHGYCTPGGKKISAASIFFESFPYKVNPQTGYIDYDKLEDKALDYRPKILICGGSSYPRDWDFARVRQIADKCGAVLMCDMAHISGLVATKECSNPFDHCDIVTSTTHKGLRGPRGGIIFYRRGPKIRKQGHHSSHCDTSTHYDLEEKINFAVFPSLQGGPHNNHIAALAIALKQVATPEYKAYIQQMKKNAQALAAALLRRKCRLVTGGTDNHLLLWDLTPMGLTGKVYEKVCEMCHITLNKTAIFGDNGTISPGGVRIGTPAMTTRGCIESDFETMADFLIKAAQITSALQREHGKSHKEFVKSLCTNKDIAELRNRVEAFALQYEMPASLIRIE

SEQ ID NO: 9029 - DNA, 1590 bp, Arabidopsis thaliana
  CDS (1)..(1590)
atgcaagcttgttgtggtggtaattcgatggcttctcttcagcaacctggacgggttcaaggatctgtctttcccccaattatgcctccagtgaccaaattttctcagcagttgaagttcaatatttcaaaacctttccgttcttcatttctgaaaagaaacctggtctctgaaatgagagcatcttcagtctcgctacctaatgtcgagataagcagcaaagaaatcccttttgaggactatggtcttggtgaagttgatccagaggtccgaaccatcatcacaaaggagaaagatagacaattcaggagcttggagcttattgcatctgagaatttcacgtctcgagcagttatggaggcggttggctcatgccttaccaacaagtattctgagggactgcctggtaaaagatattatggtggcaatgagtacattgatcagttggagacgctttgccagaaccgggctttggcagccttccgcttagattctacgaaatggggggttaatgttcagccgttatctggttcacctgcaaactttgctgtctacactgcgatacttagccctcatgatcggatcatgggtttggatttacctcacggtggtcatctgtcgcatgggttcatgaccgctaaaaggcgtgtatctggaacttcaatatactttgagtccatgccttatcgacttgatgaatcaacaggcattgttgactacgatatgctcgagaaaactgctacacttttcagaccaaagcttattatcgcaggagctagtgcatacagccgagattttgactatcctcgcatgaggaagatcgcagactcagttggtgcttttctgatgatggatatggctcatatcagtgggcttgtggctgcttctgtggtagctgacccttttgagtattgtgatattgttacaacaacaactcacaagtctttgagaggtccgagaggtggcatgatcttcttcaggaaggatccaattaatggggttgatcttgaatctgccgtgaacaatgctgtcttccctggtttgcagggtggccctcataaccacacaattggaggattagcagtctgcttgaaacacgcacaatcaccggaattcaaggcgtaccagaaaagagttgtgtctaactgtagagctctagctaaccgattggttgaactcgggtttaagctagtttctggtggcagcgataaccacttggttctcgtcgatcttagacccatgggtatggatggtgcgcgggttgagaaaatcttagacatggcatctattactctcaacaagaactctgtccctggggacaaaagtgcgttggtaccagggggaataaggataggatcccccgcgatgacgacaagaggactgtcagagaaagactttgtagtagtggctgacttcatcaaggaaggtgtggagataacaatggaagccaagaaagccgcgccgggttcaaagcttcaagatttcaacaagttcgtgacatctcctgagtttccattgaaagagagagtgaagagtctaaaggagagagtggaaaccttcacatctcgttttcccattcctggcgtttaa

SEQ ID NO: 9030 - protein, 529 aa, Arabidopsis thaliana
MQACCGGNSMASLQQPGRVQGSVFPPIMPPVTKFSQQLKFNISKPFRSSFLKRNLVSEMRASSVSLPNVEISSKEIPFEDYGLGEVDPEVRTIITKEKDRQFRSLELIASENFTSRAVMEAVGSCLTNKYSEGLPGKRYYGGNEYIDQLETLCQNRALAAFRLDSTKWGVNVQPLSGSPANFAVYTAILSPHDRIMGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLKERVETFTSRFPIPGV

SEQ ID NO: 9031 - DNA, 1257 bp, Streptomyces coelicolor A3(2)
  CDS (1)..(1257): transl_table=11
atgtcggtcacccacgagatcatcgaggccgatgacagttcggtcggagtcctgctgcgccaggatcccgagctggccgagatcctgttcgccgaaggccgccgccagtcgacgaccctccagctcatcgccgccgagaacttcacctccccggccgtgctggccgccctcggctcaccgctggccaacaagtacgccgagggctacccgggcgcccgccaccacggcggctgcgagatcgtcgacgtggccgagcggctggccgcccagcgggcccaggcgctcttcggcgccgagcacgccaacgtgcagtcccactccggctcctccgccgtgctggccgcctacgccgccctgctgcgccccggcgacaccgtcctcgccctcggcctgccctacggcggccacctcacccacggctcacccgccaacttctccggccgctggttcgacttcgtcggctacggcgtggacgcggagaccgggctgatcgaccacgaccaggtgcgcaccctggcccgcgcccgccggcccaaggcgatcgtctgcggctccatcgcctacccccgccacctcgactacgccgccttccgcgacatcgccgacgaggtgggcgcctatctcatcgccgacgccgcccacccgatcggactcgtcgccgggggagcggcgcccagtccggtgccgtacgccgacatcgtgtgcgccaccacgcacaaggtgctgcgcggaccccgcggcggcatgatcctgtgcggaagcgaactggcggaacgggtcgaccgggccgtcttcccgttcacccagggcggcgcccagatgcacaccatcgccgccaaggccgtcgccttcggggaggcggcgacccccgccttcgccgcctacgcccaccaggtggtcgccaacgcccgggcgctcgcggcccacctggccgccgagggcctggtcgtcaccaccggcggcaccgacacccacctgctcaccgccgaccccgccccgctcggcgtcgacgggaagaccgcccgggggctgctcgcggcggccgggatcgtcctggactgctgcgcactgccgcacgccgacgcccgcgggctgcgcctgggcaccgccgcggtcaccacacagggcatgggggagcgggagatgcgggcggtggccacactggtcgccggggttctgcgggggacgacggacccggccgcggcacgggcggacgtaagggacctgaccgcggaattccccccgtacccggactga

SEQ ID NO: 9032 - protein, 418 aa, Streptomyces coelicolor A3(2)
MSVTHEIIEADDSSVGVLLRQDPELAEILFAEGRRQSTTLQLIAAENFTSPAVLAALGSPLANKYAEGYPGARHHGGCEIVDVAERLAAQRAQALFGAEHANVQSHSGSSAVLAAYAALLRPGDTVLALGLPYGGHLTHGSPANFSGRWFDFVGYGVDAETGLIDHDQVRTLARARRPKAIVCGSIAYPRHLDYAAFRDIADEVGAYLIADAAHPIGLVAGGAAPSPVPYADIVCATTHKVLRGPRGGMILCGSELAERVDRAVFPFTQGGAQMHTIAAKAVAFGEAATPAFAAYAHQVVANARALAAHLAAEGLVVTTGGTDTHLLTADPAPLGVDGKTARGLLAAAGIVLDCCALPHADARGLRLGTAAVTTQGMGEREMRAVATLVAGVLRGTTDPAAARADVRDLTAEFPPYPD

SEQ ID NO: 9033 - DNA, 1260 bp, Methanosarcina mazei Go1
  CDS (1)..(1260): transl_table=11
atgagttataaggtgacagtgatgtcttatattgaaaaaattgacccggaattgttcgaggctatcaaaaatgaagccgatcgtcaggaacacaagctgaacctgatcgcatcagaaaactatgcgagcagggctgttatggaagcccagggctctattatgaccaacaagtatgccgaaggatattccggtaaacgctattacggaggctgcgatttcgttgacgttgccgaaaatctcgccattgcaagggcaaaggaacttttcggggcaaagtatgtaaacgtccagcctcactcaggttcaggtgccaacatggctgtttatttctctgtgctgcagccgggggatactatcctgtccatggacctctctcacggcggacacctttctcacggcagccctgtaagtttctcaggaaaactctataacatcgtgccctatggggtcagcaaagagaccgaagccctggattacgatgagctccttaaactggcaaaagaatgcaagcccaggatgatagtatgcggagcttcagcctatccccgtgtgattgattttaaaaggttcagggaaattgctgatgaggtcggagcttacctccttgcagatattgcacacatcgcaggacttgtagttgcaggcgtacacccgagccctgttccttatgcggattttgttaccacaaccacccacaagaccctgcgcggtcccaggggcggaatgattatctcgaagactgaagagcttgcaataggcgtgaacaaagcggttttcccgggtatccagggcggccccctcatgcatatcatagctgcaaaagctgttgccttcaaagaagccatgagcgaagagttcaggcaggaccaggatcagaccgtaaagaacgcaaaggtcctgtgttcatgtctgaagcagaaaggttttgatattgtttcaggcggcaccgacaaccaccttatgcttgtaaatctcaataatatgaatattacaggaaaggacgctgaagctgcactgagcaaagccgggatcatcgccaacaaaaacacagttcctttcgagacccgcagcccattcgtaaccagcggggtaaggctcgggaccccttcctgcaccacaaggggcatgaaagaaaaggaaatggaactggttgcagactacatcgaggctgcaataaagaattcggaaaacgatgctcttctgtcggaaatcaatattaaggtaagggatctctgtttaaagttccctgtttacgaataa

SEQ ID NO: 9034 - protein, 419 aa, Methanosarcina mazei Go1
MSYKVTVMSYIEKIDPELFEAIKNEADRQEHKLNLIASENYASRAVMEAQGSIMTNKYAEGYSGKRYYGGCDFVDVAENLAIARAKELFGAKYVNVQPHSGSGANMAVYFSVLQPGDTILSMDLSHGGHLSHGSPVSFSGKLYNIVPYGVSKETEALDYDELLKLAKECKPRMIVCGASAYPRVIDFKRFREIADEVGAYLLADIAHIAGLVVAGVHPSPVPYADFVTTTTHKTLRGPRGGMIISKTEELAIGVNKAVFPGIQGGPLMHIIAAKAVAFKEAMSEEFRQDQDQTVKNAKVLCSCLKQKGFDIVSGGTDNHLMLVNLNNMNITGKDAEAALSKAGIIANKNTVPFETRSPFVTSGVRLGTPSCTTRGMKEKEMELVADYIEAAIKNSENDALLSEINIKVRDLCLKFPVYE

SEQ ID NO: 9035 - DNA, 1260 bp, Escherichia coli CFT073
  CDS (1)..(1260): transl_table=11
atgcggatgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgttgctggaaccaggcgataccgttctgggtatgaatctggcgcatggcggtcacctgactcacggttctccggttaacttctccggtaaactgtacaacatcgttccttacggtatcgatgctaccggtcatatcgactacgccgatctggaaaaacaagccaaagaacacaaaccgaaaatgattatcggtggcttctctgcatattccggcgtggttgactgggcgaaaatgcgtgaaatcgctgacagcatcggtgcttacctgttcgttgatatggcgcacgttgcgggcctggttgctgctggcgtctacccgaacccggttcctcatgctcatgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaagaagcaatggaacctgagttcaaaacttaccagcagcaggtcgcgaaaaacgccaaagcgatggtagaagtgttcctcgaacgcggctacaaagtggtttctggtggtactgataaccacctgttcctggttgatctggttgataaaaacctgaccggtaaagaagcagacgccgctctgggccgtgctaacatcaccgtgaacaaaaacagcgtaccgaacgatccgaagagcccgtttgtgacttccggtattcgtgtaggtactccggcgattacccgtcgtggctttaaagaagccgaagcgaaagaactggctggctggatgtgtgacgtgctggacagcatcaatgatgaagccgttatcgagcgcatcaaaggtaaagttctcgacatctgcgcacgttacccggtttacgcataa

SEQ ID NO: 9036 - protein, 419 aa, Escherichia coli CFT073
MRMLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 9037 - DNA, 1335 bp, Streptococcus pyogenes SSI-1
  CDS (1)..(1335): transl_table=11
atgctttttaccgaaacctcgactatgcagatgataaaacacaattacgattcatcaaaaacttacaaggagatgacaatgatttttgataaaggtaatgttgaagactttgataaagagctttgggatgccattcatgctgaagaagaaagacaagaacatcatatcgaattgattgcatctgaaaacatggtttcaaaagctgtcatggcagctcaaggttctgttttaaccaataagtatgcagaaggctatccaggtaatcgctattatggtggaacagaatgtgtggatattgtcgaaacgcttgctattgaacgtgctaagaaacttttcggtgccgcatttgccaatgttcaagcccattccggaagtcaagccaatgcagcagcttatatggccttaattgaggctggtgataccgtattaggaatggatttggctgcaggtggtcatctcacgcatggctctccagtaaatttttctggaaaaacttaccattttgtgggttattcagtagatgctgatactgaaatgttaaattatgaggcgattttagaacaagcaaaggcggtccagccaaagcttatcgttgcaggggcttcggcctactctagaaacattgattttgaaaagtttcgtgccattgctgatcacgtaggtgcttacttaatggtggacatggctcacatcgctggccttgtagcagcaggtgtgcacccgagtcctgtcccttatgcgcatattgtgacatcaacaacccataaaaccttacgtggtcctcgtggaggcttgatattaaccaatgacgaagctcttgctaaaaagattaattcggccgttttccctggtttacaaggaggacctctggaacacgtgattgctgccaaagcggttgccttcaaagaagccttggatccagcctttaaagactatgcacaagctattattgataatactgcggctatggcagcagtttttgcacaagatgatcgtttccgtctgatctcaggtggtacagataatcatgtctttttagtagatgtcactaaggttattgctaatggtaaactagcgcaaaatcttctggatgaggttaatattacccttaataaaaatgccattccttttgaaaccttgtcgccatttaatacctcaggtattcgcattggttgtgctgccataaccagccgtggtatgggtgttaaagagagtcagaccattgcccgtcttatcatcaaagccttggttaatcatgatcaagaaactattcttgaagaagtccgtcaggaagtgcgtcagttaaccgatgccttcccactctataaaaagtaa

SEQ ID NO: 9038 - protein, 444 aa, Streptococcus pyogenes SSI-1
MLFTETSTMQMIKHNYDSSKTYKEMTMIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRNIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFNTSGIRIGCAAITSRGMGVKESQTIARLIIKALVNHDQETILEEVRQEVRQLTDAFPLYKK

SEQ ID NO: 9039 - DNA, 1554 bp, Arabidopsis thaliana
  CDS (1)..(1554)
atggcgttggctcttcgtagactctcctcttccgttaagaaaccgatctcgcttctctcctctaatggcggttcactccgtttcatgtcgtctttatcaaccgcagctatggcggaatcggagaaatctcgttctagttggattaagcaattgaatgcatctctagatgaaatcgatcctgaagttgcggatattatcgaattagagaaggctagacaatggaagggatttgaacttataccgtcagagaatttcacttctctatctgtgatgcaagccgttggttctgttatgactaataagtatagtgaaggataccctggagctagatactatggaggaaatgagtacattgacatggctgagacattatgtcaaaaacgcgcattagaagcttttcagttagatccttctaaatggggagtcaatgtgcagtctttatcaggatcaccagctaatttccaagtttacactgcattgttgaagcctcatgaaagaatcatggcacttgatttacctcatggtggacatctttctcatggttatcagactgacacgaagaaaatatcggctgtatccatcttttttgagacaatgccatacagattggatgagaacactggttacattgattatgaccagctagaaaagagtgccgtgcttttcagaccgaaacttattgttgcgggtgcaagtgcttatgctcgtctatatgactatgcacgtattcgtaaggtctgtaacaagcaaaaggcagttatgttggctgatatggctcatattagtgggttggttgctgctggcgttattccttctccttttgagtatgcagatgttgttacgactacaactcacaaatcgcttcgcggtcctagaggggctatgatattctttaggaaggggttaaaagagattaacaaacaagggaaagaggtcatgtatgactatgaggacagaattaatcaagctgtttttcctggactgcaaggtggtccacataatcacactataacgggtctagcagttgctctgaagcaggcaagaactcctgagtacaaggcctaccaggatcaagttctccgtaattgctcaaagtttgctgagactttgcttgcgaaaggatatgatttagtgtctggaggcactgataatcatttagttttggtgaatctgaaaaacaagggaatagatggatcaagagtggaaaaagtattagaattagtacatattgcagcaaacaagaatactgttcctggtgatgtttctgccatggttcccggtggcatccgtatgggaacaccagccctcacatcaagaggattcattgaggaagattttgcaaaagtggcggagtattttgatttagccgtcaagatagccttaaagatcaaagcagagtctcaaggaacaaagttgaaagactttgtagcaacaatgcaatcaaatgagaaattacagtcagagatgtcaaagctccgtgagatggtagaagaatatgctaagcaattcccaacgattgggttcgagaaagagacgatgagatacaaagagtag

SEQ ID NO: 9040 - protein, 517 aa, Arabidopsis thaliana
MALALRRLSSSVKKPISLLSSNGGSLRFMSSLSTAAMAESEKSRSSWIKQLNASLDEIDPEVADIIELEKARQWKGFELIPSENFTSLSVMQAVGSVMTNKYSEGYPGARYYGGNEYIDMAETLCQKRALEAFQLDPSKWGVNVQSLSGSPANFQVYTALLKPHERIMALDLPHGGHLSHGYQTDTKKISAVSIFFETMPYRLDENTGYIDYDQLEKSAVLFRPKLIVAGASAYARLYDYARIRKVCNKQKAVMLADMAHISGLVAAGVIPSPFEYADVVTTTTHKSLRGPRGAMIFFRKGLKEINKQGKEVMYDYEDRINQAVFPGLQGGPHNHTITGLAVALKQARTPEYKAYQDQVLRNCSKFAETLLAKGYDLVSGGTDNHLVLVNLKNKGIDGSRVEKVLELVHIAANKNTVPGDVSAMVPGGIRMGTPALTSRGFIEEDFAKVAEYFDLAVKIALKIKAESQGTKLKDFVATMQSNEKLQSEMSKLREMVEEYAKQFPTIGFEKETMRYKE

SEQ ID NO: 9041 - DNA, 1602 bp, Arabidopsis thaliana
  CDS (1)..(1602)
atggcgttggctcttcgtagactctcctcttccgttaagaaaccgatctcgcttctctcctctaatggcggttcactccgtttcatgtcgtctttatcaaccgcagctatggcggaatcggagaaatctcgttctagttggattaagcaattgaatgcatctctagatgaaatcgatcctgaagttgcggatattatcgaattagagaaggctagacaatggaagggatttgaacttataccgtcagagaatttcacttctctatctgtgatgcaagccgttggttctgttatgactaataagtatagtgaaggataccctggagctagatactatggaggaaatgagtacattgacatggctgagacattatgtcaaaaacgcgcattagaagcttttcagttagatccttctaaatggggagtcaatgtgcagtctttatcaggatcaccagctaatttccaagtttacactgcattgttgaagcctcatgaaagaatcatggcacttgatttacctcatggtggacatctttctcatggttatcagactgacacgaagaaaatatcggctgtatccatcttttttgagacaatgccatacagattggatgagaacactggttacattgattatgaccagctagaaaagagtgccgtgcttttcagaccgaaacttattgttgcgggtgcaagtgcttatgctcgtctatatgactatgcacgtattcgtaaggtctgtaacaagcaaaaggcagttatgttggctgatatggctcatattagtgggttggttgctgctggcgttattccttctccttttgagtatgcagatgttgttacgactacaactcacaaatcgcttcgcggtcctagaggggctatgatattctttaggaaggggttaaaagagattaacaaacaagggaaagaggtcatgtatgactatgaggacagaattaatcaagctgtttttcctggactgcaaggtggtccacataatcacactataacgggtctagcagttgctctgaagcaggcaagaactcctgagtacaaggcctaccaggatcaagttctccgtaattgctcaaagtttgctgagttggatataagacctactgtaatcatctcatatggcttgtcaatgcagactttgcttgcgaaaggatatgatttagtgtctggaggcactgataatcatttagttttggtgaatctgaaaaacaagggaatagatggatcaagagtggaaaaagtattagaattagtacatattgcagcaaacaagaatactgttcctggtgatgtttctgccatggttcccggtggcatccgtatgggaacaccagccctcacatcaagaggattcattgaggaagattttgcaaaagtggcggagtattttgatttagccgtcaagatagccttaaagatcaaagcagagtctcaaggaacaaagttgaaagactttgtagcaacaatgcaatcaaatgagaaattacagtcagagatgtcaaagctccgtgagatggtagaagaatatgctaagcaattcccaacgattgggttcgagaaagagacgatgagatacaaagagtag

SEQ ID NO: 9042 - protein, 533 aa, Arabidopsis thaliana
MALALRRLSSSVKKPISLLSSNGGSLRFMSSLSTAAMAESEKSRSSWIKQLNASLDEIDPEVADIIELEKARQWKGFELIPSENFTSLSVMQAVGSVMTNKYSEGYPGARYYGGNEYIDMAETLCQKRALEAFQLDPSKWGVNVQSLSGSPANFQVYTALLKPHERIMALDLPHGGHLSHGYQTDTKKISAVSIFFETMPYRLDENTGYIDYDQLEKSAVLFRPKLIVAGASAYARLYDYARIRKVCNKQKAVMLADMAHISGLVAAGVIPSPFEYADVVTTTTHKSLRGPRGAMIFFRKGLKEINKQGKEVMYDYEDRINQAVFPGLQGGPHNHTITGLAVALKQARTPEYKAYQDQVLRNCSKFAELDIRPTVIISYGLSMQTLLAKGYDLVSGGTDNHLVLVNLKNKGIDGSRVEKVLELVHIAANKNTVPGDVSAMVPGGIRMGTPALTSRGFIEEDFAKVAEYFDLAVKIALKIKAESQGTKLKDFVATMQSNEKLQSEMSKLREMVEEYAKQFPTIGFEKETMRYKE

SEQ ID NO: 9043 - DNA, 1317 bp, Vibrio vulnificus YJ016
  CDS (1)..(1317): transl_table=11
atgattgaaaggttatctaccatgaatagtcattaccaaaatcacagcttggaaaactttttctcgactaacttgtctgcaacggatgatgccgtttttgctggtattcaagccgaatttactcgtcaaaatgaacaaatcgaattgatcgcttctgagaacatcgtgtcgaaagcggtcatgcaagcgcaaggcacctgcctcaccaataaatatgcagaaggttacccaggccgtcgttactacggtggttgtgaacacgttgataccgtggaagccatcgctatcgaacgcgcgaaaaaactttttaattgcgaatacgcaaacgttcaaccgcactctggcgctcaagccaacggcgcggtgaaactggcgctattgcaacctggcgacaccattatgggcatgtcgctcgatgcaggtggccacttaactcacggtgcgcgccctgctctttcgggcaaatggtttaacgccgttcaatacggtgttgataaagagacgctcgaaatcaactacgatgatgttcgcgcactggcggtagaacacaaaccaaaaatgattattgctggtggtagcgcgattcctcgcgtgattgattttgccaagttccgtgaaatcgctgacgaagttggcgcgattttaatggttgatatggcgcacatcgcgggtttgatcgctacaggcgcacaccctagcccactgcctcatgcacacgtggtgaccaccaccacacacaaaacgctacgcggaccacgcggcggcatgatcctcaccaatcacgaagaaatcattaagaaaatcaactctgcggtattccctggcctacaaggcggcccgctgatgcacgtgattgcagcgaaagcggtggcgtttggcgaagcactcggccctgagttcaaaacttatatcgattcggtgatcaataacgcaaaagttcttgctgaagtgttgcaaactcgcggttgtgacattgtgactggcggaacggacacgcacctaatgctggttgatcttcgtcctaagggattgaaaggcaacaaagcagaagaggcactagagcgtgcggggatcacatgtaacaaaaatggcatcccattcgacacagaaaaacctatgattacatcgggtgttcgtttgggcacgccagcgggtacaagccgaggctttggcgcagaagaattcaaattaataggtcactggattggtgatgttctcgacgggttagttgaaaaccctgagggcaacgcggaagtagaacaacgcgtgcgtaaagaagtaaaagcactctgttcacgcttcccactttaccagtaa

SEQ ID NO: 9044 - protein, 438 aa, Vibrio vulnificus YJ016
MIERLSTMNSHYQNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTIMGMSLDAGGHLTHGARPALSGKWFNAVQYGVDKETLEINYDDVRALAVEHKPKMIIAGGSAIPRVIDFAKFREIADEVGAILMVDMAHIAGLIATGAHPSPLPHAHVVTTTTHKTLRGPRGGMILTNHEEIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGVRLGTPAGTSRGFGAEEFKLIGHWIGDVLDGLVENPEGNAEVEQRVRKEVKALCSRFPLYQ

SEQ ID NO: 9045 - DNA, 1551 bp, Magnaporthe grisea 70-15
  CDS (1)..(1551)
atgtcattaccggcaatgaggcaggcggcttcgagggcgctgaggatgcgtgggcccgtgggccggcacgtcaggatggtgtcgacggcttcgcatgagagccagcagaggctgctctcctcgcacctgcaaaccgcagacccggccatgtacgatattgtcgagaaggagaagcagaggcagaagcactacatcaacctcattccgtcggaaaacttcacatcccaggccgtgctggatgctttaggaagcccgatgcagaacaagtattccgagggttaccccggggcgaggtattacggcggtaacgagttcatcgatcaatccgagaggctatgccagcaaagagcattggagacttttggtttggatgacaagcagtggggagtgaacgtgcaagctctctctggcgcccccgccaacttgtacgtatactcggccctcatgggcgtccacgaccgcatgatgggtctagacctgcctcacggcggccatctttcccacggataccagacgccgaccaagaagatctcgttcatctcaaagtactttgagacggtcccctaccggctggacgagtcgaccggctacatagactacgacaagctggaggagctggcacacatctaccgtcccaagatcatcgttgcgggcacctcggcctacagtcggtttatcgactacaagcgcatgcgtgagatctgcgacaaggtcaacgcatacatgctggccgacatggcacacatctcgggtatggtcgcggccaaggtcatcccgggaccttttggctacgccgacattgtgaccacgaccacccacaagtctctgaggggccctcgcggtgccatgatcttcttcaggaagggcgtgcgttcgacgaaccccaagaccaaggctgaggtcatgtacgaccttgagaaccccatcaaccagtccgtcttccccggtcaccagggcggacctcacaaccacaccattgcggccctggccgtggcgctcaagcaggcgcagatgcccgagttccgcgcgtaccaggagcaggtcctcgtcaacgccaaggcttttgcccgccgtctgggtgaggccaagggcaacggcggcggtctgggctacaagatcgtctcgggcggcacggacaaccacctggtcctggcggacctcaagccgcagggcatcgacggcgcccgcgtcgagcgcgtgctggagctggtcggcatcgccgccaacaagaacacggttccgggcgacaagtcggccctgaccccgggaggtctgcgcatgggaacgcccgccatgacgacgcgcggcttcggcgaagacgactttgtgcgcgtcgccgacattgtggaccgggcggtgaccatcgccgtgagggttgacaaggcggccaggaaggcggccgaggccaagggcgagaagagccccggcaagctcaagaacttcttggagtacctgggcaacggcgagacggagagcgagattgtgcagctcaggagcgaggtttccgactgggttgggacataccctctgccgtgggatgtgaagccttga

SEQ ID NO: 9046 - protein, 516 aa, Magnaporthe grisea 70-15
MSLPAMRQAASRALRMRGPVGRHVRMVSTASHESQQRLLSSHLQTADPAMYDIVEKEKQRQKHYINLIPSENFTSQAVLDALGSPMQNKYSEGYPGARYYGGNEFIDQSERLCQQRALETFGLDDKQWGVNVQALSGAPANLYVYSALMGVHDRMMGLDLPHGGHLSHGYQTPTKKISFISKYFETVPYRLDESTGYIDYDKLEELAHIYRPKIIVAGTSAYSRFIDYKRMREICDKVNAYMLADMAHISGMVAAKVIPGPFGYADIVTTTTHKSLRGPRGAMIFFRKGVRSTNPKTKAEVMYDLENPINQSVFPGHQGGPHNHTIAALAVALKQAQMPEFRAYQEQVLVNAKAFARRLGEAKGNGGGLGYKIVSGGTDNHLVLADLKPQGIDGARVERVLELVGIAANKNTVPGDKSALTPGGLRMGTPAMTTRGFGEDDFVRVADIVDRAVTIAVRVDKAARKAAEAKGEKSPGKLKNFLEYLGNGETESEIVQLRSEVSDWVGTYPLPWDVKP

SEQ ID NO: 9047 - DNA, 1449 bp, Magnaporthe grisea 70-15
  CDS (1)..(1449)
atggccgaggctacttacgcattgtcggctactcataaggagatgcttgagaagtctcttctcgactccgaccctgaggtcgctgagatcatgaaacacgagatccagcgtcagcgcgagtccatcatccttatcgcctccgagaatgttacgtctcgggctgtcttcgatgcccttggttcgcctatgtcgaacaagtactccgagggctacccaggcaagcgctactacggtggcaaccagcacattgacgagattgagctcctctgccagcgccgtgctcttgctgccttcaacgtcactgaggacaagtggggtgtcaacgttcagtgcttgagtggcagccctgccaaccttcaggtttaccaggccattatgcctccccatggcaggctcatgggtctggacctccctcacggtggccacttgagccacggctaccagaccccccagcgaaagatttcggctgtttcgacctacttcgagaccatgccctaccgtgttgaccttgagactggcatcattgactacgaccagctcgagaagaacgtggtcctgtacaggcccaagattttggtggccggtacctctgcctactgccgcctgatcgattacgcgcggatgcgcaagatcgctgatctcgttggcgcttacttggtcgtcgacattgctcacatttctggcctcgtcgcttcgggtgtgatcccctccccgttcctccacgccgatgttgttactaccactacccacaagtctctccgtggtcctcgtggcgcgatgatcttcttccgcaggggtgttcgttccgtcgaccccaagactggcaaggagaccatgtacgacctcgaggagcccatcaacttctcggtcttccccggtcaccagggtggtccccacaaccacaccatcactgctctggctgtcgccctcaagcaggcatccacgcccgagttcaaggcctaccagcagcaggttgtcgacaacgccaaggcgttggagaacagcttcaaggagcttggccacaagctcgtctcggacggcaccgactcccacatggtcctggttgacctgcgtgcccactccctggatggtgctcgtgttgaggctgtacttgagcagatcaacatcgcctgcaacaagaacagcattcctggcgacaagagcgctcttaccccgtgcggtatccgtatcggtacccctgccatgaccagccgtggctttggtgtcgagcacttccagcgcgtcgccaaatacattgacgagagcatcaagatttgcaaggacgtccaggctgctctgcccaaggaggccaacaagctcaaggacttcaaggccaaggttgcttcgggcgaggtttccaggatcaacgagctcaagaaggagattgcgtcctggtgccaaaccttccctctccctgttgagggctggcgcaccgacgccggtatttaa

SEQ ID NO: 9048 - protein, 482 aa, Magnaporthe grisea 70-15
MAEATYALSATHKEMLEKSLLDSDPEVAEIMKHEIQRQRESIILIASENVTSRAVFDALGSPMSNKYSEGYPGKRYYGGNQHIDEIELLCQRRALAAFNVTEDKWGVNVQCLSGSPANLQVYQAIMPPHGRLMGLDLPHGGHLSHGYQTPQRKISAVSTYFETMPYRVDLETGIIDYDQLEKNVVLYRPKILVAGTSAYCRLIDYARMRKIADLVGAYLVVDIAHISGLVASGVIPSPFLHADVVTTTTHKSLRGPRGAMIFFRRGVRSVDPKTGKETMYDLEEPINFSVFPGHQGGPHNHTITALAVALKQASTPEFKAYQQQVVDNAKALENSFKELGHKLVSDGTDSHMVLVDLRAHSLDGARVEAVLEQINIACNKNSIPGDKSALTPCGIRIGTPAMTSRGFGVEHFQRVAKYIDESIKICKDVQAALPKEANKLKDFKAKVASGEVSRINELKKEIASWCQTFPLPVEGWRTDAGI

SEQ ID NO: 9049 - DNA, 1476 bp, Gibberella zeae PH-1
  CDS (1)..(1476)
atgtctcccacaaacgccgagtatgcgctctccgagtcgcacaaggagatgctcgagaagtctctcctcgactccgaccccgaggttgcctccatcatgaaggatgagatccagcgccagcgcgagtccatcgtcctcatcgcctccgagaacatcacctcccgtgccgtcttcgacgcccttggttctcccatgtccaacaagtactctgagggttaccccggtgctcgttactatggtggcaaccagcacatcgatcagatcgagcttctctgccagcgtcgtgccctcgaggccttccacctcgactctgagaagtggggtgtcaacgtccagtgcctttctggatctcccgccaacctccaggtctaccaggctatcatgcctcctcacggtcgtctcatgggtcttgacctcccccacggtggccatcttagccacggttaccagacccccgccaggaatatgctaacaattgacaacaggatctctgctgtctctacttacttcgagaccatgccctaccgtgtcgaccttgacaccggtatcattgactacgacaccctccagaagaacgctatcctctaccgccccaaggtcctggtcgccggtacctctgcctattgccgtctcatcgactacgagcgcatgcgcaagatcgccgactccgtcggtgcttacctcgttgtcgatatggcccacatctctggtcttatcgccgctgaggtcatccccacccccttcaagtacgccgatatcgttaccaccaccacccacaagtccctccgtggtccccgtggtgccatgatcttcttccgcaagggtgtccgctccgtcgatgccaagactggcaaggagactctctacgaccttgagaaccccatcaacttctccgttttccctggtcaccagggtggtcctcacaaccacaccatcactgccctggctgttgccctgaagcaggctgccagccccgacttcaaggcctaccaggagaaggttgtctccaacgccaagaccctggagaacaccttcaaggctctcggccacaagctcgtctctgacggaactgacagtcacatggtcctcattgacctccgccagcacaaccttgacggtgcccgcgttgaagccgttctcgagcagatcaacattgcttgcaacaagaactccatccccggtgacaagtctgcccttactccttgcggtatccgtatcggtacccccgccatgacttctcgtggtttcggcgagaaggagttcgagcgtgtcggcaagttcatcgacgaggccatcaagatctgcaaggaggagcaggctgccctccccaaggaagcaaacaagctcaaggacttcaaggcccgcgttgccagtggtgaggtccagaagatcaacgatttccgaaaggagattgcttcttggtgcagcgccttccccctccccgttgagggttggcgcctggacgccagcatctaa

SEQ ID NO: 9050 - protein, 491 aa, Gibberella zeae PH-1
MSPTNAEYALSESHKEMLEKSLLDSDPEVASIMKDEIQRQRESIVLIASENITSRAVFDALGSPMSNKYSEGYPGARYYGGNQHIDQIELLCQRRALEAFHLDSEKWGVNVQCLSGSPANLQVYQAIMPPHGRLMGLDLPHGGHLSHGYQTPARNMLTIDNRISAVSTYFETMPYRVDLDTGIIDYDTLQKNAILYRPKVLVAGTSAYCRLIDYERMRKIADSVGAYLVVDMAHISGLIAAEVIPTPFKYADIVTTTTHKSLRGPRGAMIFFRKGVRSVDAKTGKETLYDLENPINFSVFPGHQGGPHNHTITALAVALKQAASPDFKAYQEKVVSNAKTLENTFKALGHKLVSDGTDSHMVLIDLRQHNLDGARVEAVLEQINIACNKNSIPGDKSALTPCGIRIGTPAMTSRGFGEKEFERVGKFIDEAIKICKEEQAALPKEANKLKDFKARVASGEVQKINDFRKEIASWCSAFPLPVEGWRLDASI

SEQ ID NO: 9051 - DNA, 1509 bp, Gibberella zeae PH-1
  CDS (1)..(1509)
atgatgaacatgaggcttcttcggcagcaatgccttcgcaccaagccatcactggctacgcgcatttccaccagaggtttcgcatctcaaaaagatctcctcggttcaagcctcgagcaaggcgaccctgagatccatgccattctcaagcgcgaagagaagcgtcagaaccacttcatcaacctcatcccctccgaaaacttcacctcgcgatcagttctcgatgccctaggcagtgtcatgcaaaacaagtactccgagggctacccaggagcacgatactacggcggcaatgaacacatcgatgaggccgaacgtctttgccaatccagagctctcgagactttccgtcttgaccccgagaagtggggtgtcaacgttcagccactctctggatccccagccaacctctacgcttactctgctatcctcaacacccacgatcgcatcatgggtcttgaccttccccatggaggccatctctcccacggctaccagatccccggcaagaagatctccatgatctcaaagtactacgagaccttcccctaccgactcaacgaggagactggcctgatcgactacgaaaagctgcgcgagaacgccctgctgtaccgccccaaggtcatcgtagcaggaacatctgcctattcccgccttatcgattatgagcgcatgcgcgccattgccaatgaggctggtgcttaccttctctctgatatggctcacgtttccggtcttgtcgctgctggtgttatcggaacaccctttgatgactctgacatcgtcacgaccaccacccacaagtccctgcgcggacctcgcggcgccatgatcttctaccgcaagggcgtgcgaagcacagacaagaagggcaagcagatcatgtacgacctcgagggccccatcaacgcgtccgtcttccccggccaccaaggcggtcctcacaaccacaccatcaccgccctcgctgtcgccctcaagcaggcccagacacctgagttcaaggactaccaagaaaaggtcctcgcaaactcccaagccatggccaaccagctcactgacctcggctactcgcttgtctctggcggcaccgacaaccacctcgttctcgtggacctcaagcccaagggtatcgacggcgcgcgtgtggagcgcgtgcttgaactcgttggcgtagcgagtaacaagaacaccgtgcctggtgaccgctcggcgctgaagccgggcggtctccgtctgggaacgcccgccatgacgacgcggggcttcaacggcgaggactttaagcgcgtggccgatattgttgaccgcggcgtgaagatcactctggcggttgataaggatgcgcgtgctgcggctgaggctaagggagctaagaacccaggtaccgtcaagaactttttggagtttttgggtgatggatccagtgtcaaggagattgctgcgctgcgcgatgaggttgctgagtgggttggaggattccctcagccttggctcaagtcatga

SEQ ID NO: 9052 - protein, 502 aa, Gibberella zeae PH-1
MMNMRLLRQQCLRTKPSLATRISTRGFASQKDLLGSSLEQGDPEIHAILKREEKRQNHFINLIPSENFTSRSVLDALGSVMQNKYSEGYPGARYYGGNEHIDEAERLCQSRALETFRLDPEKWGVNVQPLSGSPANLYAYSAILNTHDRIMGLDLPHGGHLSHGYQIPGKKISMISKYYETFPYRLNEETGLIDYEKLRENALLYRPKVIVAGTSAYSRLIDYERMRAIANEAGAYLLSDMAHVSGLVAAGVIGTPFDDSDIVTTTTHKSLRGPRGAMIFYRKGVRSTDKKGKQIMYDLEGPINASVFPGHQGGPHNHTITALAVALKQAQTPEFKDYQEKVLANSQAMANQLTDLGYSLVSGGTDNHLVLVDLKPKGIDGARVERVLELVGVASNKNTVPGDRSALKPGGLRLGTPAMTTRGFNGEDFKRVADIVDRGVKITLAVDKDARAAAEAKGAKNPGTVKNFLEFLGDGSSVKEIAALRDEVAEWVGGFPQPWLKS

SEQ ID NO: 9053 - DNA, 1500 bp, Gibberella zeae PH-1
  CDS (1)..(1500)
atgtctctcacaggcgtgagaggcacctcccgtgtcttgcgtaccattgcgaagccagtagccatatcagcaacatgtactcgcccagcttcttcattagccgtcgaggatcagcagcaggagaagaatcgccagaaacacttcataaacctgatcccttccgagaacttcacctcacaggctgtactggatgctctgggcagtgtgatgcaaaacaaatactcagaagggtatccaggcgcccgatattacggcggtaacgaattcatcgatcaatccgaaagactttgtcaacaacgcgctctggaatcattcggcctcgatccgaaacaatggggggtgaacgttcaagctctgtccggcgcacctgccaatctctacgtttattccgctttgctcaatacacacgaccggctaatgggtctggatctaccgcatggtggccatttatcgcacgggtaccaaacactgaccaaaaagatctctgccatttcaaagtacttcgaaactctaccataccggttgaatgaaacgactggatacattgattacgaaaaactggatgaggtggcgagcgtatacagaccaaagattatcgttgctggcgcaagtgcatacagtcgacttattgactatcagcgtatgcgagagatctgtgacaaggtcaacgcctaccttcttgccgatatcgctcacatttctggtctagttgcagccaaagtcattcctggacctttcgcacatgcagatattgtaactactacaagccataaaagtttacgaggaccccgaggtgccatgatcttttacagaaagggcattcgaagacaacaccctaaaaccaaggaggatatcctatacgacctcgaaggtccaatcaacaattccgtcttccccggtcaccaaggcggtcctcacaaccacacaattacagccctcgccgtggctctcaagcaggcccaaactcctgagttccaagcttatcagtctcaagtgctaaagaatgcaaaggcattcgcgaaacggttgagtgaacccaagggcaaaggcggcttaggttacaagcttgttagtggggggacagacaaccacttggtcctcgccgacctgaaaccacacggcatcgatggtggtcgagtagaacgcgtgctggaactagttggcgtcgcagccaacaaaaacacagtccctggagatcgttctgctttggttcctggcggtcttcgcatgggtacacctgccatgaccacgcgcggctttaacgaggacgatttcgtccgcgtcgctgatgttgttgatcgcgctgtcactatcgcttctcgcattgacaaggccgcccggaaggcggcggaggagaagggcgataagagtcctggtaagataaaggtttttctagagcatctcggcgatggtgagacacaatccgaaatcgttcagctgcgaagcgaggtcgaggattgggtaggcacataccctgtaccatggaacacgtcacaataa

SEQ ID NO: 9054 - protein, 499 aa, Gibberella zeae PH-1
MSLTGVRGTSRVLRTIAKPVAISATCTRPASSLAVEDQQQEKNRQKHFINLIPSENFTSQAVLDALGSVMQNKYSEGYPGARYYGGNEFIDQSERLCQQRALESFGLDPKQWGVNVQALSGAPANLYVYSALLNTHDRLMGLDLPHGGHLSHGYQTLTKKISAISKYFETLPYRLNETTGYIDYEKLDEVASVYRPKIIVAGASAYSRLIDYQRMREICDKVNAYLLADIAHISGLVAAKVIPGPFAHADIVTTTSHKSLRGPRGAMIFYRKGIRRQHPKTKEDILYDLEGPINNSVFPGHQGGPHNHTITALAVALKQAQTPEFQAYQSQVLKNAKAFAKRLSEPKGKGGLGYKLVSGGTDNHLVLADLKPHGIDGGRVERVLELVGVAANKNTVPGDRSALVPGGLRMGTPAMTTRGFNEDDFVRVADVVDRAVTIASRIDKAARKAAEEKGDKSPGKIKVFLEHLGDGETQSEIVQLRSEVEDWVGTYPVPWNTSQ

SEQ ID NO: 9055 - DNA, 1410 bp, Kluyveromyces lactis NRRL Y-1140
  CDS (1)..(1410)
atgccatacgctctatctgactctcacaagaacttggtttctgctcacttgtctgaaagtgatccagaagtcgaacaaatcatcaaggatgaaattgacagacaaaagcactctattgtcttgattgcttctgaaaacttcacctctacctctgttttcgatgctttgggaactccaatgtgtaacaagtattctgaaggttatccaggtgctagatactatggtggtaacgaacacattgaccgtatggaattgttgtgtcaaaagagagctctagaagctttcaacttgactgctgacaaatggggtgttaacgtccaaactttgtctggttctccagctaacttgcaagtctaccaagccttgatgagacctcatgaaagattgatgggtttgttcttgccagatggtggtcatttgtctcacggttaccaaactgaaaacagaaagatttctgctgtctccacttacttcgaatctttcccatacagagttgatccaaagactggtatcatcgactatgacactttggaaaagaatgccatcttgtacagaccaaagatcttggttgctggtacttctgcatactgtcgtttgatcgactacaagagaatgagagaaatcgccgacaaggttggtgcttacttgatggttgacatggctcacatctctggtttgatcgctgctggtgttattccatctccattcgaatacgctgacattgtcactaccactactcacaagtccttgcgtggtccaagaggtgctatgatcttcttcagaagaggtatcagatctgttaacccaaagactggtaaggaaatcccatacgatttggaaggtccaatcaacttctccgtcttcccaggtcaccaaggtggtccacacaaccataccatctctgccttggctactgctttgaagcaagccaacactccagaattcaaggagtaccaaactcaagtcttgaagaacgctaaggttctagaagagtccttcaagaagttgggttacagattagtgtccgatggtactgactcccatatggtcttagtctccttgagagaaaagggtgtcgatggtgctcgtgtcgaatacgtttgtgaaaacatcaacatcgctttgaacaagaactctatcccaggtgacaaatctgctttggtcccaggtggtgtccgtatcggtgctccagctatgactactagaggtttcggtgaaccagaattcgctagaatcgtcgactacattgacaaggccgttcaatttgctgctaagactcaacaatctttgccaaaggaagccaacaaattgaaggacttcaaggctaaggtcaacgaaggttctgaagaattgacccaattgaagaacgaaatctaccaatgggccggtgaattcccattgccagtgtaa

SEQ ID NO: 9056 - protein, 469 aa, Kluyveromyces lactis NRRL Y-1140
MPYALSDSHKNLVSAHLSESDPEVEQIIKDEIDRQKHSIVLIASENFTSTSVFDALGTPMCNKYSEGYPGARYYGGNEHIDRMELLCQKRALEAFNLTADKWGVNVQTLSGSPANLQVYQALMRPHERLMGLFLPDGGHLSHGYQTENRKISAVSTYFESFPYRVDPKTGIIDYDTLEKNAILYRPKILVAGTSAYCRLIDYKRMREIADKVGAYLMVDMAHISGLIAAGVIPSPFEYADIVTTTTHKSLRGPRGAMIFFRRGIRSVNPKTGKEIPYDLEGPINFSVFPGHQGGPHNHTISALATALKQANTPEFKEYQTQVLKNAKVLEESFKKLGYRLVSDGTDSHMVLVSLREKGVDGARVEYVCENINIALNKNSIPGDKSALVPGGVRIGAPAMTTRGFGEPEFARIVDYIDKAVQFAAKTQQSLPKEANKLKDFKAKVNEGSEELTQLKNEIYQWAGEFPLPV

SEQ ID NO: 9057 - DNA, 1482 bp, Debaryomyces hansenii CBS767
  CDS (1)..(1482)
atgattccaacaaccttacgtacattgagaacctcgtctaagagattgcctggttccttttccagatgctatgcattgtctgctaatgcacaatcattgatctcaaaagctgtgaaggacgtcgacccagagatggccgaaattttacaacaagaaagaaacagacaaaaaagctcgattactttgattccatcggaaaatttcacttccaaggctgttatggacttgttaggatcggagatgcaaaacaagtactccgaaggttaccctggtgaaagatactacggtggtaatgaaatcatagataaagctgagtcattatgtcaaaagagagcattagaagcatttgacttgaacccggaagaatggggtgtcaacgtgcagccattatccggtgctccagctaacttgtacgcttactctgctgttttggaagtaggtgacagaatcatgggtttggacttacctcacggaggacatttatcccacggttaccaaactccaacaaccaaaatttcatacatctcgaagtatttccaaaccatgccatatagattaaacgaagaaaccggtttaattgactatgacaccttagaggccaatgccatgttattcagaccaaaggttattgttgctggtacttctgcatactctagaatcattgactataagagaatgaggcaaattgccgacaaggttggtgcctacttattgagtgatatggcccacatttccggtttggtttctgctggtgtcaccgattcaccattcccattctccgatattgttaccaccaccactcacaagtccttgagaggtccaagaggtgccatgattttctacagaaagggtgttagaaaggtcaccaagaagggtaaggaaattctctacgacttagacaagaagattaacttctctgttttcccagctcaccaaggtggtccacacaatcataccatctctgctttagccgttgctttgaagcaaacttcttacccagaattcaaggaataccaaaaggatgtcgttgccaatgcagccagcttcgccagcgaattgcaatccaagggtttcactttagtttccggtggtactgacacccacttaatcttagtcgacttgagatctaagaacattgacggtgccagagttgaagccgtattagaaagagctaacattgctgccaacaagaacactgttccaggtgacaagtccgctttattcccatccggtttaagagttggtaccccagctatgaccactagaggctttggtgcctctgaattcgcaagagttgctgaattctttgaaagggctgttcagatttcaattgacttgaaggctcaagaacaaggaagctcttcaaaggaattgttggcctctttcaagcaattggctaacagtagtagtgctgttcaagaattagccaccgaagtcaaggattgggtttctacttatcctgttccaggtgatcttccataa

SEQ ID NO: 9058 - protein, 493 aa, Debaryomyces hansenii CBS767
MIPTTLRTLRTSSKRLPGSFSRCYALSANAQSLISKAVKDVDPEMAEILQQERNRQKSSITLIPSENFTSKAVMDLLGSEMQNKYSEGYPGERYYGGNEIIDKAESLCQKRALEAFDLNPEEWGVNVQPLSGAPANLYAYSAVLEVGDRIMGLDLPHGGHLSHGYQTPTTKISYISKYFQTMPYRLNEETGLIDYDTLEANAMLFRPKVIVAGTSAYSRIIDYKRMRQIADKVGAYLLSDMAHISGLVSAGVTDSPFPFSDIVTTTTHKSLRGPRGAMIFYRKGVRKVTKKGKEILYDLDKKINFSVFPAHQGGPHNHTISALAVALKQTSYPEFKEYQKDVVANAASFASELQSKGFTLVSGGTDTHLILVDLRSKNIDGARVEAVLERANIAANKNTVPGDKSALFPSGLRVGTPAMTTRGFGASEFARVAEFFERAVQISIDLKAQEQGSSSKELLASFKQLANSSSAVQELATEVKDWVSTYPVPGDLP

SEQ ID NO: 9059 - DNA, 1413 bp, Debaryomyces hansenii CBS767
  CDS (1)..(1413)
atgccatacgcattatctgaatctcacaagcaattggtcgaaggacacttgaaggacattgatcctgaagttgatcaaattatcaaggatgaagtcgatagacaaaaacattccatcgttttaattgcctctgaaaattttacttcaactgctgttttcgatgccttgggaactccaatgtgtaacaagtactctgaaggttaccctggtgctagatactacggtggtaatgagcaaatcgacaagatggaaattttgtgccaagaaagagctttgaagaccttcaatgctacttctgataaatggggtgttaatgtccaaaccttatctggttcccctgctaatttgcaagtgtaccaagctttgatgaagcctcatgaaagattaatgggattggatttacctcatggaggtcacttatctcacggttatcaaaccgactctagaaagatttcagctgtttcaacctactttgaaactatgccttacagagttaacttagataccggtttaattgactacgatatgttagaaaaaactgctgttttattcagaccaaaaattttagttgcaggtacttcagcttactgtcgtcttatcgattacaagaagatgagggaaattgccgacaaggttggtgcttatcttgttgttgatatggcgcatatttccggtttagttgctgccggtgtaattccttcaccattcgaatatgctgatgttgtcactaccactacccataagtctttaagaggtccaagaggtgctatgatcttcttcagaagaggtgttaggtctatcaacccaaagaccggtcaagagatcttatacgacttagaaaacccaattaacttctctgtcttcccaggtcaccaaggtggtcctcacaaccacaccatcgcagctttagccactgctttgaagcaagcggccactcctgaattcaagcaatatcaagagcaagtattgaagaattcgaaggtcttagaagaagaattcacgaaaaagggttataccttggtttccaatggtaccgattcccatatggttttagtttccttaaaggataaacaaattgatggtgccagagtcgagactatttgtgaaaagatcaacattgctttaaataagaattctattccaggtgataagtcagcattagtcccaggtggtgttagaattggtgctccagctatgaccaccagaggtttaggtgaagaagacttcaagaagattgtttcttatattgattttgctgtcaattacgctaaggaaatacaagctaatttaccaaaggatgctaacaagttgaaagatttcaaaaacaaggtcttgaatactgaagatgagaaattacaagctgctaagaaggaaatttcccaatgggctggtgaattcccattatcagtctaa

SEQ ID NO: 9060 - protein, 470 aa, Debaryomyces hansenii CBS767
MPYALSESHKQLVEGHLKDIDPEVDQIIKDEVDRQKHSIVLIASENFTSTAVFDALGTPMCNKYSEGYPGARYYGGNEQIDKMEILCQERALKTFNATSDKWGVNVQTLSGSPANLQVYQALMKPHERLMGLDLPHGGHLSHGYQTDSRKISAVSTYFETMPYRVNLDTGLIDYDMLEKTAVLFRPKILVAGTSAYCRLIDYKKMREIADKVGAYLVVDMAHISGLVAAGVIPSPFEYADVVTTTTHKSLRGPRGAMIFFRRGVRSINPKTGQEILYDLENPINFSVFPGHQGGPHNHTIAALATALKQAATPEFKQYQEQVLKNSKVLEEEFTKKGYTLVSNGTDSHMVLVSLKDKQIDGARVETICEKINIALNKNSIPGDKSALVPGGVRIGAPAMTTRGLGEEDFKKIVSYIDFAVNYAKEIQANLPKDANKLKDFKNKVLNTEDEKLQAAKKEISQWAGEFPLSV

SEQ ID NO: 9061 - DNA, 1446 bp, Yarrowia lipolytica CLIB122
  CDS (1)..(1446)
atgcagcgattcactcgactttcccggcctctcaaccgaggcctgcttcgagcctacgccaccaaggcgtcgcccgatacccagatgactcagcagaccttgtacgcgtccgatcccgagatcgcagacatcatcaagaaggaaaccgaccggcagatcggctccatcaccctgatcccgtcggaaaacttcacctcgcaggccgtcatgaacgccctgggctccgtcatgcagaacaagtactctgagggctaccctggcgcccgatactacggtggtaacgagttcattgatcaggccgagtctctgtgccagaagcgagccctggaggcgttcaacctggaccccaaggtctggggagtcaacgtccagcccctgtctggtgcccccgcaaacctctacgcttactccgctgtcatggaggccggtgaccgactgatgggcctggacctgccccatggaggccatctctcccacggctaccagatcccctccaagaagatctcctacatctccaagtacttcaacaccatgccctaccgactggacgagtcaaccggtctcattgactatgacacgctcgccaagaacattcttcttttccgacccaaggtgctggttgctggagcttccgcctactctcgtctgatcgactacaagcgaatgcgagagatcgccgactctgtgggcgccattctcatgtctgacatggcccacatttccggtatggttgccgctggcgtcatcccctcgccttttgagtactcggacattgtgaccaccaccacccacaagtctcttcgaggcccccgaggtgccatgatcttctaccgaaaggacggtgaccgaaacctcgaggagaagatcaacttctccgtcttccccggccaccagggaggtccccataaccacaccatcaccgctctggccgttgcgcttggccaggccaagtctcccgagttcaaggagtaccagcagaaggttgtcgacaacgcccaggccttctccaaggctctgtctgacgccggcttcaagcttgtttctgacggaaccgacacccatctgatcctcattgatctgaaacccttttccattgacggtgctcgaaccgagatggttcttgacggtatgaacattgccgctaacaagaacaccgtgcccggcgacaagtctgctcttgtgcccggtggtatccgaatcggtactcccgccatgaccaccagaggttttgatcagtctgagttcgagcaggttgccaagtacattgtcaaggccgtcgatattgccaagcgactcaagcagaaggctgtttccgagggcgtcaagaagatctcccagttccggccctacgtcgatgctgatgccgaggtcaaggagctccgaaacgaggtcgagtcctgggccaagaagtaccctttccctattgatcctgctggatacaaatag

SEQ ID NO: 9062 - protein, 481 aa, Yarrowia lipolytica CLIB122
MQRFTRLSRPLNRGLLRAYATKASPDTQMTQQTLYASDPEIADIIKKETDRQIGSITLIPSENFTSQAVMNALGSVMQNKYSEGYPGARYYGGNEFIDQAESLCQKRALEAFNLDPKVWGVNVQPLSGAPANLYAYSAVMEAGDRLMGLDLPHGGHLSHGYQIPSKKISYISKYFNTMPYRLDESTGLIDYDTLAKNILLFRPKVLVAGASAYSRLIDYKRMREIADSVGAILMSDMAHISGMVAAGVIPSPFEYSDIVTTTTHKSLRGPRGAMIFYRKDGDRNLEEKINFSVFPGHQGGPHNHTITALAVALGQAKSPEFKEYQQKVVDNAQAFSKALSDAGFKLVSDGTDTHLILIDLKPFSIDGARTEMVLDGMNIAANKNTVPGDKSALVPGGIRIGTPAMTTRGFDQSEFEQVAKYIVKAVDIAKRLKQKAVSEGVKKISQFRPYVDADAEVKELRNEVESWAKKYPFPIDPAGYK

SEQ ID NO: 9063 - DNA, 1416 bp, Yarrowia lipolytica CLIB122
  CDS (1)..(1416)
atgtcttcgtacgccctttccaacaaccataaggatctcattgaagcctccctccacgacctcgaccccgaggtcgagggcatcatgaaggacgagattgaccgacagaagcactccatcgtcctcattgcctccgaaaacttcacctccaagtctgttttcgacgcccttggatctcccatgtgcaacaagtactccgagggataccccggcgcccgatactacggtggtaaccagcacattgaccgaatcgagactctgtgccagaaccgagccctcaaggccttcggcgtcacccccgacaagtggggcgtcaacgtccagaccctgtctggctctcccgcaaacctccaggtctatcaggccatcatgaagccccacgatcgactcatgggtcttgatctgccccacggaggccatctttctcacggttaccagaccgacaaccgaaagatctccgccgtctccacctacttcgagaccatgccctaccgagtcgacctcgagaccggcatcatcgactacgacatgctcgagaagaccgccatcctctatcgacccaaggttctggttgccggaacctccgcttactgccgactcattgactacaagcgaatgcgagagattgccgacaaggttggcgcttacctcgttgtcgacatggcccatatttccggcctgatcgccgccggtgtcatcccctctccctttgagtacgctgacattgtcaccaccaccacccacaagtctctgcgaggcccccgaggtgccatgatctttttccgacgaggtgtccgatccgtcgaccccaagactggtaaggagattctctacgaccttgagaaccccatcaacttttccgtcttccccggccaccagggaggtccccacaaccacaccatcaccgctctggccgttgccctgaagcaggctgctgaccccactttccgggagtaccaggagcaggttctcaagaacgccaaggctctggagaccgagttcaacaagctcggttacaacctcgtgtccggcggaaccgactcccacatggttctggtttccctgcgagacaagggcattgacggtgctcgagtcgagactgtttgcgagcagatcaacattgctctcaacaagaactccatccccggtgacaagtctgcccttgtccccggtggtgtccgaatcggtgctcccgccatgtccacccgaggcttcggcgaggaggacttcaagaagattgccaactacatctcgcaagccgtcgatctcgccattgagatccagcagggactgcccaaggaggccaacaagctcaaggacttcaaggctgctgcccaggctggtggcaaccccaagatcgaggctctcaagaccgagatctccaactgggccggccagttccctctgcccgtttaa

SEQ ID NO: 9064 - protein, 471 aa, Yarrowia lipolytica CLIB122
MSSYALSNNHKDLIEASLHDLDPEVEGIMKDEIDRQKHSIVLIASENFTSKSVFDALGSPMCNKYSEGYPGARYYGGNQHIDRIETLCQNRALKAFGVTPDKWGVNVQTLSGSPANLQVYQAIMKPHDRLMGLDLPHGGHLSHGYQTDNRKISAVSTYFETMPYRVDLETGIIDYDMLEKTAILYRPKVLVAGTSAYCRLIDYKRMREIADKVGAYLVVDMAHISGLIAAGVIPSPFEYADIVTTTTHKSLRGPRGAMIFFRRGVRSVDPKTGKEILYDLENPINFSVFPGHQGGPHNHTITALAVALKQAADPTFREYQEQVLKNAKALETEFNKLGYNLVSGGTDSHMVLVSLRDKGIDGARVETVCEQINIALNKNSIPGDKSALVPGGVRIGAPAMSTRGFGEEDFKKIANYISQAVDLAIEIQQGLPKEANKLKDFKAAAQAGGNPKIEALKTEISNWAGQFPLPV

SEQ ID NO: 9065 - DNA, 1377 bp, Aspergillus nidulans FGSC A4
  CDS (1)..(1377)
atggaggaccgcctcgtcgacactgaccccgaggtcgctaagatcatggagaatgagatccaacgtcagcgtgaatctgttgtcttgattgcttcggagaacttcacttcccgcgctgtcttcgatgctcttggttctcccatgtgcaacaagtattccgagggttaccccggtgctcgttactatggtggaaaccagcacattgacgctatcgagctgctctgccagtcccgtgcccttaaggcattcaacctcgacgccgataagtggggtgtcaacgttcagtgccttagtggcagcccggccaatttgcaggtctaccaggctctcatgcgcccccatgaccgtctcatgggtctcgaccttccccacggtggtcacctgagccacggttatcagactccttccaggaagatctctgctgtgtctacttacttcgagaccttcccttaccgcgttaacctcgagaccggtattattgactacgacacccttgaagccaacgctgagctgtaccgccccaagattttggttgccggtacctctgcctactgccgtctgatcgactatgcccgcatgcgcaagatcgctgacaaggttggcgcctaccttgttgttgacatggcccacatctccggtctgattgctgctggtgtcatcccctctcctttcgagtacgccgatgtagtcaccactaccactcacaagtctctccgcggtccccgtggtgccatgattttcttccgcaagggcgtccgcagcactgaccccaagactggtaaggacatcatgtatgacctcgagggtcccatcaacttctccgtcttccctggtcaccagggtggtccccacaaccacaccatcactgctctctctgtcgccctcaagtacgccgctaccaccgagttcaagcagtaccaggagcaggtgatcaagaacgccaaggcccttgagaacgaattcaaggccattggccacaagctcgtctccgacggtaccgacagccacatggtactcgtggatctccgccccaagtctctcgacggtgcccgtgtcgaagccgtcctcgagcagatcaacattgcttgcaacaagaactccatccctggtgacaagtctgctctcactccctgcggtatccgcattggtgctcccgccatgaccagccgtggtatgggcgaggaggacttcaagcgcatcgctcgctacattgaccaggccatcaacatctgcaagtccgtgcaggccgcacttcccacggatgccaacaagctcaaggacttcaaggccaaggttgcttccggcaccgtccctgagatcaacgacctgcgcaaggagatcgctgcgtgggccagcaccttccctctccctgtctaa

SEQ ID NO: 9066 - protein, 458 aa, Aspergillus nidulans FGSC A4
MEDRLVDTDPEVAKIMENEIQRQRESVVLIASENFTSRAVFDALGSPMCNKYSEGYPGARYYGGNQHIDAIELLCQSRALKAFNLDADKWGVNVQCLSGSPANLQVYQALMRPHDRLMGLDLPHGGHLSHGYQTPSRKISAVSTYFETFPYRVNLETGIIDYDTLEANAELYRPKILVAGTSAYCRLIDYARMRKIADKVGAYLVVDMAHISGLIAAGVIPSPFEYADVVTTTTHKSLRGPRGAMIFFRKGVRSTDPKTGKDIMYDLEGPINFSVFPGHQGGPHNHTITALSVALKYAATTEFKQYQEQVIKNAKALENEFKAIGHKLVSDGTDSHMVLVDLRPKSLDGARVEAVLEQINIACNKNSIPGDKSALTPCGIRIGAPAMTSRGMGEEDFKRIARYIDQAINICKSVQAALPTDANKLKDFKAKVASGTVPEINDLRKEIAAWASTFPLPV

SEQ ID NO: 9067 - DNA, 1482 bp, Candida albicans SC5314
  CDS (1)..(1482): transl_table=12
atgctttcatctacgttacgtcgttctgtgagagctcaatccaagaatttgccagcttttgcaagaagagcctatgccgtttctccatctgctcaagcattaatttccaaatccgttcaagatgttgaccctgagatggcggatattttgaatcaagaaagaaccagacaaaagaactcaattactttgattccatcagagaattttacctctaaagcagttatggatttgttgggttcagaaatgcaaaacaaatattctgaagggtaccctggagagagatattatgggggtaatgaaataatcgataaagctgaagcattatgtcaaaaaagagctttagaagcatttggattggacccatctcaatggggggttaatgtacagccattatctggtgctccagccaatttgtatgcttatagtgcaattttagaagttggtgacagaattatgggtttagatttacctcatggtggtcatttgtctcatggatatcaaaccaacactaccaagatttcctacatttccaaatacttccaaaccatgccatatagattaaatgaagaaactggtataattgattacgatactttagaaaaaaacgctcaattgtttagacctaaagtaattgttgctggtgcttcagcttattctcgtgtcattgactacaaaagaatgagacaaattgctgataaggttggagcttacttattgtccgatatggcccacatctctgggttagtttctgctggtgttactgattcaccattcccatattctgatattgtcaccactactacccataaatcgttgagaggaccaagaggagccatgattttctttagaaaaggaatcagaaaggttaccaaaaagggtaaagaaattccttatgaattggaaagaaagatcaatttctcggttttcccagggcatcaaggtggtccacataatcatactatttctgctttagcagttgctttaaaacaatgtactgaaccagaatatgttaaataccaacaagaagttgtttctaatgccaaacattttgctgatgcattagtctccaagggtttcaaattggtttccgatggtactgatactcatttgatcttggttgatttaagatcaagaaatattgatggtgctagagttgaagctgttttggaaagagccaacatagctgccaataaaaacaccgttcctggtgatgtatcagctcttttcccatcaggtttaagagttggtactccagctatgaccactagaggatttgggccagaagagtttgataaagttgctgaattcattgatcaagccgttaacattgccattgaattaaaagctcaagaacaaggtaaagtaccaaaagaattattggcatcatttaaaaaattagctgatgaaagtgataaagttaaacaattagataaagaagttgtcagttgggtcagtaaatatcctgtcccaggtgaattgtaa

SEQ ID NO: 9068 - protein, 493 aa, Candida albicans SC5314
MLSSTLRRSVRAQSKNLPAFARRAYAVSPSAQALISKSVQDVDPEMADILNQERTRQKNSITLIPSENFTSKAVMDLLGSEMQNKYSEGYPGERYYGGNEIIDKAEALCQKRALEAFGLDPSQWGVNVQPLSGAPANLYAYSAILEVGDRIMGLDLPHGGHLSHGYQTNTTKISYISKYFQTMPYRLNEETGIIDYDTLEKNAQLFRPKVIVAGASAYSRVIDYKRMRQIADKVGAYLLSDMAHISGLVSAGVTDSPFPYSDIVTTTTHKSLRGPRGAMIFFRKGIRKVTKKGKEIPYELERKINFSVFPGHQGGPHNHTISALAVALKQCTEPEYVKYQQEVVSNAKHFADALVSKGFKLVSDGTDTHLILVDLRSRNIDGARVEAVLERANIAANKNTVPGDVSALFPSGLRVGTPAMTTRGFGPEEFDKVAEFIDQAVNIAIELKAQEQGKVPKELLASFKKLADESDKVKQLDKEVVSWVSKYPVPGEL

SEQ ID NO: 9069 - DNA, 1413 bp, Candida albicans SC5314
  CDS (1)..(1413): transl_table=12
atgtctgcttacgctttatctcaatctcatagacaattgactgaaggtcatttaaaagatactgatcctgaagttgatcaaatcattaaagatgaaattgatagacaacaacattccattgttttaattgcttcagaaaatttcactactactgctgttttcgatgccttgggaactccaatgtgtaataaatattctgaaggttatcctggtgctagatattatggtggtaatgaacatattgatagaatggaacttttgtgtcaagaaagagctttaaaagcttttggtttgactccagataaatggggggttaatgttcaaactttgagtggatctccagctaatttacaagtttatcaagccattatgaaacctcatgaaagattaatggggttggatttaccccatggtggtcatttatctcatggttatcaaaccgattcaagaaaaatttctgctgtttccacttattttgaaaccatgccttacagagttgatttagaaactggattgattgattatgatatgttggaaaaaactgctgttttgtatagaccaaaagttttagttgctggtacttctgcttattgtagattaattgattacaaaagaatgagagaaattgccgataaagttggtgcttaccttgttgttgatatggctcatatttccggtttaattgctgctggtgttatcccatcaccatttgaatacgctgatattgtcaccaccactactcataaatcattaagaggtccaagaggtgccatgattttctttagaagaggggtaagatcagttaatccaaagactggtcaagaaatcttgtatgatttagaaaacccaattaacttctcagtgttcccaggtcatcaaggtggtccacataatcataccattgctgccttggctactgctttgaaacaagctaatactccagaatttaaagaatatcaagaacaagttttgaaaaatgctaaagctttagaaagtgaattcaccaaaaaaggttataaattagtttctgacggtactgattctcatatggttttagtgtctttaaaagataaacaaattgatggtgctagagttgaaactgtttgtgaaaaaatcaatattgctttgaataagaattccattcctggagataaatcagctttagttccaggtggagttagaattggtgccccagccatgactacaagaggtttaggtgaagaagatttcaagaaaatcgttagttatattgattttgctgtcaattatgctaaggaagttcaatcacaattaccaaaagatgctaataaattgaaagatttcaaaaatgctgtttctggtgatctggaaaaacttaaagctgttagagatgaaatttatcaatgggctggttctttcccattagcagtataa

SEQ ID NO: 9070 - protein, 470 aa, Candida albicans SC5314
MSAYALSQSHRQLTEGHLKDTDPEVDQIIKDEIDRQQHSIVLIASENFTTTAVFDALGTPMCNKYSEGYPGARYYGGNEHIDRMELLCQERALKAFGLTPDKWGVNVQTLSGSPANLQVYQAIMKPHERLMGLDLPHGGHLSHGYQTDSRKISAVSTYFETMPYRVDLETGLIDYDMLEKTAVLYRPKVLVAGTSAYCRLIDYKRMREIADKVGAYLVVDMAHISGLIAAGVIPSPFEYADIVTTTTHKSLRGPRGAMIFFRRGVRSVNPKTGQEILYDLENPINFSVFPGHQGGPHNHTIAALATALKQANTPEFKEYQEQVLKNAKALESEFTKKGYKLVSDGTDSHMVLVSLKDKQIDGARVETVCEKINIALNKNSIPGDKSALVPGGVRIGAPAMTTRGLGEEDFKKIVSYIDFAVNYAKEVQSQLPKDANKLKDFKNAVSGDSEKLKAVRDEIYQWAGSFPLAV

SEQ ID NO: 9071 - DNA, 1533 bp, Ustilago maydis 521
  CDS (1)..(1533)
atggcttcccgtcgttcttacgcaacactcgttcaaagcttcctgaagcactcttccctccctgtcgtccgaggtcctgcttctcctgcctccatccttcctcgcacctttgccacctctgttctcaagatgtccattgccgtccccaccgatttcaacaaggttctctaccagcctctggccgaggctgaccccgaggtccagcagattatcgagaatgagacttaccgtcaattctccggtctcgagctcatcgcttccgagaatctgacctcactcgccaccatggaagctaacggctccatccttactaacaagtattctgagggtcttcccggtgcccgatactacggcggtaacgagtacatcgaccagctagaggttctctgccagcagcgtgccttgaaggccttcaacctcgaccccaaggtctggggcgtcaacgttcagccttactctggctccaccgccaactttgctaccttcaccgccctcctccagccccaggaccgtatcatgggtctcggccttccttccggtggccacttgacccatggttactacaccgccaagaagaagatctcggcttcttcgatctacttccagtcgttcccttacaacgttgaccccgccaccggctacatcaactacgacgagctcaagaagaacgctgatcttttcaagccccgcatggtcatctgcggtggttccgcctacccccgtgactgggactacgccaagcttgccgagattgccaagactcagtccgcttacctcatggccgacattgcccacatctctggtctcgttgccgcccaggtgcagaacaaccccttcgagtactgtgacattgtcaccaccactactcacaagaccctccgcggtccccgtgctggtatgatcttcttccgcaaggatcgtgatgccgagattgagggtcgtgtcaatgcggccgtcttccctgcctgccagggcggcccccacaacaacaccattgccggtatcgctgttgcgctcaagcaggtcgccgaccccgctttcaagcagtacgccacccaagtcatcaagaactcgcaggccattgccaaggtcctctctggcaagggctacaagctccagactgacggctcggagaaccacctgattctttgggacttgcgtcctcttggcctcaccggctccaaggtcgagaacatttgcgaccttgcgcacatcacgctcaacaagaacgccgtcagcggtgacacttcggcccttgtgcccggtggtgttcgtatcggcactggtgcccttacctcgcgatccatgggcgagaaggacatggagaaggtggctgagttccttgaccgcgtcgtccagatctcgcttgagattcaaaagacgtcgggcaagaaactcgttgacttcatgaacgctgcccgccagtcggaggccgtcaagcagctcaacaaggacgtcgaggcctttgccaccagcttcccccttcctggtgttcccgacacctcgatcatcaagaagcccgccgctcactaa

SEQ ID NO: 9072 - protein, 510 aa, Ustilago maydis 521
MASRRSYATLVQSFLKHSSLPVVRGPASPASILPRTFATSVLKMSIAVPTDFNKVLYQPLAEADPEVQQIIENETYRQFSGLELIASENLTSLATMEANGSILTNKYSEGLPGARYYGGNEYIDQLEVLCQQRALKAFNLDPKVWGVNVQPYSGSTANFATFTALLQPQDRIMGLGLPSGGHLTHGYYTAKKKISASSIYFQSFPYNVDPATGYINYDELKKNADLFKPRMVICGGSAYPRDWDYAKLAEIAKTQSAYLMADIAHISGLVAAQVQNNPFEYCDIVTTTTHKTLRGPRAGMIFFRKDRDAEIEGRVNAAVFPACQGGPHNNTIAGIAVALKQVADPAFKQYATQVIKNSQAIAKVLSGKGYKLQTDGSENHLILWDLRPLGLTGSKVENICDLAHITLNKNAVSGDTSALVPGGVRIGTGALTSRSMGEKDMEKVAEFLDRVVQISLEIQKTSGKKLVDFMNAARQSEAVKQLNKDVEAFATSFPLPGVPDTSIIKKPAAH

SEQ ID NO: 9073 - DNA, 1482 bp, Candida albicans SC5314
  CDS (1)..(1482): transl_table=12
atgctttcatctacgttacgtcgttctgtgagagctcaatccaagaatttgccagcttttgcaagaagaacctatgccgtttctccatctgctcaagcattaatttctaaatccgttcaagatgttgaccctgagatggcggatattttgaatcaagaaagaaccagacaaaagaactcaattactttgattccatcagagaattttacctctaaagcagttatggatttgttgggttcagaaatgcaaaacaaatattctgaagggtaccctggagaaagatattatgggggtaatgaaataatcgataaagctgaagcattatgtcaaaaaagagctttagaagcatttggattggacccatctcaatggggggttaatgtacagccattatctggtgctccagccaatttgtatgcttatagtgcaattttagaagttggtgacagaattatgggtttagatttacctcatggtggtcatttgtctcatggatatcaaaccaacactaccaagatttcctacatttccaaatacttccaaaccatgccatatagattaaatgaagaaactggtataattgattacgatactttagaaaaaaatgctcaattgtttagacctaaagtaattgttgctggtgcttcagcttattctcgtgtcattgactacaaaagaatgagacaaattgctgataaggttggagcttatttattgtccgatatggcccacatctctgggttagtttctgctggtgttactgattcaccattcccatattctgatattgtcaccactactacccataaatcgttgagaggaccaagaggagccatgattttctttagaaaaggaatcagaaaggttaccaaaaagggtaaagaaattccttatgaattggaaagaaagatcaatttctcggttttcccagggcatcaaggtggtccacataatcatactatttctgctttagcagttgctttaaaacaatgtactgaaccagaatatgttaaataccaacaagaagttgtttctaatgccaaacattttgctgatgcattagtctccaagggtttcaaattggtttccgatggtactgatactcatttgatcttggttgatttaagatcaagaaatattgatggtgctagagtcgaagctgttttggaaagagctaacatagctaccaataagaacaccgttcctggtgatgtatcagctcttttcccatcaggtttaagagttggtactccagctatgaccactagaggatttgggccagaagagtttgataaagttgctgaattcattgatcaagccgttaacattgccattgaattaaaagctcaagaacaaggtaaagtaccaaaagaattattggcatcatttaaaaaattggctgatgaaagtgataaagttaaacaattagataaagaagttgtcagttgggtcagtaaatatcctgtcccaggtgaattgtaa

SEQ ID NO: 9074 - protein, 493 aa, Candida albicans SC5314
MLSSTLRRSVRAQSKNLPAFARRTYAVSPSAQALISKSVQDVDPEMADILNQERTRQKNSITLIPSENFTSKAVMDLLGSEMQNKYSEGYPGERYYGGNEIIDKAEALCQKRALEAFGLDPSQWGVNVQPLSGAPANLYAYSAILEVGDRIMGLDLPHGGHLSHGYQTNTTKISYISKYFQTMPYRLNEETGIIDYDTLEKNAQLFRPKVIVAGASAYSRVIDYKRMRQIADKVGAYLLSDMAHISGLVSAGVTDSPFPYSDIVTTTTHKSLRGPRGAMIFFRKGIRKVTKKGKEIPYELERKINFSVFPGHQGGPHNHTISALAVALKQCTEPEYVKYQQEVVSNAKHFADALVSKGFKLVSDGTDTHLILVDLRSRNIDGARVEAVLERANIATNKNTVPGDVSALFPSGLRVGTPAMTTRGFGPEEFDKVAEFIDQAVNIAIELKAQEQGKVPKELLASFKKLADESDKVKQLDKEVVSWVSKYPVPGEL

SEQ ID NO: 9075 - DNA, 1239 bp, Clostridium thermocellum ATCC 27405
  CDS (1)..(1239): transl_table=11
atgtttaatttgaatgaaatatcaaaaatcgatcccgaagttgcgaaggcaattgaattggaggttaatcgtcagagaaacaagatagagcttattgcatctgaaaattttgtcagtaaagccgtaatagaagcaatgggtacacctctgaccaacaagtatgctgaaggatatccgggaaaaaggtattacggaggctgtgagtttgttgacataattgaaaatcttgcgattgaacgggcaaagaaaatattcggagctgagcatgcgaatgtgcagccgcattcaggggctcaggcaaatatggctgtgttttttgcagtgttaaatcccggagatacgattcttggaatgaatctttcccatggagggcatttgagccatggaagccctgtcaacatgtccggaaaatattataatgtcatatcctacggagtaaggaaggaagactgcagaatagactatgacgaagtgagaaagcttgcaaaggaacacaggccgaaacttatagtggcgggagccagtgcatatccaagaataatagattttaaggctttcagagatattgcggatgaagtcggagcatatttgatggtggatattgcacatatagcaggtcttgttgcagcaggactgcacccgaatcctgttccttatgcacattttgttaccaccaccactcacaagactttgagaggtccgagaggcggactgatattgtgcggcaatgagcatgcaaaaatgattgacaaggctgttttcccgggaatacagggcggtcctctgatgcatgttattgcggcaaaagcggtaagctttgccgaagtattgaccgatgaattcaagcagtatcagcagcagatagtaaaaaatgcgaaaactcttgccaacgctttgatggagaaaggcattgaccttgtttccggtggaacggacaaccatctcatgctggttgatttaagaaataaaggtcttacgggtaaatacgttcagcatattcttgatgaggtttgcattaccgtaaataaaaacggaattccttttgaccctgaaagtccgtttgttaccagcggtatcagaataggaacacctgcggtgacggcacggggtatgaaagaagaggatatggttgagatagcggatcttatcaatctcaccattacggattatgagaattcgaaagagaaagtaaaggaaagagtaagaatgctatgcgaaaaatatcctttgtatcagtaa

SEQ ID NO: 9076 - protein, 412 aa, Clostridium thermocellum ATCC 27405
MFNLNEISKIDPEVAKAIELEVNRQRNKIELIASENFVSKAVIEAMGTPLTNKYAEGYPGKRYYGGCEFVDIIENLAIERAKKIFGAEHANVQPHSGAQANMAVFFAVLNPGDTILGMNLSHGGHLSHGSPVNMSGKYYNVISYGVRKEDCRIDYDEVRKLAKEHRPKLIVAGASAYPRIIDFKAFRDIADEVGAYLMVDIAHIAGLVAAGLHPNPVPYAHFVTTTTHKTLRGPRGGLILCGNEHAKMIDKAVFPGIQGGPLMHVIAAKAVSFAEVLTDEFKQYQQQIVKNAKTLANALMEKGIDLVSGGTDNHLMLVDLRNKGLTGKYVQHILDEVCITVNKNGIPFDPESPFVTSGIRIGTPAVTARGMKEEDMVEIADLINLTITDYENSKEKVKERVRMLCEKYPLYQ

SEQ ID NO: 9077 - DNA, 1245 bp, Clostridium difficile 630
  CDS (1)..(1245): transl_table=11
atgtttgagaacttgaaaaaagcggaccctgagatttatgaaagtatgaaaagagagttaaaaagacaacaaagaaatattgaattaatagcatctgaaaacatagtatcagttccagtaatggaaactatgggaagtcatcttacaaataagtatgcagaaggttactcaggcaaaagatattatggtggatgtgaatacatagatgaagttgaaactcttgcaatagatagaatcaaaaaaatatttggagcagaacatgctaatgttcaacctcactctggagcaaatgcaaatattggtgtatattttgctatgttaaaaccaggtgatgttgttatgggaatgaatttatctcaaggtggacatttaactcatggtgctccagttaatatttctggtcaatattataaattttatgaatatggtatagataaagacagtggacttatagattttgatgaagttagaaagatagcacatgaagtaaaacctaaaatgatagttgcaggagcaagtgcatatcctagagaaatagattttaaaaagtttagagagatagctgatgaggttggagcattgcttatggtagatatggctcatatagcaggtcttgtggctgctggtcttcaccaaaatccatgtgaagtggctgattttgttacaacaacaactcacaaaactttaagaggacctcgtgggggtgttattctttgtaaagaaaaatatgctaaagacatagacaaagcaatattccctggtattcaaggtggacctcttgaacatataattgcttctaaggcagtttgctttaaagaagctttaagtgatgagtttaaagaatatcaggtacaagttgctaaaaatgcaaaagccttagctgaagaacttattaaaagagattttaaattgatttctggaggtacagataatcatttaatactattagatttgactaataaaaatataactggtaaagcagcagaaaagagattggatgatgcttatataacagctaataaaaatacaattccatttgacccaaatggtgctcttgttacaagtggaataagacttggtactccagctgtaactactagaggtatgaaagaagaagatatggcaataatcgctgaggctatagacctatgtttaacttatgatgaagaatctaaggctagaacattggttgttggtttaactgaaaaatatcctttatatgaagaatataatgttatggattaa

SEQ ID NO: 9078 - protein, 414 aa, Clostridium difficile 630
MFENLKKADPEIYESMKRELKRQQRNIELIASENIVSVPVMETMGSHLTNKYAEGYSGKRYYGGCEYIDEVETLAIDRIKKIFGAEHANVQPHSGANANIGVYFAMLKPGDVVMGMNLSQGGHLTHGAPVNISGQYYKFYEYGIDKDSGLIDFDEVRKIAHEVKPKMIVAGASAYPREIDFKKFREIADEVGALLMVDMAHIAGLVAAGLHQNPCEVADFVTTTTHKTLRGPRGGVILCKEKYAKDIDKAIFPGIQGGPLEHIIASKAVCFKEALSDEFKEYQVQVAKNAKALAEELIKRDFKLISGGTDNHLILLDLTNKNITGKAAEKRLDDAYITANKNTIPFDPNGALVTSGIRLGTPAVTTRGMKEEDMAIIAEAIDLCLTYDEESKARTLVVGLTEKYPLYEEYNVMD

SEQ ID NO: 9079 - DNA, 1245 bp, Herminiimonas arsenicoxydans
  CDS (1)..(1245): transl_table=11
atgttttcaaaagaccagaccctcgcaaaaacagatactgaactgtggtcggcgatccagcaggaaaatacgcgtcagcaggatcatatcgagctgatcgcatccgagaattacacttcgcctgccgtgatggaagcgcaaggttcgcaactgacaaataagtatgccgaaggttatccgggcaagcgttattacggcggttgcgagtacgtcgatatcgtcgaacagctggcgatcgatcgcgtcaagaaattgttcggcgccgaagcagccaacgtacagccgaattccggctcgcaggcgaaccagggcgtgttctttgccgtcctcaagccgggcgacaccatcatgggcatgtcgctggcagaaggcggccacctgacacacggcatggcattgaacatgtcgggcaaatggttcaatgtggtttcctacggtctgaacgacaaggaagaaatcgattacgaacagatggaacgtctggcgcgtgaacacaagcctaagatgatcattgccggcgcatcggcgtatgcactgcgcatcgactttgaacgctttgcaaaaattgcgaaggaaatcggcgcctacttcatggtggacatggcgcattacgccggtctgatcgctgcaggcgaatatccgaatccggtaccgtacgccgatttcgttacctctacgacccataaatcactgcgcggcccgcgcggcggcttcatcctgatgaaagccgaacacgagaaaatcatcaactcggcaattttccccggcatccagggcggcccattgatgcatgtcatcgccggcaaggcagtggcattcaaggaagcgctggcacccgagttcaaggtctatcagcaacaagtcctcaagaatgcagatgcattggccaaggccttgatcgcacgcggcttgcgcatcgtttccaatcgcaccgaatcgcacgtgatgctggtcgatctgcgcgccaaaaaaatcaccggcaaggatgcagaagcattgctgggttccgcgcacatcacgaccaacaagaacggcattcccaacgatccggaaaaaccgtttgtttcttccggtattcgtctcggcagccctgcgatgaccacccgtggtttcaaggaagcggaagcgaccaaggtcggcaatctgatcgccgacgtgctggataatccgaacgatgcagcaaccatcgaacgcgtgaaagccgaagtcaagaaactgactgatgctttcccggtttacggctga

SEQ ID NO: 9080 - protein, 414 aa, Herminiimonas arsenicoxydans
MFSKDQTLAKTDTELWSAIQQENTRQQDHIELIASENYTSPAVMEAQGSQLTNKYAEGYPGKRYYGGCEYVDIVEQLAIDRVKKLFGAEAANVQPNSGSQANQGVFFAVLKPGDTIMGMSLAEGGHLTHGMALNMSGKWFNVVSYGLNDKEEIDYEQMERLAREHKPKMIIAGASAYALRIDFERFAKIAKEIGAYFMVDMAHYAGLIAAGEYPNPVPYADFVTSTTHKSLRGPRGGFILMKAEHEKIINSAIFPGIQGGPLMHVIAGKAVAFKEALAPEFKVYQQQVLKNADALAKALIARGLRIVSNRTESHVMLVDLRAKKITGKDAEALLGSAHITTNKNGIPNDPEKPFVSSGIRLGSPAMTTRGFKEAEATKVGNLIADVLDNPNDAATIERVKAEVKKLTDAFPVYG

SEQ ID NO: 9081 - DNA, 1260 bp, Burkholderia vietnamiensis G4
  CDS (1)..(1260): transl_table=11
atgttttccaaagaacaaaccattgccggtttcgatccggatctgcatgaggccatgcgtctcgagcgacagcgccaggaggcgcacatcgagctgatcgcttcggaaaactatacgagcccgcgcgtgctcgaggcacagggatcggtgctgaccaacaaatacgccgaaggctacccgggcaagcgctactacggcggctgcgaacacgtcgacgtggtcgaacagctggcgatcagccgcgcgaaggcgctgttcaatgccgatttcgcgaacgtgcagccgcatagcggctcgcaggcgaacgcggccgtctatctggcgctgctcacgcccggcgacacgatcctcggcatgagcctcgcgcacggcggccatctgacgcacggtgcgaaggtgtcgttttcggggaaggtgttcaatgcggtccagtacggcgtcgatgcgacaaccgggctgatcgattacgacgagatcgaacgtctcgcgctcgagcatcggccgaagatgatcgtcgccggcttttccgcgtattcgcgggttctcgatttcgcacgcttccgcgcgatcgctgacaaggtcggcgcctatctgttcgtcgacatggcgcacgtcgccgggcttgtcgcggcgggcctgtatccgaacccggtgccgtttgccgacgtcgtgacgaccacgacgcacaagacgctgcgcgggcctcgtggcggcctgattctggcccgcgccaacgaggagatcgagaaaaagctgaactcgatggtgtttccgggcacgcaaggcggcccgctgatgcatgtcgttgccgcgaaggcggtcgcgttcaaggaagcactggggccggagttcgtcacgtatcagaagcagacgctcgcgaacgcgcgggcgatggtcgaggtgttcaacgcgcgcggctacgacgtcgtgtcgggcggcaccgacgatcacctgttcctcgtcagcctcgtcaagaagggcatcaccggcaaggatgccgatgcggcgctggggcgcgcgcacatcacggtgaacaagaacacggtgccgaacgatccccaatcgccgttcgtgacgagcggcatccgcatcggcacgccggcgatcacgacgcgcggctttctcgaggcggacgccgcacataccgcgcaattgatgtgcgacgcgctcgaccggctcggcgacgcgcaggtcgaagctgctgtgcgcacccaggtggcgcagctctgcgcgcgcttcccggtttatctcggactgtga

SEQ ID NO: 9082 - protein, 419 aa, Burkholderia vietnamiensis G4
MFSKEQTIAGFDPDLHEAMRLERQRQEAHIELIASENYTSPRVLEAQGSVLTNKYAEGYPGKRYYGGCEHVDVVEQLAISRAKALFNADFANVQPHSGSQANAAVYLALLTPGDTILGMSLAHGGHLTHGAKVSFSGKVFNAVQYGVDATTGLIDYDEIERLALEHRPKMIVAGFSAYSRVLDFARFRAIADKVGAYLFVDMAHVAGLVAAGLYPNPVPFADVVTTTTHKTLRGPRGGLILARANEEIEKKLNSMVFPGTQGGPLMHVVAAKAVAFKEALGPEFVTYQKQTLANARAMVEVFNARGYDVVSGGTDDHLFLVSLVKKGITGKDADAALGRAHITVNKNTVPNDPQSPFVTSGIRIGTPAITTRGFLEADAAHTAQLMCDALDRLGDAQVEAAVRTQVAQLCARFPVYLGL

SEQ ID NO: 9083 - DNA, 1275 bp, Burkholderia vietnamiensis G4
  CDS (1)..(1275): transl_table=11
atgtcgaacacccagcctttcttctcgcagcccctcgccgagcgcgacgccccggtgcgcagcgccatcctgaaggagctcgagcgccagcagtcgcaggtcgagctgatcgcgtcggaaaacatcgtgtcgcgcgccgtgctggaagcgcagggttcggtgctgaccaacaagtatgcggaaggctatccgggcaagcgctattacggcggctgcgaatttgccgatgaaatcgaggcgctcgcgatcgagcgtgtgaagcagatcttcaacgccggctatgcgaacgtgcagccgcattcgggtgcgcaggcgaacggctcggtgatgctcgcgctcgcgaagccgggcgacacggtgctcggcatgtcgctcgacgccggcggccacctcacgcacggcgcgaagccggcgctgtcgggcaagtggttcaacgcggtgcagtacggcgtgaaccgcgacacgatgcgcatcgactacgaccaggtcgaggagctcgcccaccagcacaagccgacgctgctcatcgccggcttctccgcttatccgcgcgcgctcgacttcgcgcgcttccgcgcgatcgccgacagcgtcggcgcgaagctgatggtcgacatggcgcacatcgcgggcgtgatcgcggccggtcgccatgcgaacccggtcgagcacgcgcacgtcgtcacgtcgaccacgcacaagacgctgcgcggcccgcgcggcggcttcgtgctgaccaacgacgaagagatcgcgaagaagatcaactcggccgtgttccccggcctgcagggcggcccgctgatgcacgtgatcgccggcaaggccgtcgcgttcggcgaagtgctgcatgccgacttcaagacctacatcgaccgcgtgctcgcgaacgcgcaggcgctcggcgaagtgctcaaggcgggcggcgtcgatctcgtcaccggcggcaccgacaaccacctgctgctggtcgacctgcgcccgaaggggctgaagggtgcgccggtcgagcaggcgctcgagcgcgcgggcatcacctgcaacaagaacggcattccgttcgacaccgagaagccgaccgtcacgtcgggcatccgcctcggcacgccggccggcacgacgcgcggcttcggcgtggccgagttccgcgagatcggccgcctgattctcgaagtgttcgacgcgctgcgcgcgaatccggacggcgaccacgcgaccgagcaacgcgtgcgccgcgagattttcgcgctttgcgagcgcttcccgatttactga

SEQ ID NO: 9084 - protein, 424 aa, Burkholderia vietnamiensis G4
MSNTQPFFSQPLAERDAPVRSAILKELERQQSQVELIASENIVSRAVLEAQGSVLTNKYAEGYPGKRYYGGCEFADEIEALAIERVKQIFNAGYANVQPHSGAQANGSVMLALAKPGDTVLGMSLDAGGHLTHGAKPALSGKWFNAVQYGVNRDTMRIDYDQVEELAHQHKPTLLIAGFSAYPRALDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEVLHADFKTYIDRVLANAQALGEVLKAGGVDLVTGGTDNHLLLVDLRPKGLKGAPVEQALERAGITCNKNGIPFDTEKPTVTSGIRLGTPAGTTRGFGVAEFREIGRLILEVFDALRANPDGDHATEQRVRREIFALCERFPIY

SEQ ID NO: 9085 - DNA, 1248 bp, Burkholderia vietnamiensis G4
  CDS (1)..(1248): transl_table=11
atgttcaatcgcactaccagcaccgtcgcgaacgtcgatcccgagatctttgctgcgatcgagcaggaaaaccgccgccaggaagaccacatcgagttgatcgcgtcggaaaactacacgagcccggccgtgatggccgcacagggctcgcagctcacgaacaagtacgcggaaggttatccgggcaagcgctactacggcggctgcgagtacgtcgacgtggtcgagcagctggcgatcgatcgcgtgaagcagctgttcggcgcggaagcggcgaacgtgcagccgaactcgggctcgcaggcgaaccagggcgtgttcttcgcgatgctcaagccgggcgacacgatcatggggatgagcctggcgcacggtgggcacctgacgcacggctcgccggtgaacatgtcgggcaagtggttcaacgtggtgagctacgggctgaacgaaaacgaagacatcgattacgacgcggcggaaaagctcgcgcaggagcacaagccgaagctgatcgtcgcgggcgcctcggcgttcgcgctgaagatcgacttcgcgcgtatggcgcagatcgcgaagtcggtcggcgcgtacctgatggtggacatggcgcactacgctgggctgatcgcggcgggcgtgtatccgaacccggtgccgcacgctgatttcgtgacgacgaccacgcacaagagcctgcgcggcccgcgcggcggcgtgatcctgatgaaggcggagtacgagaagcagatcaactcggcgatcttcccgggcatccagggcggcccgctgatgcacgtgatcgcggcgaaggcggtggcgttcaaggaagcgctgtcgccggagttcaaggcgtatcagcaaaaggtggtggagaacgcgcgggtgctggccgagacgctggtgaaacgcgggctgcggatcgtgtcgggccgcacggaaagccacgtgatgctggtggacctgcgcgcgaagcacatcacgggcaaggcggcggaagcggcgctgggtgcggcgcacatcacggtgaacaagaacgcgattccgaacgatccggaaaagccgttcgtgacgagcggcgtgcggctgggctcgccggcgatgacgacgcgcggcttcggtccggcggaagcggagcaggtgggcaacctgatcgcggacgtgctggagaacccggaagatgcggcgacgctcgagcgcgtgcgcgcgcaagtggccgagctgaccaagcgtttcccggtctacgggtga

SEQ ID NO: 9086 - protein, 415 aa, Burkholderia vietnamiensis G4
MFNRTTSTVANVDPEIFAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYDAAEKLAQEHKPKLIVAGASAFALKIDFARMAQIAKSVGAYLMVDMAHYAGLIAAGVYPNPVPHADFVTTTTHKSLRGPRGGVILMKAEYEKQINSAIFPGIQGGPLMHVIAAKAVAFKEALSPEFKAYQQKVVENARVLAETLVKRGLRIVSGRTESHVMLVDLRAKHITGKAAEAALGAAHITVNKNAIPNDPEKPFVTSGVRLGSPAMTTRGFGPAEAEQVGNLIADVLENPEDAATLERVRAQVAELTKRFPVYG

SEQ ID NO: 9087 - DNA, 1296 bp, Burkholderia vietnamiensis G4
  CDS (1)..(1296): transl_table=11
atgtactcggccgcaccggtcaacctgtacacacttaacggaaaccgtatgtttgacagagcccaaagcaccatcgcgaacgtcgatcccgagatctttgctgcgatcgagcaggaaaaccgccgccaggaagaccacatcgagttgatcgcgtcggaaaactacacgagcccggccgtgatggccgcacagggctcgcagctcacgaacaagtacgcggaaggttatccgggcaagcgctactacggcggctgcgagtacgtcgacgtggtcgagcagctggcgatcgatcgcgtgaagcagctgttcggcgcggaagcggcgaacgtgcagccgaactcgggctcgcaggcgaaccagggcgtgttcttcgcgatgctcaagccgggcgacacgatcatggggatgagcctcgcgcacggcgggcacctgacgcacggctcgccggtgaacatgtcgggcaagtggttcaacgtggtgagctacgggctgaacgaaaacgaagacatcgattacgacgcggcggaaaagctcgcgcaggagcacaagccgaagctgatcgtcgcgggcgcctcggcgttcgcgctgaagatcgacttcgcgcgtatggcgcagatcgcgaagtcggtcggtgcgtacctgatggtggacatggcgcactacgctgggctgatcgcggcgggcgtgtatccgaacccggtgccgcacgctgatttcgtgacgacgaccacgcacaagagcctgcgcggcccgcgcggcggcgtgatcctgatgaaggcggagtacgagaagcagatcaactcggcgattttcccgggcatccagggcggcccgctgatgcacgtgatcgcggcgaaggcggtggcgttcaaggaagcgctgtcgccggagttcaaggcgtatcagcaaaaggtggtggagaacgcgcgcgtgctggccgagacgctggtgaaacgcgggctgcggatcgtgtcgggccgcacggaaagccacgtgatgctggtggacctgcgcgcgaagcacatcacgggcaaggcggcggaagcggcgctgggtgcggcgcacattacggtgaacaagaacgcgattccgaacgatccggaaaagccgttcgtgacgagtggcgtgcggctgggctcgccggcgatgacgacgcgcggcttcgggccggcggaagcggagcaggtgggcaacctgatcgcggacgtgctggagaacccggaagatgcggcgacgctcgagcgcgtgcgcgcgcaagtggccgagctgaccaagcgtttcccggtctatcgctga

SEQ ID NO: 9088 - protein, 431 aa, Burkholderia vietnamiensis G4
MYSAAPVNLYTLNGNRMFDRAQSTIANVDPEIFAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYDAAEKLAQEHKPKLIVAGASAFALKIDFARMAQIAKSVGAYLMVDMAHYAGLIAAGVYPNPVPHADFVTTTTHKSLRGPRGGVILMKAEYEKQINSAIFPGIQGGPLMHVIAAKAVAFKEALSPEFKAYQQKVVENARVLAETLVKRGLRIVSGRTESHVMLVDLRAKHITGKAAEAALGAAHITVNKNAIPNDPEKPFVTSGVRLGSPAMTTRGFGPAEAEQVGNLIADVLENPEDAATLERVRAQVAELTKRFPVYR

SEQ ID NO: 9089 - DNA, 1257 bp, Streptococcus pyogenes str. Manfredo
  CDS (1)..(1257): transl_table=11
atgatttttgataaaggtaatgttgaagactttgataaagagctttgggatgccattcatgctgaagaagaaagacaagaacatcatatcgaattgattgcatctgaaaacatggtttcaaaagctgtcatggcagctcaaggttctgttttaaccaataagtatgcagaaggctatccaggtaatcgctattatggtggaacagaatgtgtggatattgtcgaaacgcttgctattgaacgtgctaagaaacttttcggtgccgcatttgccaatgtccaagcccattccggaagtcaagccaatgcagcagcttatatggccttgattgaggctggtgacaccgtattaggaatggatttggctgcaggtggtcatctcacgcatggctctccagtaaatttttctggaaaaacctaccattttgtgggttactcagtagatgctgatactgaaatgttaaattatgaggcgattttagaacaagcaaaggcggtccagccaaagcttatcgttgcaggggcttcggcctactctagaagcattgattttgaaaagtttcgtgccattgctgatcacgtaggtgcttacttaatggtggacatggctcacatcgctggccttgtagcagcaggtgtgcacccgagtcctgtcccttatgcgcatattgtgacgtcaacaacccataaaaccttacgtggtcctcgtggaggcttgatattaaccaatgacgaagctcttgctaaaaagattaattcggccattttccctggtttacaaggaggacctctggaacacgtgattgctgccaaagcggttgccttcaaagaagccttggatccagcctttaaagactatgcacaagctattattgataatactgcggctatggcagcagtttttgcacaagatgatcgtttccgtctgatctcaggtggtacagataatcatgtctttttagtagatgtcactaaggttattgctaatggtaaactagcgcaaaatcttctggatgaggttaatattacccttaataaaaatgccattccttttgaaaccttgtcgccatttaaaacctcaggtattcgcattggttgtgctgccataaccagccgtggtatgggtgttaaagagagtcagaccattgcccgtcttatcatcaaagccttggttaatcatgatcaagaaactattcttgaagaagtccgtcaggaagtgcgtcagttaaccgatgctttcccactctataaaaagtaa

SEQ ID NO: 9090 - protein, 418 aa, Streptococcus pyogenes str. Manfredo
MIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAIFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFKTSGIRIGCAAITSRGMGVKESQTIARLIIKALVNHDQETILEEVRQEVRQLTDAFPLYKK

SEQ ID NO: 9091 - DNA, 1272 bp, Thermus thermophilus HB27
  CDS (1)..(1272): transl_table=11
ttgcgccttctccctcatgccgcgattttacccggctataatcgccctatggtgagcaccctcaagcgggacgaggccctctttgagctcatcgccttagaggagaaaaggcagcgggaaggcctggagctcatcgccagcgaaaacttcgtctccaagcaggtgcgggaggcggtggggagcgtcctcaccaacaagtacgccgagggctaccccggggcccggtactacggggggtgcgaggccattgaccgggtggagtccctggccatagagcgggccaaggccctcttcggagcggcctgggccaacgtccagccccactccggctcccaggccaacatggcggtctacatggccctgatggagccgggggacaccctcatgggcatggacctcgcggccggcggccacctcacccacggctcccgcgtgaacttctccgggaagctttacaaggtggtctcctacggggtccgtcccgacacggagctcatagacctggaggaggtccgccgcctcgccctcgagcaccgccccaaggtgatcgtggccggggccagcgcctacccccgcttctgggactttaaggcctttcgggagatcgccgacgaggtgggggcctacctcgtggtggacatggcccacttcgccgggctcgtggccgcgggcctccacccgaaccccctgccttacgcccacgtggtgacgagcaccacccacaaaaccctccggggcccgaggggcggcctcatcctctccaacgaccctgagctcggcaagaggattgacaagctcatcttccccgggatccagggggggcccttggagcacgtgatcgccgggaaggccgtggccttctttgaggccctacagcccgagttcaaggagtacagccgcctggtggtggaaaacgccaagcgcctggcggaggcgcttgcccgccggggctaccgcatcgtcaccggggggacggacaaccacctcttcctcgtggacctgcgccccaagggcctcaccgggaaggaggcagaggagaggctggacgccgtggggatcacggtgaacaagaacgccatcccctttgaccccaagcccccccgggtcacctcggggatccgcatcggcaccccggccatcaccacccggggcttcacccccgaggagatgcccctcgtcgccgagctcatagaccgggcccttctggagggcccctcggaggccctgcgggaagaggtgcgcaggctcgccctggcccaccccatgccctga

SEQ ID NO: 9092 - protein, 423 aa, Thermus thermophilus HB27
MRLLPHAAILPGYNRPMVSTLKRDEALFELIALEEKRQREGLELIASENFVSKQVREAVGSVLTNKYAEGYPGARYYGGCEAIDRVESLAIERAKALFGAAWANVQPHSGSQANMAVYMALMEPGDTLMGMDLAAGGHLTHGSRVNFSGKLYKVVSYGVRPDTELIDLEEVRRLALEHRPKVIVAGASAYPRFWDFKAFREIADEVGAYLVVDMAHFAGLVAAGLHPNPLPYAHVVTSTTHKTLRGPRGGLILSNDPELGKRIDKLIFPGIQGGPLEHVIAGKAVAFFEALQPEFKEYSRLVVENAKRLAEALARRGYRIVTGGTDNHLFLVDLRPKGLTGKEAEERLDAVGITVNKNAIPFDPKPPRVTSGIRIGTPAITTRGFTPEEMPLVAELIDRALLEGPSEALREEVRRLALAHPMP

SEQ ID NO: 9093 - DNA, 1263 bp, Streptococcus pyogenes MGAS10394
  CDS (1)..(1263): transl_table=11
atgacaatgatttttgataaaggtaatgttgaagactttgataaagagctttgggatgccattcatgctgaagaagaaagacaagaacatcatatcgaattgattgcatctgaaaacatggtttcaaaagctgtcatggcagctcaaggttctgttttaaccaataagtatgcagaaggctatccaggtaatcgctattatggtggaacagaatgtgtggatattgtcgaaacgcttgctattgaacgtgctaagaaacttttcggtgccgcatttgccaatgttcaagcccattccggaagtcaagccaatgcagcagcttatatggccttgattgaggctggtgacaccgtattaggaatggatttggctgcaggtggtcatctcacgcatggctctccagtaaatttttctggaaaaacctaccattttgtgggttactcagtagatgctgatactgaaatgttaaattatgaggcgattttagaacaagcaaaggcggtccaaccaaagcttatcgttgcaggggcttcggcctactctagaagcattgattttgaaaagtttcgtgccattgctgatcacgtaggtgcttacttaatggtggacatggctcacatcgctggccttgtagcagcaggtgtgcacccgagtcctgtcccttatgcgcatattgtgacgtcaacaacccataaaaccttacgtggtcctcgtggaggcttgatattaaccaatgacgaagctcttgctaaaaagattaattcggccgttttccctggtttacaaggaggacctctggaacacgtgattgctgccaaggcggttgccttcaaagaagccttggatccagcctttaaagactatgcacaagctattattgataatactgcggctatggcagcagtttttgcacaagatgatcgtttccgtctgatctcaggtggtacagataatcatgtctttttagtagatgtcactaaggttattgctaatggtaaactagcgcaaattcttctggatgaggttaatattactctaaataaaaatgccattccttttgaaaccttatctccttttaaaacatcaggcattcgtattggttgtgcagctataaccagtcgtggcatgggagttaaagaaagccaaactatcgctcacctcatcatcaaagccttggttaatcataatcagactgttattcttgaagaagtccgtcaggaagtgcgtcagttaaccgatgccttcccactctataaaaagtaa

SEQ ID NO: 9094 - protein, 420 aa, Streptococcus pyogenes MGAS10394
MTMIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQILLDEVNITLNKNAIPFETLSPFKTSGIRIGCAAITSRGMGVKESQTIAHLIIKALVNHNQTVILEEVRQEVRQLTDAFPLYKK

SEQ ID NO: 9095 - DNA, 1290 bp, Burkholderia pseudomallei K96243
  CDS (1)..(1290): transl_table=11
gtgacgagacgcctcatgtcgaacgccaatcccttcttctcgcaatcgctcgccgagcgcgacgcgtccgtgcgcggcgcgatcctcaaggaactcgaacgccagcagtcgcaagtcgagctgatcgcgtcggagaacatcgtgtcgcgcgcggtgctcgatgcgcagggctcggtgctgaccaacaagtatgcggaaggctatccgggcaagcgctattacggcggttgcgaattcgccgacgaagtcgaggcgctcgcgatcgagcgcgtgaagcggctcttcaacgccggccatgcgaacgtgcagccgcactcgggcgcccaggcgaacggcgcggtgatgctcgcgctcgcgaagccgggcgacacggtgctcggaatgtcgctcgacgcgggcggacacctcacgcacggcgcgaagccggcgctgtccggcaagtggttcaacgcgctccagtacggcgtgagccgcgacacgatgctgatcgattacgaccaggtcgaggcgctcgcgcagcagcacaagccgagcctcatcatcgccggcttctccgcctatccgcgcaagctcgacttcgcgcggtttcgcgcgatcgccgattcggtcggcgcgaagctgatggtcgacatggcgcatatcgccggcgtgatcgccgcgggccgccatgcgaacccggtcgaacacgcgcacgtcgtcacgtcgacgacgcacaagacgctgcgcggcccgcgcggcggcttcgtgctgaccaacgacgaggagatcgcgaagaagatcaactcggcggtgttccccggcctgcagggcggcccgctgatgcacgtgatcgccggcaaggcggtggcgttcggcgaggcgctgacagacgatttcaagacctacatcgatcgcgtgctcgcgaacgcgcaggcgctcggcgacgtgctgaaggcgggcggcgtcgatctcgtgacgggcggcaccgacaaccatctgctgctcgtcgatctgcgcccgaagggcctgaagggcgcgcaggtcgagcaggcgctcgagcgcgcgggcatcacgtgcaacaagaacggcattccgttcgatccggagaagccgacgatcacgtcgggcatccgcctcggcacgccggcgggcacgacgcgcggcttcggcgcagcggagttccgcgaggtcggccggctgattctcgaggtgttcgaggccctgcgcacgaacccggaaggcgatcacgcgaccgaacagcgcgtgcggcgcgagatcttcgcgctttgcgaacgcttcccgatctactga

SEQ ID NO: 9096 - protein, 429 aa, Burkholderia pseudomallei K96243
MTRRLMSNANPFFSQSLAERDASVRGAILKELERQQSQVELIASENIVSRAVLDAQGSVLTNKYAEGYPGKRYYGGCEFADEVEALAIERVKRLFNAGHANVQPHSGAQANGAVMLALAKPGDTVLGMSLDAGGHLTHGAKPALSGKWFNALQYGVSRDTMLIDYDQVEALAQQHKPSLIIAGFSAYPRKLDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEALTDDFKTYIDRVLANAQALGDVLKAGGVDLVTGGTDNHLLLVDLRPKGLKGAQVEQALERAGITCNKNGIPFDPEKPTITSGIRLGTPAGTTRGFGAAEFREVGRLILEVFEALRTNPEGDHATEQRVRREIFALCERFPIY

SEQ ID NO: 9097 - DNA, 1323 bp, Burkholderia sp. 383
  CDS (1)..(1323): transl_table=11
atggaatgcgaaggccgaaacaccatgcagccggcaagccgcggtcagtcattcactctcaactggtcaatcatcatgttcaaccgcaccaccagcaccgttgccaacgtcgatccggaactttatgccgcgatcgagcaggaaaaccgccgccaggaagatcacatcgagctgatcgcgtcggaaaactacacgagcccggccgtgatggctgcgcagggttcgcaactcacgaacaagtacgcggaagggtatccgggcaagcgctactacggcggctgcgaatacgtggacgtggttgagcagctggcgatcgaccgcgtgaagcagctgttcggtgcggaagcggcgaacgtgcagccgaactcgggttcgcaggcgaaccagggcgtgttcttcgcgatgctcaagccgggcgacacgatcatgggcatgagcctcgcgcacggcggccacctgacgcacggctcgcccgtgaacatgtcgggcaagtggttcaacgtggtgagctacggcctgaacgaaaacgaagacatcgactacgaagcggccgagcagctcgcgcaggaacacaagccgaagctgatcgtcgcaggcgcgtcggcattctcgctgaagatcgatttcgagcgtctggcgaagatcgcgaagtcggtcggcgcgtacctgatggtcgacatggcccactacgcaggcctgatcgcagcgggcgtgtacccgaacccggtgccgcacgcagacttcgtgacgacgacgacgcacaagagcctgcgcggcccgcgcggcggcgtgatcctgatgaaggccgagtacgagaagccgatcaactcggcgatcttcccggggatccagggcggcccgctgatgcacgtgatcgcgggcaaggccgtggcgttcaaggaagcgctgtcgccggaattcaaggcgtaccaggagaaggtggtcgagaacgcccgcgtgctggctgaaacgctggtgaagcgtggcctgcggatcgtgtcgggccgtacggaaagccacgtgatgctggtggacctgcgtgcgaagaacatcacgggcaaggcagcggaagcagcgctgggtgctgcgcacatcacggtgaacaagaacgcgatcccgaacgatccggaaaagccgttcgtgacgagcggcgtgcgcctgggttcgccggcaatgacgacgcgcggcttcggcgtgaaggaagcggagatcgtcggcaacctgatcgccgatgtgctggaagcgccggaagatgcggccacgctcgagcgtgtgcgcgggcaggtcgccgaactgacgaagcgtttccccgtctacggctga

SEQ ID NO: 9098 - protein, 440 aa, Burkholderia sp. 383
MECEGRNTMQPASRGQSFTLNWSIIMFNRTTSTVANVDPELYAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYEAAEQLAQEHKPKLIVAGASAFSLKIDFERLAKIAKSVGAYLMVDMAHYAGLIAAGVYPNPVPHADFVTTTTHKSLRGPRGGVILMKAEYEKPINSAIFPGIQGGPLMHVIAGKAVAFKEALSPEFKAYQEKVVENARVLAETLVKRGLRIVSGRTESHVMLVDLRAKNITGKAAEAALGAAHITVNKNAIPNDPEKPFVTSGVRLGSPAMTTRGFGVKEAEIVGNLIADVLEAPEDAATLERVRGQVAELTKRFPVYG

SEQ ID NO: 9099 - DNA, 1503 bp, Burkholderia thailandensis E264
  CDS (1)..(1503): transl_table=11
gtgctcaataccccctgcgtgactggcgatacgacctttcggggtcaaggtggagcatcccaccgtgaagcgcggggcgtcgcttttgccgttcgcctgggcagccgttgtgcgcgccgcgttgcgtgctttgccggtggctgtcccgcctcgcgttcctcggaattcctccgccgcgtcgagccggttgcgctgccggctgcgcgacgttacttggccacttcggtcaacctgtacacacttaacggaaaccgtatgtttgacagagcccaaagcaccattgcgaacgtcgatcccgagatctggcaagcgatccagcaggaaaacgtccgccaggaagagcacatcgagctgatcgcgtcggagaactacacgagcccggccgtgatggcggcgcaaggctcgcagctcacgaacaagtacgcggaaggctacccgggcaagcgctattacggcggctgcgaatacgtcgacatcgtcgagcagcttgcgatcgaccgcgtgaaggcgctgttcggctccgaagccgcgaacgtgcagccgaactccggctcgcaggcgaaccagggcgtgttcttcgcgatgctcaagccgggcgatacgatcatgggcatgagcctcgcgcatggcggccacctgacgcacggctcgcccgtcaacatgtcgggcaaatggttcaacgtcgtgagctacggcttgaacgagaacgaagacatcgactacgaagccgccgataagcttgcgcacgagcacaagccgaagctgatcgtcgccggcgcttcggcgtttgcgctgaagatcgatttcgagcgtctcgcgaagatcgcgaaggcggtcggcgcgtacctgatggtcgacatggcgcactacgcgggcctcatcgccgctggcgtctacccgaacccggtgccgcacgccgatttcgtcacgacgacgacgcacaagagcctgcgcggcccgcgcggcggcgtgatcctgatgaaggccgagtacgagaagcagatcaactcggcgatcttcccgggcatccagggcggtccgctgatgcacgtgattgcggcgaaggccgtcgcgttcaaggaagcgctgtcgccggaattcaaggaataccagcagaaggtgatcgagaacgcgcgcgtgctggccgagacgctcgtcaagcgcggcctgcgcatcgtgtcgggccgcaccgaaagccacgtgatgctcgttgacctgcgcgcgaagaacattaccggcaaggccgcggaagcggcgctcggcaatgcgcacatcacggtcaacaagaacgcgatcccgaacgatccggagaagccgttcgtgacgagcggcgtgcgtctcggctcgcccgcgatgacgacgcgcggcttcggtccgcaggaagccgaactggtcggcaacctgatcgccgacgtgctcgagcatccggaagacgcggcgacgatcgagcgcgtgcgcgcgcaggtcgccgacctgaccaagcgtttcccggtctatcgctga

SEQ ID NO: 9100 - protein, 500 aa, Burkholderia thailandensis E264
MLNTPCVTGDTTFRGQGGASHREARGVAFAVRLGSRCARRVACFAGGCPASRSSEFLRRVEPVALPAARRYLATSVNLYTLNGNRMFDRAQSTIANVDPEIWQAIQQENVRQEEHIELIASENYTSPAVMAAQGSQLTNKYAEGYPGKRYYGGCEYVDIVEQLAIDRVKALFGSEAANVQPNSGSQANQGVFFAMLKPGDTIMGMSLAHGGHLTHGSPVNMSGKWFNVVSYGLNENEDIDYEAADKLAHEHKPKLIVAGASAFALKIDFERLAKIAKAVGAYLMVDMAHYAGLIAAGVYPNPVPHADFVTTTTHKSLRGPRGGVILMKAEYEKQINSAIFPGIQGGPLMHVIAAKAVAFKEALSPEFKEYQQKVIENARVLAETLVKRGLRIVSGRTESHVMLVDLRAKNITGKAAEAALGNAHITVNKNAIPNDPEKPFVTSGVRLGSPAMTTRGFGPQEAELVGNLIADVLEHPEDAATIERVRAQVADLTKRFPVYR

SEQ ID NO: 9101 - DNA, 1263 bp, Frankia sp. CcI3
  CDS (1)..(1263): transl_table=11
gtgcatcaaccaccgattccccacctcgccgtcgccgatcccgaactcgccggtctcgtcgaggccgaagccacgcgccagttctcgtcgatcaggctgatcgcgtcggagaactacgtctctaccgcggtgctggaggcgtccggctccgtgctgaccaacaagtactccgagggctacgtcggtcggcgttactacgagggccagcaggtcatcgatccgatcgagacgcttgcggtcgaccgtgccaaggcgctgttcggggtcgagcacgccaacgtccagccgtactcgggttccccggcgaacctcgccgtctatctggccttcgccgagccgggggacaccgtgatgggcctgtcgctgccgatgggcggccatctgacccacggctggagcgtctccgcgaccggcacgtggttccgcagtgtccggtacggcgtgcgcgccgacaccggccgcatcgacctggacgaggtgcgcgacctcgctctggccgagcgtcccaggattattttctgcggcggtacggcgatccctcggacgatcgacttcccggggttcgccgcgatcgcgcgggaggtcggggcggtgctcgtcgcggacatcgcgcacatcgccgggctgatcgcgggtggggcacacccctcgccggtggggcacgccccggtgatctccaccaccacgcacaagacgttgcgcggcccgcgtggggcgatgctcctctccgacgccgagcacgccaccgcgatcgacaaggcggtgttcccgggcctgcagggcgggccgcacaaccacaccaccgcggcgatcgccgtcgcactgcgcgaggcggcggcacccgcgttccgcgactacgcgcacgcggtcgtggcgaacgcccgcgcgctggccgaggccctggtggagcggggcttcgacctggtcaccggcggtaccgacaaccatctgatcctgatcgacctgaccagcagggacatcggtggcaagcccgcggcccgggcgctcgaccaggccgggatcgagctgaactacaacgcggtgcccttcgaccagcgcaggcccttcgacccgtccggtatccggctgggaaccgccgccatcaccacccgcggtctgggggtcggtcacatgccggtgctcgccggctggatcgacgatgtcgtcaaggccgccgtggtcggcgacaccgcgaccatcacccgggtccgggagcaggtcaccgagctgaccgcagccttcccgatgccgggcttcgcctga

SEQ ID NO: 9102 - protein, 420 aa, Frankia sp. CcI3
MHQPPIPHLAVADPELAGLVEAEATRQFSSIRLIASENYVSTAVLEASGSVLTNKYSEGYVGRRYYEGQQVIDPIETLAVDRAKALFGVEHANVQPYSGSPANLAVYLAFAEPGDTVMGLSLPMGGHLTHGWSVSATGTWFRSVRYGVRADTGRIDLDEVRDLALAERPRIIFCGGTAIPRTIDFPGFAAIAREVGAVLVADIAHIAGLIAGGAHPSPVGHAPVISTTTHKTLRGPRGAMLLSDAEHATAIDKAVFPGLQGGPHNHTTAAIAVALREAAAPAFRDYAHAVVANARALAEALVERGFDLVTGGTDNHLILIDLTSRDIGGKPAARALDQAGIELNYNAVPFDQRRPFDPSGIRLGTAAITTRGLGVGHMPVLAGWIDDVVKAAVVGDTATITRVREQVTELTAAFPMPGFA

SEQ ID NO: 9103 - DNA, 1257 bp, Frankia sp. CcI3
  CDS (1)..(1257): transl_table=11
atgagcaccccgttctggggcccggacttcgaccagctgagcgcgacggatccgcagatcgcggaggtggtcctcgatgagctggaccggctgcgcggcggcctgcaactcatcgcgagcgagaacttcacgtccccggcggtgctggcggcgctgggctcgacgttgtcgaacaagtatgccgaagggtatccgggtcggcgttactacggcggttgccaggtggtcgaccgggccgaggagatcggcatcgcccgggcgaagcagctcttcggcgcggagcacgccaacctgcaaccgcattcgggctcgtcggcgaacttcgccgtgtacgcggcgctactcacgccaggtgacacggtcctggcgatgtcgttgccgcatggcggtcacctcacccacggcagcaaggtgagcttctccggtaagtggttcaacgtggtggcctacggcgtgcgggaggacaccgagctgatcgactacgaccaggtgcgggagctcgcccgccagcaccggcccaagatgatcatctgtggggcgacggcctacccacgtctgatcgacttcgccgcgttccgctcgatcgccgacgaggtcggttcgtggctgatggtggacgcggcgcacttcatcggtctggtcgccgggggcgcgatcccgagccccgttccctacgccgacgttgtcagcttcaccacccacaaggtgttgcgcggcccgcgagggggcatgatcctcgcgcgtgaggagctggcttcccgcatcgacaaggccgtgttcccgttcagccagggtggcccgctgatgcacgcggtcgcggcgaaggccgtcgcgttgcgggaggcggcctcgcccgcttacgcgcagtacgctcgccaggtggtggccaacgcgcagcggctcgccgacgagcttgccgccgagggcatccggcccgtcgccggtggcaccgacacccatctcgccctgctcgacctgcgggaactcggggtcagcggcaaggaagccgaggcgcgttgcgacgcggccggcatcaccctgaacaagaacgccattccctatgacccgcagccgcccgcgatctcctccggcatccgggtgggaaccccggcggtcaccacccaggggatgggcgagggggagatgaaggagatcgcggggctgatcgcccacgcggtgcgtgagccggaagccgccgccgacgtcgctgcggcggtgtccgcgctcgtcgcccggcatccggcctatccgcggtag

SEQ ID NO: 9104 - protein, 418 aa, Frankia sp. CcI3
MSTPFWGPDFDQLSATDPQIAEVVLDELDRLRGGLQLIASENFTSPAVLAALGSTLSNKYAEGYPGRRYYGGCQVVDRAEEIGIARAKQLFGAEHANLQPHSGSSANFAVYAALLTPGDTVLAMSLPHGGHLTHGSKVSFSGKWFNVVAYGVREDTELIDYDQVRELARQHRPKMIICGATAYPRLIDFAAFRSIADEVGSWLMVDAAHFIGLVAGGAIPSPVPYADVVSFTTHKVLRGPRGGMILAREELASRIDKAVFPFSQGGPLMHAVAAKAVALREAASPAYAQYARQVVANAQRLADELAAEGIRPVAGGTDTHLALLDLRELGVSGKEAEARCDAAGITLNKNAIPYDPQPPAISSGIRVGTPAVTTQGMGEGEMKEIAGLIAHAVREPEAAADVAAAVSALVARHPAYPR

SEQ ID NO: 9105 - DNA, 1263 bp, Ehrlichia chaffeensis str. Arkansas
  CDS (1)..(1263): transl_table=11
atggttgggtatatcttagatgatgatttacaggaagttgatgctgaggtttttaattgtatttctggagagttaaatcgacaaaattctggactacagttaatagcgtcagaaaattttgtgagtaaggcagtattgcaagctcagggttctatatttacaaataagtatgctgaaggttatccaggaaaaagatattattgtggatgtcattttgcagatattgtagaaaatttggcaatagaacgtttatgtcgattgtttggatgtaaatttgcaaatgttcaaccgcattctggttcacaagctaatcaaggagtatttgctgcattgttaaagccaggtgacactgtcattggtatgtcacttgattgtggtggtcatttaactcatggttctgctcctagtatttctggaaagtggtttaatgctgtgcagtatcaagttgatcgtgatactggtttaatagatatggatgaaatagagaagttagctgttgaacataatccatcattaattattgctggttcatcttcttatcctcgtgtaatagattttaaaaggtttagggaaatagctgataaagtgggagcatatcttctagctgatatagcgcattatgctgggttaattgctgctggagaatttccttcgcctgttgaatatgctcatgttattacgtctactactcacaagacattgcgtggccctaggggagcagtgataatgactaattatgaagatatccataagaaaattcaatcttctatttttcctggtatgcagggtggtccgttaatgcatgttattgctgctaaagctgtagcatttgcagaagcattgaaacctgagtttaaagattatgcgaaacaaataataaaaaattctaaggctttgggtgaagtatttaaagaaagagggcttgatcttgtgacaggtggtacagattctcatatggttgttcttgatttacgttcaaaaagtgttacaggtaaagatgcagttcttgctttagaaaaactaggaattatttgtaataaaaatgctattccttttgatccagaaaagccttttgtaacttctggtttacgttttggtagtgctgctgagacttccagagggttacaagaatcagaatttagggaaattggcagtatggtttgtgatgttattgatagtttaaaagctagtgatagtgttagattatctgttgaaagagatataataaaaagagttaaggaattaacttctaattttatttag

SEQ ID NO: 9106 - protein, 420 aa, Ehrlichia chaffeensis str. Arkansas
MVGYILDDDLQEVDAEVFNCISGELNRQNSGLQLIASENFVSKAVLQAQGSIFTNKYAEGYPGKRYYCGCHFADIVENLAIERLCRLFGCKFANVQPHSGSQANQGVFAALLKPGDTVIGMSLDCGGHLTHGSAPSISGKWFNAVQYQVDRDTGLIDMDEIEKLAVEHNPSLIIAGSSSYPRVIDFKRFREIADKVGAYLLADIAHYAGLIAAGEFPSPVEYAHVITSTTHKTLRGPRGAVIMTNYEDIHKKIQSSIFPGMQGGPLMHVIAAKAVAFAEALKPEFKDYAKQIIKNSKALGEVFKERGLDLVTGGTDSHMVVLDLRSKSVTGKDAVLALEKLGIICNKNAIPFDPEKPFVTSGLRFGSAAETSRGLQESEFREIGSMVCDVIDSLKASDSVRLSVERDIIKRVKELTSNFI

SEQ ID NO: 9107 - DNA, 1263 bp, Desulfitobacterium hafniense Y51
  CDS (1)..(1263): transl_table=11
gtgggtaatatggattatattaaggaatggattctccctcaggatcccgaagtggcggaggctattgcccaggaggaacaaaggcagcgctataaaatcgagctgattgcctcagagaattttgtgagccgagcggtcatggccgcccagggttccgttcttaccaataagtatgcggaaggatatccgggaaaacgctattatggcggctgcgagtatgtggatatcgttgaggatctggcccgggagcgggtgaaaaagctttttggtgcggaacatgccaatgtccagcctcattccggcgcccaggctaataccgctgtatattttgccatgcttaaacccggggatacggttctcggcatgaatctttcccatggagggcatttaacccacggcagcccggtgaatatttccgggatgtattataactttgtcgcctatggggtggatcaagccaccgagcgcattgattatgatgtggtacgccaattggcccttgagcatcgccctaagctgattgtagcgggagccagtgcctatcccagacaaatcgactttgcccgcttaagagaaattgccgatgaggcaggctcttacttcatggtggatatggcccatattgcgggcctggtggcagccgggcttcatcaaaaccctgtcccctacgcacattttgtaaccaccaccactcataaaaccctgcggggcccccgggggggactgattctatgccaagaagaatttgccaaagctatcgataaagccatcttccccggcattcagggcggccctctgatgcatgtgatcgcggctaaggctgttgccttcggtgaggctttaaaaccggaattcgtggaatatcaaaaacgcattgtggaaaatgctaaagtattatcggaaactctggcggaaaaaggtttccgcatcgtttccggaggtacggacaaccatttgatgcttgtggatgtacggtctaaaggcttgacagggaaagaagcagagtatattttagatgaggtcggtattacggtgaataagaacaccatcccctatgatccggccagccctatggtaaccagcggcatccgcatcggcacccctgccgtgaccagccgcggtatggataccctggcgatgaaaaagattgccgcagccatcgacattgctttatcagaacccaatgaagcgggggctgccaaagcccgggatatggttgcagcactctgcgcggaatacccgctctacccaaatctagattag

SEQ ID NO: 9108 - protein, 420 aa, Desulfitobacterium hafniense Y51
MGNMDYIKEWILPQDPEVAEAIAQEEQRQRYKIELIASENFVSRAVMAAQGSVLTNKYAEGYPGKRYYGGCEYVDIVEDLARERVKKLFGAEHANVQPHSGAQANTAVYFAMLKPGDTVLGMNLSHGGHLTHGSPVNISGMYYNFVAYGVDQATERIDYDVVRQLALEHRPKLIVAGASAYPRQIDFARLREIADEAGSYFMVDMAHIAGLVAAGLHQNPVPYAHFVTTTTHKTLRGPRGGLILCQEEFAKAIDKAIFPGIQGGPLMHVIAAKAVAFGEALKPEFVEYQKRIVENAKVLSETLAEKGFRIVSGGTDNHLMLVDVRSKGLTGKEAEYILDEVGITVNKNTIPYDPASPMVTSGIRIGTPAVTSRGMDTLAMKKIAAAIDIALSEPNEAGAAKARDMVAALCAEYPLYPNLD

SEQ ID NO: 9109 - DNA, 1263 bp, Saccharophagus degradans 2-40
  CDS (1)..(1263): transl_table=11
atgtttgataccaagcaaacactcgacgcattcgacccagaaatttggcaatccatccaagatgaagcccagcgtcaagaagagcatattgagttaattgcttcagaaaactacaccagcccaatggtgatggaagcccaaggcaccaagcttactaacaaatatgcagaagggtacccaggcaagcgctactacggtggttgtgagtatgtagacaaagccgaagcattggctattgagcgtgcaaaaaccttgtttggtgcagattacgccaacgtacagccgcactctggttcgcaagctaactcggctgtttacgccgcattgtgttcacctggcgataccgtattaggcatgagcttggcgcacggtggtcacttaacgcacggtgcttccgttagcttctctggcaaaatgtacaacgcggtacagtacggcattaacccagatactggtttagtcgattacgaagaaattgctaacttggcgcgtgagcacaagccaaaaatgattgttgctggtttctcggcctatagccaagtactagattggcagaaattccgcgatatcgccgacgaagtaggcgcttacttaatggttgatatggctcacgttgctggtcttgttgccgctggtgtatacccatcacctgtgcaaattgccgatgtaactacctccactacccacaaaacattacgtggtccacgcggtggtattatccttgccaaagccaacccagagatagaaaagaaattaaactctgcggtattccctggcggtcaaggtggcccattgatgcacgtcattgcggctaaagcgattagctttaaagaggccatgaccgacgagtacaaagcgtatcaaaaacaagttgttgctaacgcaaaagccatggctgcaacattcaatgagcgcggcattaaaattgtatctggcggaaccgaaaaccaccttatgttggtagacttaatcggtaaagaatacaccggtaaagatgccgatgccgctttgggtgcagcgtacattaccgtaaacaaaaatgcggtacctaacgacccacgctcaccgtttgtaaccagcggtttacgcgttggtaccccggctgtaactacccgtggttttaaagagaagcagtgtatagaccttactaactggatttgcgacgtactagaaagcttagaaaacggcaattcagagcaagtaattgcagatgtaaaagcaaaagtattggctgtttgtgctgagttcccagtttacaaataa

SEQ ID NO: 9110 - protein, 420 aa, Saccharophagus degradans 2-40
MFDTKQTLDAFDPEIWQSIQDEAQRQEEHIELIASENYTSPMVMEAQGTKLTNKYAEGYPGKRYYGGCEYVDKAEALAIERAKTLFGADYANVQPHSGSQANSAVYAALCSPGDTVLGMSLAHGGHLTHGASVSFSGKMYNAVQYGINPDTGLVDYEEIANLAREHKPKMIVAGFSAYSQVLDWQKFRDIADEVGAYLMVDMAHVAGLVAAGVYPSPVQIADVTTSTTHKTLRGPRGGIILAKANPEIEKKLNSAVFPGGQGGPLMHVIAAKAISFKEAMTDEYKAYQKQVVANAKAMAATFNERGIKIVSGGTENHLMLVDLIGKEYTGKDADAALGAAYITVNKNAVPNDPRSPFVTSGLRVGTPAVTTRGFKEKQCIDLTNWICDVLESLENGNSEQVIADVKAKVLAVCAEFPVYK

SEQ ID NO: 9111 - DNA, 1293 bp, Methylobacillus flagellatus KT
  CDS (1)..(1293): transl_table=11
atgctaaaatcccgcctattcatttcatacccgagatatcgaaccatgtttagcacggccaaaaacctgagcgttgttgatcctgatctttggaaatatgtggaagcagagcgccatcgccaggacgaacacattgaactgattgcctccgagaattacaccagtcctgccgtgatgcaggcgcaaggttcgcaactgaccaacaagtatgcagagggctatccaggcaagcgattctatggcggctgtgaattcgttgatggtgtcgagcagctggcgatcgaccgcctgaagaagctgtttggcgccgagtatgccaacgtacagccacactccggctcccaggccaatcaggccgtatatttctccgtcctcaagcccggcgacaccgtcatggggatgaatctgggccatggcgggcacttgacccacggctcaccagccaacctgtccggcaagctgttcaacatcgtgccttacggcctgaatgacaaggaagagatcgactacgacgagatggaacgcattgcgctggaatgcaaacctaagctgctgatcggcggggcttctgcttacgccttgcgtttcgactgggcgcgcatggcagacatcgccaagaaagtaggcgcctatttcatggtcgatatggcgcattatgccggcctcatcgcggctggcgtctatcccaaccccgtgccgcatgccgattttgtcacctccacgacgcacaagaccttgcgtggcccgcgcggcggcctgatcatggccaaggcagagttcgagaagtcgctgaactccagcgtattccccagcctgcaaggtggtccattgatgcatgtcatcgctgctaaggcggttgccttcctcgaggccgcccagccagaattcaaggcctaccaggaacaagtattaaagaacgccgacaccatggccaagaccttggcttctcgaggcttgcgcatcatctccggcggcacgcagtcgcatgtgttcctggtcgacctgcgtcccaaggggctgactggcaaggcggctgacgcctatcttgggcaggcgcatatcaccgtgaacaagaacgccatcccaaacgaccccgagagcccattcgtcacttccggcatacgcatcggttcgcccgcgattaccacgcgcgggttcaaggaggccgaagctgcagaagtggccaacttgattgccgacatccttgataacccgactgacgagtccgtcatcgctgcgaccaaggccaaggtgcatgccttgacctcgcgcttcccggtgtacggcgcttag

SEQ ID NO: 9112 - protein, 430 aa, Methylobacillus flagellatus KT
MLKSRLFISYPRYRTMFSTAKNLSVVDPDLWKYVEAERHRQDEHIELIASENYTSPAVMQAQGSQLTNKYAEGYPGKRFYGGCEFVDGVEQLAIDRLKKLFGAEYANVQPHSGSQANQAVYFSVLKPGDTVMGMNLGHGGHLTHGSPANLSGKLFNIVPYGLNDKEEIDYDEMERIALECKPKLLIGGASAYALRFDWARMADIAKKVGAYFMVDMAHYAGLIAAGVYPNPVPHADFVTSTTHKTLRGPRGGLIMAKAEFEKSLNSSVFPSLQGGPLMHVIAAKAVAFLEAAQPEFKAYQEQVLKNADTMAKTLASRGLRIISGGTQSHVFLVDLRPKGLTGKAADAYLGQAHITVNKNAIPNDPESPFVTSGIRIGSPAITTRGFKEAEAAEVANLIADILDNPTDESVIAATKAKVHALTSRFPVYGA

SEQ ID NO: 9113 - DNA, 1248 bp, Burkholderia xenovorans LB400
  CDS (1)..(1248): transl_table=11
atgtttgacagagcccaaagcaccatcgccaacgtcgatcctgaactctggaaggtcatcgagcaggaaaaccgccgtcaggaagagcacatcgaactgatcgcgtcggaaaactacacgagcccggctgtcatggctgcgcaaggctcgcaactcacgaacaagtacgccgaagggtatccgggcaagcgctattacggcggttgcgagtacgtggacatcgccgagcagctggcgatcgaccgtgtgaagcaactgttcggcgccgaagccgccaacgtgcagccgaactccggctcgcaggccaaccagggcgtgttcttcgccgtgctcaagccgggcgatacgatcatgggcatgagcctcgcgcacggaggccacctgactcacggttcgccggtcaacatgtcgggcaagtggttcaacgtggtgagctacggcctgaacgaagccgaagacatcgactacgaagccgcggagaagctcgctcaggaacacaagccgaagctgatcgtggcgggcgcctccgcgttctcgctgcgtatcgatttcgaacgcatgtcgaagatcgccaggtcggtcggcgcgtatttcatggtcgacatggcgcattacgccggtctgatcgccgcgggcgtctatccgaatccggtgccgcacgccgatttcgtcaccaccaccacgcacaagagcctgcgcggcccgcgcggcggcgtgatcctgatgaaggcggagttcgaaaagcagatcaactcggccatcttcccgggcattcaaggtggaccgttgatgcacgtgatcgccggcaaggccgtcgcgttcaaggaagcgctctcgccggagttcaaggcgtatcagcagcaggtcgtcgaaaacgcgcgtgtgctggcggaaacgctggtcaagcgcggtctgcgcatcgtgtcgggccgcactgaaagccatgtgatgctcgtcgacctgcgtgcaaagaagattaccggcaaggctgcggaagcagcgctgggcacggctcacatcacggtcaacaagaacgcgattccgaacgatccggaaaagccgttcgtgacgagcggcgtgcgtctcggctcgccggccatgaccacgcgcggcttcggcgtcaaggaagccgagcaggtgggtaacctgatcgccgacgtgctggacaacccggaagacgccgccacgatcgaacgtgtgcgcgcgcaggtcgccgagctgacccagcgcttcccggtttaccgttaa

SEQ ID NO: 9114 - protein, 415 aa, Burkholderia xenovorans LB400
MFDRAQSTIANVDPELWKVIEQENRRQEEHIELIASENYTSPAVMAAQGSQLTNKYAEGYPGKRYYGGCEYVDIAEQLAIDRVKQLFGAEAANVQPNSGSQANQGVFFAVLKPGDTIMGMSLAHGGHLTHGSPVNMSGKWFNVVSYGLNEAEDIDYEAAEKLAQEHKPKLIVAGASAFSLRIDFERMSKIARSVGAYFMVDMAHYAGLIAAGVYPNPVPHADFVTTTTHKSLRGPRGGVILMKAEFEKQINSAIFPGIQGGPLMHVIAGKAVAFKEALSPEFKAYQQQVVENARVLAETLVKRGLRIVSGRTESHVMLVDLRAKKITGKAAEAALGTAHITVNKNAIPNDPEKPFVTSGVRLGSPAMTTRGFGVKEAEQVGNLIADVLDNPEDAATIERVRAQVAELTQRFPVYR

SEQ ID NO: 9115 - DNA, 1245 bp, Methanococcoides burtonii DSM 6242
  CDS (1)..(1245): transl_table=11
atgtcttacatttcagagattgacccggaaattgccaatgcattgtcattggaggcacagcgtcaggatttcaagttgaacttgatcgcttcagagaactacaccagccgcgctgttatggaagcacagggttccataatgaccaacaagtacgcagaaggctattccggaaagcgttattatggtggttgcgaatttgtcgatatggcagaggaccttgctatctcaagagcaaagcagatcttcggtgcagagcatgttaatgtccagcctcattcaggctcaggagctaacatggctgtctatttttctgttatcaagccaggcgacaagatcatgtcaatggacctttcccacggtggtcatctttcccacggaagtcctgtgagcttttcaggtcagttgtacaacatcgttccatacggtgtttcccaggataccgagatgcttgattataacgagctcatggaaatagcaaagaaagagaagccacagatgatcgttgtcggagcatctgcatattcccgtattatcgatttcaaggcattcagggaaattgctgacgaggttggagcataccttctcgcagatgttgcacacattgccggacttattgctgccggtgtacacccaaatccattcccatatgctgactttgtgacaacaaccactcataagacacttcgtggtccaaggggtggaatggtaatgtgcaaggaagagtacgcaaaagctatcaacaagtctgtattccccggaattcagggcggtcctcttatgcacataatcgctgcaaaggcagttgcattcaaggaagcattgagtgacagtttcaaaaaggatcaggaacaaaccgtcaagaacgcaaaagcactttgtgcagcgcttcaggacagggaattcgatatagtctctgatggaactgacaaccatcttatgcttatcaaccttaacaaatacgaccttacaggaaaggatgctgaggtcattatgagcaaagctggtattgttatcaacaagaataccattccattcgagacaagaggacctttcattacaagtggtctcagggcaggtacacctgcttgtactacacgtggtatgaaggaatcagcaatggatgagattgcagactttttcaagaccattattgacaacagggagaacaatgcagtccttgagactgtcaatgcagatgttcaggaactttgcagtcgcttccctatctatgagcatcttagataa

SEQ ID NO: 9116 - protein, 414 aa, Methanococcoides burtonii DSM 6242
MSYISEIDPEIANALSLEAQRQDFKLNLIASENYTSRAVMEAQGSIMTNKYAEGYSGKRYYGGCEFVDMAEDLAISRAKQIFGAEHVNVQPHSGSGANMAVYFSVIKPGDKIMSMDLSHGGHLSHGSPVSFSGQLYNIVPYGVSQDTEMLDYNELMEIAKKEKPQMIVVGASAYSRIIDFKAFREIADEVGAYLLADVAHIAGLIAAGVHPNPFPYADFVTTTTHKTLRGPRGGMVMCKEEYAKAINKSVFPGIQGGPLMHIIAAKAVAFKEALSDSFKKDQEQTVKNAKALCAALQDREFDIVSDGTDNHLMLINLNKYDLTGKDAEVIMSKAGIVINKNTIPFETRGPFITSGLRAGTPACTTRGMKESAMDEIADFFKTIIDNRENNAVLETVNADVQELCSRFPIYEHLR

SEQ ID NO: 9117 - DNA, 1527 bp, Ralstonia metallidurans CH34
  CDS (1)..(1527): transl_table=11
ttgcgcgactggcgaagtcagtgggtactaccacgaggaagcgcaagttcattgggcgtgatattcgatgcgcctgccgctcgcctgggcagcgaatgggaagcagggtgcgccctgcaccggctggtcgcgttttcgcgcccccggtgctggacgccagtgccttccccgcgcgccctaatacgcgaaaatcccgcaatacagagtagcgtcgacaggcatccggttttcgtaccggccgtgccatccgctctcccttttaaacagacgagtcacgccatgtttgaacgtagccgcttcacgatcgagcagatcgaccccgaagtctttgccgcgatccagaaggaaaaccagcgtcaggaagaccacatcgaactgatcgcttccgagaactacacctcgccggccgtgatggccgcccagggttcgcagctcaccaacaagtacgccgaaggctatcccggcaagcgctactacggcggttgcgagtacgtggacgtggtggagcagctcgccatcgaccgcgtgaagcaactgtttggcgccgaagccgccaacgtgcagccgaactcgggctcgcaggccaaccagggcgtgttcttcgccatgctcaagccgggcgacacgatcatgggcatgagcctggccgaaggcggtcacctgacccacggcatggcgctgaacatgagcggcaagtggttcaacgtggtcagctacggcctgaacgcgcaggaagacatcgactacgacgcgcttgaaaagctggcccacgagaagaagccgaagctgatcatcgccggcgcatcggctttcgcgctgcgcatcgacttcgaacgcatcgccaaggttgccaaggctgttggtgcctacttcatggtggacatggcccactatgccggcctgatcgccgccggtgtgtacccgaacccggtgccgcacgccgacttcgtgaccaccaccacccacaagagcctgcgtggcccgcgcggtggcgtgatcctgatgaaggccgagcatgagaaggccatcaactcggccatcttcccgggcatccagggtggtccgctgatgcacgtgattgccggcaaggccgtggccttcaaggaagcgctgcagccggacttcaaggcgtatcaggaacaggtggtcaagaacgccgccgcactggccgaaacgctgatcgcccgcggtctgcgcatcgtatcgggccgtacggaaagccacgtgatgctggtggacctgcgcgccaagaagatcaccggcaaggaagccgagaagatcctcggcgacgcccatatcacggtgaacaagaacgcgatcccgaacgatccggaaaagccgttcgtcacctcgggcatccgcctgggctcgccggccatgaccacgcgcggcttcaaggaagaagaagcccgccaggtggccaacctgatcgccgacgtgctggacaacccgcacgatgaggccaacatcgccgccgtgcgcgaacaggttgccgcactgacccgtcgcttcccggtctacggctga

SEQ ID NO: 9118 - protein, 508 aa, Ralstonia metallidurans CH34
MRDWRSQWVLPRGSASSLGVIFDAPAARLGSEWEAGCALHRLVAFSRPRCWTPVPSPRALIRENPAIQSSVDRHPVFVPAVPSALPFKQTSHAMFERSRFTIEQIDPEVFAAIQKENQRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAEGGHLTHGMALNMSGKWFNVVSYGLNAQEDIDYDALEKLAHEKKPKLIIAGASAFALRIDFERIAKVAKAVGAYFMVDMAHYAGLIAAGVYPNPVPHADFVTTTTHKSLRGPRGGVILMKAEHEKAINSAIFPGIQGGPLMHVIAGKAVAFKEALQPDFKAYQEQVVKNAAALAETLIARGLRIVSGRTESHVMLVDLRAKKITGKEAEKILGDAHITVNKNAIPNDPEKPFVTSGIRLGSPAMTTRGFKEEEARQVANLIADVLDNPHDEANIAAVREQVAALTRRFPVYG

SEQ ID NO: 9119 - DNA, 1281 bp, Acidobacteria bacterium Ellin345
  CDS (1)..(1281): transl_table=11
atgtcaaatcgcatgtctcaatcgttaaacgaagaagatccgcagatcgcagaggcgatcgcgaatgaggaacgccgtcagcacgagggtctcgagctcatcgccagcgaaaattttgtcagcgaagcagtgcttcaggccgcgggctcagtattcaccaacaagtacgccgaggggtatccgggaaagcgctactacggcggctgcgagtatgccgatgtggttgagaacctggcgcgcgatcgcgcgaaggaactcttcggcgcggagcacgctaacgtgcagccgcactccgggtcatccgccaacatggaagcctatggcgcgatccttcagcccggcgacacaattcttggtctgaaccttgcgcatggtgggcacctcacccacggacatccactgaacttttccggtaagacctacaagatcgtcccgtacggcgtgaccaaagaaaccgagaccatcgattacgacgagctcgagaagcttgcgctggaacaccatccgaaggtgatcgtcggcggaggcagcgcgtatccgcgtattttcgatttcaagcgcatgcgcgaaatcgccgacaaagccggcgcgctcttcatggtagatatggcacacttcgccggactggttgccggcggcgcacatccttcgccggtgccgcatgcgcacgtcgtgacgaccaccacgcacaagacactgcgtggaccgcgcgcgggcatgatcctctccaagcaggaattcgcagcggcgattgataaagtcacattccccggcatgcagggagggccgctggtgcacatcatcgcggccaaggccgtgtgcttcaaagaagccatggagccgagcttcaaggactacgcgaaccaagtggtcgcgaacgcgaaggtgctggcgcagtcactcgccgaccagggcttccgcattatttccggaggcaccgatacgcacctgatgctgatcgatgtcttcgcggccggaatgttgggcagcgaagccgaaaaggcgttgggcgaagctggaatcacggtgaacaagaacgcaattccgtttgacaccaacccgccgatgaagccgagcggcgtccgcattggaacgccggcgcttacgacgcgcgggatgaaggaaccagagatgcggcaggtcggcatctggattgcggagtcgttacggcaccgcacggatccggatttcctcggccgcgtgcggcgacaggtgcacgagctttgcgatgcgtacccgctgtatccggagcggagagcaacccggctggcgacggtatag

SEQ ID NO: 9120 - protein, 426 aa, Acidobacteria bacterium Ellin345
MSNRMSQSLNEEDPQIAEAIANEERRQHEGLELIASENFVSEAVLQAAGSVFTNKYAEGYPGKRYYGGCEYADVVENLARDRAKELFGAEHANVQPHSGSSANMEAYGAILQPGDTILGLNLAHGGHLTHGHPLNFSGKTYKIVPYGVTKETETIDYDELEKLALEHHPKVIVGGGSAYPRIFDFKRMREIADKAGALFMVDMAHFAGLVAGGAHPSPVPHAHVVTTTTHKTLRGPRAGMILSKQEFAAAIDKVTFPGMQGGPLVHIIAAKAVCFKEAMEPSFKDYANQVVANAKVLAQSLADQGFRIISGGTDTHLMLIDVFAAGMLGSEAEKALGEAGITVNKNAIPFDTNPPMKPSGVRIGTPALTTRGMKEPEMRQVGIWIAESLRHRTDPDFLGRVRRQVHELCDAYPLYPERRATRLATV

SEQ ID NO: 9121 - DNA, 1296 bp, Silicibacter sp. TM1040
  CDS (1)..(1296): transl_table=11
atgactgacgcgacccgcgaccccggtttcttcacccaaagcctctctgagcgcgacccagagctttttggcgcaatcaccgatgaactcggtcgtcagcgcgacgagatcgagctgatcgcctccgaaaacatcgtctctgctgccgtcatggaagcgcagggctctgtgctgaccaacaagtatgccgaaggctacccgggccgtcgctattatggcggctgccagtatgtcgacgtggccgaaaacctcgccatcgaccgggccaagcagctgttcaactgcgaatttgccaatgtgcagcccaactccggctcgcaggcgaaccagggcgtgttccaggcgattctgaagcccggcgacaccatcctcggcatggatctcgcgtccggcggtcacctcacccatggtgcagcgccaaaccagtccggcaaatggttcaacgcggtgcactacggcgtgcgcgaatccgactgcctgatcgactatgatcaggttcaggcacttgcgaccgagcaccagcccaagctgatcatcgccggcggctccgcgatcccgcgccagatcgattttgccaagttccgtgaaatcgctgacagcgtcggtgcctatctgctggtggacatggcgcatttcgccggtcttgttgcagcaggcgagcatccttcgcccttcccgcatgctgatgtggccaccaccaccacccacaagaccctgcgcggcccgcgtggcggcatgatcctgaccaacaacccggatctggcaaagaaattcaactctgccatcttcccgggcattcagggcggcccgctgatgcacgtgatcgcaggcaaagccgccgcctttggcgaggcgctgaagcccgagttcaaatcctaccagaaacaagtgcgtgcaaacgcggttgcgctggcggatgagctgatcaaaggcggtctggacatcgtgaccggcggcaccgacacccatgtgatgctggtagacctgcgccccaaaggcgtgacgggcaacatcgtcgacaaagcgctcggccgtgcgcatatcaccaccaacaagaacggcatcccgttcgacccggaaaagcccaccgtgacctccggtatccgcctcggcacgcctgcaggcacgacccgtgggtttggtgaggaagagttccgcgagatcgcccgtctgatcgtcgaggtggtcgacggtctcgcagccaatggcgaggacggcaacgccgcggtcgaagaagccgtgcgtggcaaagtcgcggcgctctgcggccgcttcccgctctatccaaacctctga

SEQ ID NO: 9122 - protein, 431 aa, Silicibacter sp. TM1040
MTDATRDPGFFTQSLSERDPELFGAITDELGRQRDEIELIASENIVSAAVMEAQGSVLTNKYAEGYPGRRYYGGCQYVDVAENLAIDRAKQLFNCEFANVQPNSGSQANQGVFQAILKPGDTILGMDLASGGHLTHGAAPNQSGKWFNAVHYGVRESDCLIDYDQVQALATEHQPKLIIAGGSAIPRQIDFAKFREIADSVGAYLLVDMAHFAGLVAAGEHPSPFPHADVATTTTHKTLRGPRGGMILTNNPDLAKKFNSAIFPGIQGGPLMHVIAGKAAAFGEALKPEFKSYQKQVRANAVALADELIKGGLDIVTGGTDTHVMLVDLRPKGVTGNIVDKALGRAHITTNKNGIPFDPEKPTVTSGIRLGTPAGTTRGFGEEEFREIARLIVEVVDGLAANGEDGNAAVEEAVRGKVAALCGRFPLYPNL

SEQ ID NO: 9123 - DNA, 1257 bp, Myxococcus xanthus DK 1622
  CDS (1)..(1257): transl_table=11
atggagaacatccgtacgctggccgaagtggacccggagattgcccgcgtcctccgcgaggagacccagcgccaggaggaagggctggagctcatcgcttcggagaacttcgtctctccggcggtgatggaggcggtgggctcggtgctcaccaacaagtacgcggaaggctaccccggcaagcgctactacggcggctgcgaggtggtggacgtcgcggagaacctggccatcgcccgcgccaaggacctgttcggcgcggacgcggtcaacgtgcaggcgcactccggcagccaggccaacatgggcgccttcatggcgctgatgaagccgggcgacaccatgctgtcgctggacctcaactccggcggccacctcacccacggcgccacgttcaacttctccggcaagctctacaaggtcgtccactacggcctgacgcgtgacacggagaccatcgacttcgcgcaggtggagtcgctggccaaggagcacaagccgaaggtcatcgtcgtgggcgccagtgcgtacccgcgcacgctggacttcgcgaagttccgcgagatcgccgacgcggtgggcgcggcgatgctggtggacatggcgcacatcgccggcctggtggcggcgggcgtgcacccttcgccggtgccggtggcggacatcgtcaccagcaccacgcacaagacgctgcgcggtccgcgtggcggcctggtgctgagccgcgagccctacgccaaggccatcaacagtcagatcttccccggcatccagggcggcccgctgatgcacgtcatcgccggcaaggcggtggccttcaaggaggcgctgtcgccggagttcaaggcgtaccagcggcagattgtcgccaacgcgaaggcgctggcggaggcgctccagcgcgcgggcctgcggctgacgtccggcggcacggacaaccacctgatgctggtggacctgcgccccaagaagctcacgggcaaggtggccgaagaggtgctggacaaggccggaatcaccgtgaacaagaacatgattccgtttgacccggagaagccgatgaccacgtccggtgtccgggtgggcacgccggccatcaccacgcgcggcatgcgcgaggcggagatggcggtggtggggcggctcatcggcgaggcgctggacgccgcgcaggacgacgccgcgctggcccgcatcaaggggcaggtgaaggagctttcgcaggggttcccgctctacgcctcgcggttgaagtag

SEQ ID NO: 9124 - protein, 418 aa, Myxococcus xanthus DK 1622
MENIRTLAEVDPEIARVLREETQRQEEGLELIASENFVSPAVMEAVGSVLTNKYAEGYPGKRYYGGCEVVDVAENLAIARAKDLFGADAVNVQAHSGSQANMGAFMALMKPGDTMLSLDLNSGGHLTHGATFNFSGKLYKVVHYGLTRDTETIDFAQVESLAKEHKPKVIVVGASAYPRTLDFAKFREIADAVGAAMLVDMAHIAGLVAAGVHPSPVPVADIVTSTTHKTLRGPRGGLVLSREPYAKAINSQIFPGIQGGPLMHVIAGKAVAFKEALSPEFKAYQRQIVANAKALAEALQRAGLRLTSGGTDNHLMLVDLRPKKLTGKVAEEVLDKAGITVNKNMIPFDPEKPMTTSGVRVGTPAITTRGMREAEMAVVGRLIGEALDAAQDDAALARIKGQVKELSQGFPLYASRLK

SEQ ID NO: 9125 - DNA, 1425 bp, Rubrobacter xylanophilus DSM 9941
  CDS (1)..(1425): transl_table=11
atgaggaacgaccaccgcgtctcgcccgcgttgggggacagagggggggcagcggcgaaccggcgagcctccgcggggggagcatccttcgggctccccggcgggtacatgacggcgccgcttgcggaggtggaccccgagatccaggaggtgctggagcgggagctcgagcgccagcgcaacaccttggagatgatcgcctctgagaacttcgtgccccaggcggtgctggaggcggtgggctccgtgctgaccaacaagtacgccgaaggctatccgggcaggcgctattacggcggctgccacgaggtggacgtcgccgagcagctcgccatagaccgggcgaaggagctcttcggggccgagcacgtcaacgtccagccccactccggcgcgcaggcaaacaacgccgcctacatggcgctgctcgagcccggcgacaccttcctggggctggcgctcgaccacggggggcacctctcgcacgggatgaagctcaacgtctccggcaggctctacaaccccgtcccctaccacgtcaggcgcgaggacagcctcgtggacatggaggaggtcgagcgcctggcaaacgagcacaggccaaagctcatcgtcgccggctggtcggcctacccgcgccagctggacttcgccgccttccgcgagatcgccgactcggtgggcgccaagctcatggtggacatggcccactttgcagggctcgtcgcggcgggcatccaccccaaccccgtcgagtacgcagacgtggtgaccaccacggttcacaagaccctcgccggtccccgaagcggcatgatcctctgccgggaggagcacgccaaaaagatagacagcgccgtcttccccggacagcagggcgggccgctcatgcacgtcatcgccgccaaggccgtcgccctgcggatagcccacaccgaaggcttccgcgcccgccagcggcagacggtcgccaacgcaaaagcgctcgccgaggcgctcatgcaaaacggcatagaggtggtctcgggcggcaccgacgtgcacctggtgctggtggacctcacctcgaccggcctcgacgggaagacggccgaagaccggctggagaaggtcggcatcacggtcaaccgcaacaccataccgttcgacccgcgaccgccgatgaacccctccggcctcaggataggcaccccggcgctcaccacgcgcggcctcctcgaggaggacatgcgcgagatcgccgggatcatcgcgggagccctgagcgacaacttcgaggcagagcataaggcgctgctcgagcgtagccgcgccctgatgcagaagtacccgctctacccggactcccagagaccaaccccggcagacggggaggggaaggaagcccccgctccgcctcccccaacgcgcccatcgtggctgtaa

SEQ ID NO: 9126 - protein, 474 aa, Rubrobacter xylanophilus DSM 9941
MRNDHRVSPALGDRGGAAANRRASAGGASFGLPGGYMTAPLAEVDPEIQEVLERELERQRNTLEMIASENFVPQAVLEAVGSVLTNKYAEGYPGRRYYGGCHEVDVAEQLAIDRAKELFGAEHVNVQPHSGAQANNAAYMALLEPGDTFLGLALDHGGHLSHGMKLNVSGRLYNPVPYHVRREDSLVDMEEVERLANEHRPKLIVAGWSAYPRQLDFAAFREIADSVGAKLMVDMAHFAGLVAAGIHPNPVEYADVVTTTVHKTLAGPRSGMILCREEHAKKIDSAVFPGQQGGPLMHVIAAKAVALRIAHTEGFRARQRQTVANAKALAEALMQNGIEVVSGGTDVHLVLVDLTSTGLDGKTAEDRLEKVGITVNRNTIPFDPRPPMNPSGLRIGTPALTTRGLLEEDMREIAGIIAGALSDNFEAEHKALLERSRALMQKYPLYPDSQRPTPADGEGKEAPAPPPPTRPSWL

SEQ ID NO: 9127 - DNA, 1305 bp, Rubrobacter xylanophilus DSM 9941
  CDS (1)..(1305): transl_table=11
atgggggcgcgggcgtcgagttttcggggaggggcggatgcccggcggatcccgcggagcggaggtggagcggagaggatgatgataggaccctacaccgaggtagtagacgccgaggtccaggaggcgctcgacggggagctggagcgccagcggaccaccatagagctcatcgccagcgagaacttcgcctcccccgcggtgctggcggcccagggctcggtgatgaccaacaagtacgccgaggggtatccggggaggcgctactacggcggctgcgagttcatggaccgggtcgagctgcttgcgataaaccgggcgaaggagctcttcggggccgagcacgtcaacgtccagccgcactcgggcagccaggccaacgaggccgcctacgcgaccctcatagagcccggcgacaaggtgctgagcatggaccttgcgcacggcgggcacctcacccacgggatgaagatcaacttcagcggccgcacctacgagttcgtccactacggggtgggggaggacgggttcatagactacgaccgggtgcgcgagatcgcgctgcgcgagcggccccgcctcatcctcgcgggggccagcgcctacccccgcgtcctgcacttcgaccggttccgcgagatcgccgacgaggtgggcgcctacttcatggcggacatggcccacgttgcggggctggtggcgggcggggtgcacccctcgccggtgccccactgcgaggtcgtcaccaccaccacccacaagacgctgcgcggggcccggggcgggatggtcctctgccgcgaggagttcgcctcccggctcggcagccgcgtcttcccgggcttgcagggggggccgctgatgcacgccatcgcgggcaaggcggtggccctcggcgaggcgctgcggccggagttcaaggactacgcccgcaggatcgtggagaacgcgcgggcgctggccgaagggctcatggagggcgggctgaagctcgtctccggcggcaccgacaaccacatgatgctcgtggacctgcggggcagcggcatcaccggcaaggaactggagcagcggctggagtccgtcggggtgacctgcaacaagaacatggtccccggagaccccgagccccccaccgtcaccagcggggtgcggctcggcacccccgccatgaccacccgggggatggggccgggggagatgcgcgagatcgcggacatcatcgtccgggcggcccgcggtgagaccgatggcctgcgcaggcgggtccttgccctcaccgaggccttcccgctgtatgcctga

SEQ ID NO: 9128 - protein, 434 aa, Rubrobacter xylanophilus DSM 9941
MGARASSFRGGADARRIPRSGGGAERMMIGPYTEVVDAEVQEALDGELERQRTTIELIASENFASPAVLAAQGSVMTNKYAEGYPGRRYYGGCEFMDRVELLAINRAKELFGAEHVNVQPHSGSQANEAAYATLIEPGDKVLSMDLAHGGHLTHGMKINFSGRTYEFVHYGVGEDGFIDYDRVREIALRERPRLILAGASAYPRVLHFDRFREIADEVGAYFMADMAHVAGLVAGGVHPSPVPHCEVVTTTTHKTLRGARGGMVLCREEFASRLGSRVFPGLQGGPLMHAIAGKAVALGEALRPEFKDYARRIVENARALAEGLMEGGLKLVSGGTDNHMMLVDLRGSGITGKELEQRLESVGVTCNKNMVPGDPEPPTVTSGVRLGTPAMTTRGMGPGEMREIADIIVRAARGETDGLRRRVLALTEAFPLYA

SEQ ID NO: 9129 - DNA, 1314 bp, Mesorhizobium sp. BNC1
  CDS (1)..(1314): transl_table=11
atggcacaagcatcgaccgtcgcggccgagaccgagacctttttctcccggccgctcgaggaaaccgattccgagatattctcggcaattcgcagcgaactcggccgccagcggcatgagattgagctgatcgcctccgaaaatatcgtctcgcgcgcagtgctcgaggcgcagggtacggtgctcaccaacaaatatgccgagggttatccgggtaagcgttattacggcggctgccagttcgtcgacgtggtggagcagcttgcgatcgaccgcgccaagaagcttttcaattgccagtttgcaaatgtgcagccccattcgggcagccagatgaaccaggcggtgttcctggcgctgctccagccgggcgacaccttcatggggctcgacctgaattcgggcggccaccttacccacggctcccccgtcaacatgtcgggaaagtggttcaacgtcgtttcctatggcgtgcgccgcgacgataacctcctcgatatggacgaggtggagcggctcgccacggagcacaagccgaagctgatcctggccggcggcacggcctattcgcggatttgggactggaagcgcttccgcgaaatcgccgatagcgtcggcgcctatctgatggtcgatatggcgcatatcgcgggcctcgtggcaggcggcgcgcatccttctccgctgccgcatgcgcatgtggtcaccacgacgacgcacaaatcgctgcgcggcccgcgcggcggcatggtcctcaccaatgacgaggatatcgccaaaaaggtgaactccgccgtgttcccgggcctgcagggcgggccgctgatgcatgtgattgccgccaaggcggtggcgctcggcgaggcgttgcagcccgaattcaaagcctatgcgcaccaggtggtggcgaatgcccgcgcgcttgcggcaagccttcaggagacagggctggagatcgtctccggcggcacggacaatcacctgatgctggtggatctcaggcccaaaaacgccacgggcaagcgggcggaggccgcccttggccgcgccaacatcacctgcaacaagaacggcattccctttgatcccgagaagcccttcgtgacctctggcatccggcttggcacgcccgctggcaccacgcgcggcttcggcgtagccgaattcagccagatcggccagcttatcgctgaggtcctggatgggctgcgcgccgtcaactccgacgatggcaatatcgccgtcgaggaggcggtgaagaaaaaggtgattgcccttaccgaacgtttcccgctctattcatatctggactga

SEQ ID NO: 9130 - protein, 437 aa, Mesorhizobium sp. BNC1
MAQASTVAAETETFFSRPLEETDSEIFSAIRSELGRQRHEIELIASENIVSRAVLEAQGTVLTNKYAEGYPGKRYYGGCQFVDVVEQLAIDRAKKLFNCQFANVQPHSGSQMNQAVFLALLQPGDTFMGLDLNSGGHLTHGSPVNMSGKWFNVVSYGVRRDDNLLDMDEVERLATEHKPKLILAGGTAYSRIWDWKRFREIADSVGAYLMVDMAHIAGLVAGGAHPSPLPHAHVVTTTTHKSLRGPRGGMVLTNDEDIAKKVNSAVFPGLQGGPLMHVIAAKAVALGEALQPEFKAYAHQVVANARALAASLQETGLEIVSGGTDNHLMLVDLRPKNATGKRAEAALGRANITCNKNGIPFDPEKPFVTSGIRLGTPAGTTRGFGVAEFSQIGQLIAEVLDGLRAVNSDDGNIAVEEAVKKKVIALTERFPLYSYLD

SEQ ID NO: 9131 - DNA, 1233 bp, Clostridium perfringens ATCC 13124
  CDS (1)..(1233): transl_table=11
atgaattttgacaacttagaaagagaagatgagcaaattgcacatcttgttcaaaaggaaaaggaaagacaagaaaatagtatagagcttatagcttcagaaaactttgttagcaaagctgttatggaagctatgggatcatatttaacaaataaatatgctgagggttacccttcaaaaagatactatggtggatgtcacgtagtagatgaggttgaagatttagcaagagaaagagtaaaaaaattatttggggctgagcatgctaatgtacaaccacattcaggatcacaagctaatatggctgtttatttttcaatattagagccaggtgatactgtattaggaatggatttaagccatggaggacatttaactcatggttcaccagttaacttttcaggtagattatttaatttcgtgtcatatggtgtagataaagagacagaaacaataaattatgaaactgtaagagaattagctcttaaacataaacctaaattaatagttgcaggagctagtgcatattcaagaattatagattttaaaactttaagagagatagcagatgaggtaggagcatacttaatggttgatatagctcacattgcagggcttgtagctacaggcttacatccatcaccagttccttatgctgattttgttacatcaacaactcataaaactttaagaggaccaagaggtggattaatactttgtaaagaaaaatttgcaaaagcattagataagaatatcttcccaggaatacaaggtggtcctttaatgcatataatagctgcaaaggctgtttgttttaaagaagcattagaaccaagttttaaaacatatatggagcaagttgttaaaaatgcacatgttttagcagaagctttagaatcttatggatttaaattagtttcaaatggaactgataaccatttaatacttgttgatttaactaataaagatataactggtaaagatgcagaaattcttttagatagcataggaataactttaaacaaaaatactgtaccaaatgaaacaagaagtccatttgttactagtggtgttagaataggaactcctgctataacaactagaggatttaaagaagaagaaatgaaagaaatagcttctataataaatgatgctattaaagaaaaagatggagatttagagccattaaaagcaagagttaaagctttatgtgctaagtatcctttatattaa

SEQ ID NO: 9132 - protein, 410 aa, Clostridium perfringens ATCC 13124
MNFDNLEREDEQIAHLVQKEKERQENSIELIASENFVSKAVMEAMGSYLTNKYAEGYPSKRYYGGCHVVDEVEDLARERVKKLFGAEHANVQPHSGSQANMAVYFSILEPGDTVLGMDLSHGGHLTHGSPVNFSGRLFNFVSYGVDKETETINYETVRELALKHKPKLIVAGASAYSRIIDFKTLREIADEVGAYLMVDIAHIAGLVATGLHPSPVPYADFVTSTTHKTLRGPRGGLILCKEKFAKALDKNIFPGIQGGPLMHIIAAKAVCFKEALEPSFKTYMEQVVKNAHVLAEALESYGFKLVSNGTDNHLILVDLTNKDITGKDAEILLDSIGITLNKNTVPNETRSPFVTSGVRIGTPAITTRGFKEEEMKEIASIINDAIKEKDGDLEPLKARVKALCAKYPLY

SEQ ID NO: 9133 - DNA, 1326 bp, Rhodococcus sp. RHA1
  CDS (1)..(1326): transl_table=11
atgaccgtggacaccgcacacctcaccgaggcggcagcagcgaacccgacgctgacgcattcgctcgccgatctcgaccccgccgtgcaccaggcgatcgccgccgagctggggcgacagcagggcaccctggaaatgattgccagtgagaacttcgccccgctcgcggtgatgcaggcgcaggggtcggtgctgacgaacaagtacgccgagggctaccccggccgccgctactacggcggttgcgagcacgtcgacgtcatcgagcagctcgccatcgaccgcctcaccgcgctgttcggtgcgaaattcgccaacgtgcaaccgcattcgggagcgcaggccaacgccgccgcgatgtcggcactgctcgagcccggcgacggcatcctcggcctggacctcgcgcacggcggtcacctcacgcacgggatgaagctgaacttctccggcaagctctacgacgtcgccgcgtaccacgtccgcgaggacgaccatctcgtcgacatggacgaggtcgagcatctggcccgtgagcaccgcccgaagctgatcctggccggctggtccgcctacacccgccaactcgacttcgccgcgttccggcgcatcgccgacgaggtcggcgcgtacctcatggtcgacatggcgcacttcgccggactcgtcgccgccggactgcacccctcccccgtcccgcacgcccacgtggtcacgtcgacgacgcacaagaccctcggcggcccccgcggcggcgtcatcctcaccaacgacgaggcactggccaagaagttcaactcctcggtgttccccggacagcagggcggcccgctcgagcacgtgatcgccggcaaggccgtctcgttcaagctcgctgccgagcccgaattccgggagcgccaggagcgcacgctcgccggcgcgaagatcctcgccgaccgcctcctgaaggacgactcccggcaggccggcatcaacgtcgtgtccggcggcaccgacgtgcacctggtgctggtggatctgcgcgagtccgagctcgacggcaagcaggccgaggaccggctgcaccgcgtgggaatcaccgtgaaccgcaacgccgtcccgttcgacccgcgtccgccgatggtcagctccggggtgcggatcggcacccccgcactcgccacccgcggtttcgacctggacgcgttcaccgaggtcgccgacatcatcagctacgcgctccggccggccaccgacgaggccgggctagacgaactccgcggccgcgtcgacgctctcgcactgcgtttcccgctctaccccgacctcacggaggcgaactga

SEQ ID NO: 9134 - protein, 441 aa, Rhodococcus sp. RHA1
MTVDTAHLTEAAAANPTLTHSLADLDPAVHQAIAAELGRQQGTLEMIASENFAPLAVMQAQGSVLTNKYAEGYPGRRYYGGCEHVDVIEQLAIDRLTALFGAKFANVQPHSGAQANAAAMSALLEPGDGILGLDLAHGGHLTHGMKLNFSGKLYDVAAYHVREDDHLVDMDEVEHLAREHRPKLILAGWSAYTRQLDFAAFRRIADEVGAYLMVDMAHFAGLVAAGLHPSPVPHAHVVTSTTHKTLGGPRGGVILTNDEALAKKFNSSVFPGQQGGPLEHVIAGKAVSFKLAAEPEFRERQERTLAGAKILADRLLKDDSRQAGINVVSGGTDVHLVLVDLRESELDGKQAEDRLHRVGITVNRNAVPFDPRPPMVSSGVRIGTPALATRGFDLDAFTEVADIISYALRPATDEAGLDELRGRVDALALRFPLYPDLTEAN

SEQ ID NO: 9135 - DNA, 1269 bp, Rhodococcus sp. RHA1
  CDS (1)..(1269): transl_table=11
atgagtgtcctgaaccgcgacctcgcggatttcgacccggacgtcgccgcactgatcggcaaggagctggagcgccagcgcaccggcctcgagatgatcgcgtcggagaaccacgccccgctttcggtgatgcaggcgcagggttccgtgctgaccaacaaatacgccgagggctaccccgggcggcgctactacggcggctgcgagcacgtcgacacgatcgagcagctcgccatcgatcgcgtcaaggcgctgttcgccgccgaatacgccaacgtgcaaccgcattccggcgccaccgcgaacgcgtcggtgatgcacgcgctgatcgagccgggcgacacgatcctcggaatgtccctcgccgacggcggccacctcacgcacggcatgcgcctcaacttctccggcaagctctacaacgtcgccgcctacggggtgtccgaacaggactacctcatcgacatggacgaggtggcgaaggcagcacgcgagcaccggccgcagctgatcatcgccggctggtcggcctacccccggcacctggacttcgcccgcttccgggaaatcgccgacgaggtcggcgcgtacctgatggtcgacatggcccacttcgcgggtctggtcgccaccggattccacccgtctcccgtcccgcacgcacacgtcgtcacgtcgacgacgcacaagaccctcggcggaccccgcggcggcatcatcctgacgggcgacgccgccatcgcgaagaagatcaactccgcggtgttccccggccagcagggcggcccactggaacacgtgatcgcgggcaaggcaacggcattcaagatggcggccgaacccgaattcgcggagcgtcaggaacgctgcctggacggcgcgaaggtcctcgccgaacggctcagccgacccgacgtcaaggaagccggaatcagcgtcctcaccggcggcacggacgtgcacctcgtcctcgtcgacctgcgggatgccgccatcgacgggcagcaggccgaggaccgcctcgacgcaatcggaatcaccgtcaaccgcaacgccgtcccgttcgatccacggccaccgatggtgacgtccggtctgcgcatcggcaccccggcactcgccgcccgcggcttcggccgggacgacttcgcgaccgtcgccgacctgatcgcccaggccctcgtcgcgcccgccgacgcggacacgtccgggttggccgcccaggtccgggcgctcgcggacaagtaccccctctatccggggctgtaa

SEQ ID NO: 9136 - protein, 422 aa, Rhodococcus sp. RHA1
MSVLNRDLADFDPDVAALIGKELERQRTGLEMIASENHAPLSVMQAQGSVLTNKYAEGYPGRRYYGGCEHVDTIEQLAIDRVKALFAAEYANVQPHSGATANASVMHALIEPGDTILGMSLADGGHLTHGMRLNFSGKLYNVAAYGVSEQDYLIDMDEVAKAAREHRPQLIIAGWSAYPRHLDFARFREIADEVGAYLMVDMAHFAGLVATGFHPSPVPHAHVVTSTTHKTLGGPRGGIILTGDAAIAKKINSAVFPGQQGGPLEHVIAGKATAFKMAAEPEFAERQERCLDGAKVLAERLSRPDVKEAGISVLTGGTDVHLVLVDLRDAAIDGQQAEDRLDAIGITVNRNAVPFDPRPPMVTSGLRIGTPALAARGFGRDDFATVADLIAQALVAPADADTSGLAAQVRALADKYPLYPGL

SEQ ID NO: 9137 - DNA, 1260 bp, Haemophilus somnus 129PT
  CDS (1)..(1260): transl_table=11
atgttaaaaagaagtatgaatattgccgattacgatccggttttatggcaagccattcaagatgaaaatcttcgtcaagaagagcatattgagctaattgcctcagaaaactatgccagcccacgagtaatggaagcacaaggttgtcaattcaccaataaatatgcagaaggctatccgggtaaacgttattatggcggttgtgaatatgcagatattgttgaacaattagcgattgatcgggcaaaagcgttgttcggtgcagattatgctaacgttcaaccgcactccggctcacaagcaaatgcggcggtttatatggcattattaaatccgggggacaccattttaggaatgagccttgctcatgggggacatttaactcacggtgcctcggtcagtttctccggtaaaatttataaagcggagcaatacggtattacatccgaaggactgattgactatgatgcgttgcgtaaacaggctcatgaagtgaaaccaaaaatgatcgtcggcggattttctgcctattctcaaatcgttgactgggcaaaaatgcgtgaaattgccgatgaagtaggtgcatatttatttgttgatatggcacatgttgcagggcttattgccgctggtgtatatccaagcccaatgccacatgctcatgtagttaccaccacaacacacaaaaccttagcggggcctcgtggagggttaattcttgccaacggcaatgaagaactttacaaaaaattaaatagtgcggtatttccggcaggacaaggcggaccgttagttcatgttattgcagcgaaagccgtttgttttaaagaagctttggaacctgagttcaaaacttatcaagcacaagtagtaaaaaatgcaaaagctatggtagaagtttttaaacaacgtggttacaacgtggtatctaacggtacagaaaaccatttattcttagttgatttagtcagtcatggtttaaccggtaaagcggccgatgcggcgttaagtcgtgccaatattactgttaataaaaatgcggttcctaatgatccgcaaaaaccgttcgttacttcaggtattcgtgtgggaacgcctgctgtaactcgtcgaggcttcaacgaagaagatgtggcggaacttgccggttggatgtgcgatattttagacagtatgaataaagataaccatgaacaagtcattgctgatactaaagaaaaagtgttagcaatttgcaaacgtcttcctgtttatccataa

SEQ ID NO: 9138 - protein, 419 aa, Haemophilus somnus 129PT
MLKRSMNIADYDPVLWQAIQDENLRQEEHIELIASENYASPRVMEAQGCQFTNKYAEGYPGKRYYGGCEYADIVEQLAIDRAKALFGADYANVQPHSGSQANAAVYMALLNPGDTILGMSLAHGGHLTHGASVSFSGKIYKAEQYGITSEGLIDYDALRKQAHEVKPKMIVGGFSAYSQIVDWAKMREIADEVGAYLFVDMAHVAGLIAAGVYPSPMPHAHVVTTTTHKTLAGPRGGLILANGNEELYKKLNSAVFPAGQGGPLVHVIAAKAVCFKEALEPEFKTYQAQVVKNAKAMVEVFKQRGYNVVSNGTENHLFLVDLVSHGLTGKAADAALSRANITVNKNAVPNDPQKPFVTSGIRVGTPAVTRRGFNEEDVAELAGWMCDILDSMNKDNHEQVIADTKEKVLAICKRLPVYP

SEQ ID NO: 9139 - DNA, 1254 bp, Shewanella sp. MR-4
  CDS (1)..(1254): transl_table=11
atgctgaaaaaagatatgaatatcgcagattatgatccggaactgttcaacgcaattcagaacgaaactctgcgtcaagaagagcatattgagctgattgcttctgaaaactacaccagtccacgcgtgatgcaagcgcaaggttcacaattaaccaacaagtacgccgaaggttatcctggcaagcgttactacggtggttgtgagtatgtggacgtagttgaaaccttagcaattgagcgtgcaaaacaactgtttggtgcgacttacgcaaacgtgcaacctcactcaggttctcaagcaaacagcgccgtttacatggcattgttaaaaccaggcgataccgttttaggtatgaacctcgctcacggtggtcacttgacccacggttcacctgtaaacttctccggtagactgtacaacatcattccttacggcatcgatgaatcaggcaaaatcgactacgacgaaatggaacgtctggcagttgaacataagcctaagatgatgatcggtggtttctctgcttactcaggcatcgttgactgggcaagaatgcgcgaaatcgcagacaaaatcggtgcttacctgtttgtcgacatggcgcacgttgcgggtcttatcgccgctggtgtgtatccaaaccctgtgccacacgcgcacgttgtgacctcaaccactcacaagaccttagccggtcctcgtggcggtatcattctgtctgcagccgatgatgaagatttatacaaaaagctgaactctgcggtattcccaggcggtcaaggcggtcctttgatgcacgttatcgcaggtaaagcggtagccttcaaagaagctttagagccagagttcaaagcttaccaacaacaagtggttaagaacgctaaagctatggttgaagtgttcttagagcgcggttacaagatcgtttctggcggtactgacaaccacttaatgctggtggacttaatcggtcgcgacctgacgggtaaagaagccgatgccgctttaggtagcgcgaacatcacagtaaacaaaaactctgtgcctaacgatccacgttctccattcgtgacctctggtgtgcgtattggtacgcctgcgatcactcgccgcggctttaaagaagctgaagcgaaagagttaaccggttggatctgtgacatcctcgacgatgcccacaacccagcagtcatcgagcgcgtaaaaggccaagtattggcactgtgcgcccgtttccctgtttacggttaa

SEQ ID NO: 9140 - protein, 417 aa, Shewanella sp. MR-4
MLKKDMNIADYDPELFNAIQNETLRQEEHIELIASENYTSPRVMQAQGSQLTNKYAEGYPGKRYYGGCEYVDVVETLAIERAKQLFGATYANVQPHSGSQANSAVYMALLKPGDTVLGMNLAHGGHLTHGSPVNFSGRLYNIIPYGIDESGKIDYDEMERLAVEHKPKMMIGGFSAYSGIVDWARMREIADKIGAYLFVDMAHVAGLIAAGVYPNPVPHAHVVTSTTHKTLAGPRGGIILSAADDEDLYKKLNSAVFPGGQGGPLMHVIAGKAVAFKEALEPEFKAYQQQVVKNAKAMVEVFLERGYKIVSGGTDNHLMLVDLIGRDLTGKEADAALGSANITVNKNSVPNDPRSPFVTSGVRIGTPAITRRGFKEAEAKELTGWICDILDDAHNPAVIERVKGQVLALCARFPVYG

SEQ ID NO: 9141 - DNA, 1260 bp, Alkalilimnicola ehrlichei MLHE-1
  CDS (1)..(1260): transl_table=11
atgttctcccgtgatatgaccatcgccagctttgacccggaactctccgaggccatggaggccgagcgccgtcggcaggaggatcacatcgagctgatcgcctccgagaactacgccagcccccgggtgctcgaggcccagggcagcgtactcaccaacaagtatgccgagggctacccgggcaagcgctattacgggggctgcgagcatgtggacgaggccgagcgcctggccatcgagcgggccaagcagctctttggcgccgactacgccaatgtgcagccgcactccggctcccaggccaacgcggccgtctatctggcgctgctccagcccggcgacaccatcctgggcatgagcctggaccacggcgggcacctgacccacggcgccaaggtgaacttctccgggcggctgttcaacgccgtgcagtacggcgtctgccccgacaccggcgagctggactacgcccagctcgagcgcctggccaaggagcaccagccgaagatgattatcggcggcttctccgcctactcccgggtggtggactggcagcgcctgcgcgacatcgccgattcggtgggcgcctacctgctggtggatatggcccacgtggcgggcctggtcgccgccggtgtctacccgagcccggtgcagatcgccgatgtcaccaccaccaccacccacaagaccctgcgcggcccgcgcggtggcctgatcctggcccgggccaacgccgaggtggagaaaaagctcaactcgctggtcttccccggcacccagggcgggccgctgatgcacgccatcgccggcaaggccgtggccttcaaagaggccctggagccggagttcaaggcctatcagcagcaggtggtcgcaaacgcccgggcgatggcccaggggctgatcgagcgcggctacaaggtggtctcgggcggcaccgacaatcacctgttcctgatcgacctggtggacaaggggctgaccggcaaggccgccgacgccgccctgggcaaggcgcacatcacggtcaacaagaacaccgtgcccaacgatccgcagtcgccctttgtcacctccggcctgcgcattggcaccccggcgatcaccacccgcggcttcaaggaagaggagtgccgcgagctggctggttggatggccgacgtgctggatgacatcgagaacgaggacgtgattgcgcgggtgcgcgagcaggtcacccaggtctgccgccgcctgccggtctaccaacagggctga

SEQ ID NO: 9142 - protein, 419 aa, Alkalilimnicola ehrlichei MLHE-1
MFSRDMTIASFDPELSEAMEAERRRQEDHIELIASENYASPRVLEAQGSVLTNKYAEGYPGKRYYGGCEHVDEAERLAIERAKQLFGADYANVQPHSGSQANAAVYLALLQPGDTILGMSLDHGGHLTHGAKVNFSGRLFNAVQYGVCPDTGELDYAQLERLAKEHQPKMIIGGFSAYSRVVDWQRLRDIADSVGAYLLVDMAHVAGLVAAGVYPSPVQIADVTTTTTHKTLRGPRGGLILARANAEVEKKLNSLVFPGTQGGPLMHAIAGKAVAFKEALEPEFKAYQQQVVANARAMAQGLIERGYKVVSGGTDNHLFLIDLVDKGLTGKAADAALGKAHITVNKNTVPNDPQSPFVTSGLRIGTPAITTRGFKEEECRELAGWMADVLDDIENEDVIARVREQVTQVCRRLPVYQQG

SEQ ID NO: 9143 - DNA, 1308 bp, Hyphomonas neptunium ATCC 15444
  CDS (1)..(1308): transl_table=11
atggcagattcggcgcatgttccagaaacgctggccgggggctttttctccgttggtcttgcagagcgcgaccccgagctggccgctgcgatcaaccaggaagccacccgccagcagcaccagatcgagctgatcgcctcggagaacatcgtctcccgcgccgtgctcgaagcccaaggctcgatcctcaccaacaaatacgccgaaggctatcccggcaaacgctactatggcggctgcgaattcgtcgacatcgctgaggaactcgcgatcgagcgcgccaagaagctgttcaattgcggctttgccaacgtccagccaaactccggcagccaggccaaccagggcgtcttccaggcggtcctgaagcccggcgacaccatcctcggcatgagcctcgccgccggtggccacctcacccacggcgccaagccaaaccagtccggaaaatggttcaacgctgtccagtatggcgtgcgcccggaagaccacctgatcgactttgatgaggttgagcgccttgcccgcgcccaccgcccgcagatgatcatcgccggtggctctgcctatccgcgccagattgacttcaaacgcttccgcgagattgccgatgatgtcggcgccatcttcctggtcgacatggcccactttgctggtctcgtcgccggcggcgcccatcccaacccgctcgaccattgccacattgccaccaccacgacgcacaagacccttcggggcccgcgcggcggcatgatcctcaccaatgacgaagctctcgccaagaagatcaactcggccatcttccccggcatccagggcggtcccctaatgcatgtcatcgccggcaaggcggtcgcctttggcgaggcgctgatgccggaattcaagacctatgttgagcaggtcgtctccaacgcccgcgccatggccgcagcctgccgcacggcgggcctcgatgtcgtctccgatggcaccgacacccacctcgcgctgattgacctgcgccccaaaggcgtcaccggccgcgacgccgaagccgctctcgagcgcgcctacatcacctgcaataagaacggcatcccgttcgatcccgccccgccgacggtcacctcgggcatccgggtcggctcgcctgcgggcaccacgcgcggcttccgcgaggaagagttcatccagatcggcacctggatcggcgagatcgtagacgctctggccaatggcaacagcgacgcggttgaagcccgcgtccgcgaagaggtgaaggcgctcacggcgcgtttccccatctatgaggggctggggggctga

SEQ ID NO: 9144 - protein, 435 aa, Hyphomonas neptunium ATCC 15444
MADSAHVPETLAGGFFSVGLAERDPELAAAINQEATRQQHQIELIASENIVSRAVLEAQGSILTNKYAEGYPGKRYYGGCEFVDIAEELAIERAKKLFNCGFANVQPNSGSQANQGVFQAVLKPGDTILGMSLAAGGHLTHGAKPNQSGKWFNAVQYGVRPEDHLIDFDEVERLARAHRPQMIIAGGSAYPRQIDFKRFREIADDVGAIFLVDMAHFAGLVAGGAHPNPLDHCHIATTTTHKTLRGPRGGMILTNDEALAKKINSAIFPGIQGGPLMHVIAGKAVAFGEALMPEFKTYVEQVVSNARAMAAACRTAGLDVVSDGTDTHLALIDLRPKGVTGRDAEAALERAYITCNKNGIPFDPAPPTVTSGIRVGSPAGTTRGFREEEFIQIGTWIGEIVDALANGNSDAVEARVREEVKALTARFPIYEGLGG

SEQ ID NO: 9145 - DNA, 1299 bp, Rhizobium leguminosarum bv. viciae 3841
  CDS (1)..(1299): transl_table=11
atgaccaatgcttccaccgaatccttcttcaatcgctcgcttgcggacgtcgatccggatattttcggcgcgatcggaaaggaactcggtcgccaacggcacgagatcgaactgatcgcttctgagaacatcgtctcccgcgccgtgctggaagcccagggctccatcatgaccaacaaatatgccgagggttatcccggcaagcgttattacggcggctgccagttcgtcgatatcgccgaggaactggcgatcgagcgcgccaagaagctgttcggcgtcaatttcgccaacgtccagccgaattccggttcgcagatgaaccaggccgtgttcctggcgctgctgcagcccggcgataccttcatggggctcgacctgaattcaggcggccacctcacgcatggttcgccggtcaacatgtccggcaagtggttcaacgtcgtctcctacggcgtgcgcgaaggcgacaacctgctcgacatggatgaagtcgcccgcaaggccgaggaaaccaagccgaagctcatcatcgccggcggcactgcctattcccgcatctgggactggaagcgcttccgcgagatcgccgacagcgtcggcgcttatctgatggtcgacatggcccacatcgccggcctcgttgccggtggtgttcatccgtcgccattcccgcattgccatgtcgcgacgacgacgacccacaagtcgctgcgcggcccgcgcggcggcgtcatcctcaccaatgacgaggatctggcgaagaagttcaattcggcggtcttccccggtctgcagggcggcccgctgatgcacattatcgccgccaaggctgtggccttcggcgaggcgctgcagcctgagttcaaggattatgccgcccaggtggtcaagaacgccaaggcgcttgccgaaacgctgatatcgggcggcctcgacgtcgtctccggcggcaccgacaaccacctgatgctggtcgacctgcgcaagaagaatgccaccggcaagcgcgccgaggcagccctcggccgcgcttacgtcacctgcaacaagaacggcattcccttcgatccggaaaagcccttcgtcacctcgggtgtgcgcctcggcgcaccggccggcacgacccgcggcttcaaggaagcggaattccgcgagatcggcaatctgatcgtcgaggtcctcgacggtctgaaggtcgccaattccgatgaaggcaacgccgcggtcgaagccgccgtgcgcggcaaggtggtcagcctcaccgaccgcttccccatgtacggctacatgggataa

SEQ ID NO: 9146 - protein, 432 aa, Rhizobium leguminosarum bv. viciae 3841
MTNASTESFFNRSLADVDPDIFGAIGKELGRQRHEIELIASENIVSRAVLEAQGSIMTNKYAEGYPGKRYYGGCQFVDIAEELAIERAKKLFGVNFANVQPNSGSQMNQAVFLALLQPGDTFMGLDLNSGGHLTHGSPVNMSGKWFNVVSYGVREGDNLLDMDEVARKAEETKPKLIIAGGTAYSRIWDWKRFREIADSVGAYLMVDMAHIAGLVAGGVHPSPFPHCHVATTTTHKSLRGPRGGVILTNDEDLAKKFNSAVFPGLQGGPLMHIIAAKAVAFGEALQPEFKDYAAQVVKNAKALAETLISGGLDVVSGGTDNHLMLVDLRKKNATGKRAEAALGRAYVTCNKNGIPFDPEKPFVTSGVRLGAPAGTTRGFKEAEFREIGNLIVEVLDGLKVANSDEGNAAVEAAVRGKVVSLTDRFPMYGYMG

SEQ ID NO: 9147 - DNA, 1233 bp, Pediococcus pentosaceus ATCC 25745
  CDS (1)..(1233): transl_table=11
atgaattatacaaaacaagatccagaattatggtcagcaattgaacgtgaagaaaagcgtcagcaacataatattgaattaattgcttcggaaaatattgtatctgatagcgtacgcaaggcccaaggtagtgtacttactaataagtatgccgaaggttatcctggcaaacgttactatggtgggtgtgaatttattgaccaagttgaacaattagcaattgatcgggcaaaagccatctttaatgcggaatatgtaaatgttcaaccccattctggttcccaagcgaatgctgcggcttatgccgcgtttattaaacctggggataaaattttagggatggaccttaatgctggtggacatttaacacacggtgctaaagtaagctttagtggaactttttatcaatcagtgagttatggggttgatcctcaaactgaaaaattagattacgatgaaattcgtcgtattgctttaaaagaacagccacaaattattgttgcgggagcttcggcctatagtcgatttattgattggaataaattccgcgaaattgctgatgaagtcggggcttatctgatggtagatatggcccatattgctggtctggtagcagctggtctgcatccttcaccagttggcattgctgatgtggttacaactacgacacataagaccctccgaggtccccgtggtggcatgattctttcgcaggaaaaatatgccaagcaacttaattttgcggtatttcctcaaaatcaaggtggtccattagaacatgttattgctgcgaaggccgttgcctttggtgaagcattgcaaccagaatttaagacttatcaaaaacaagttttaaaaaatgcgaaagcaatggctgaagtctttgaaaatgatacgattttgcacgtagtaacaggggggaccgataatcatctgatgacagtagatttaactgggacccaattaaatggtaaggaagtacagaatctgttagatggcgtcttcattactactaataaagaagctattccagaagaaaaattaagcccatttaaaacctcaggaattcgaattggaacgccagctattacgacacgaggatttaaagaagacgactgtcgtgaagttgctaatttgataattcgagcaatcaaaaatgcggataatgaaacagttctagaagaaattaagcgagatgtgttcaaactaactgaaaagtaccctattgattaa

SEQ ID NO: 9148 - protein, 410 aa, Pediococcus pentosaceus ATCC 25745
MNYTKQDPELWSAIEREEKRQQHNIELIASENIVSDSVRKAQGSVLTNKYAEGYPGKRYYGGCEFIDQVEQLAIDRAKAIFNAEYVNVQPHSGSQANAAAYAAFIKPGDKILGMDLNAGGHLTHGAKVSFSGTFYQSVSYGVDPQTEKLDYDEIRRIALKEQPQIIVAGASAYSRFIDWNKFREIADEVGAYLMVDMAHIAGLVAAGLHPSPVGIADVVTTTTHKTLRGPRGGMILSQEKYAKQLNFAVFPQNQGGPLEHVIAAKAVAFGEALQPEFKTYQKQVLKNAKAMAEVFENDTILHVVTGGTDNHLMTVDLTGTQLNGKEVQNLLDGVFITTNKEAIPEEKLSPFKTSGIRIGTPAITTRGFKEDDCREVANLIIRAIKNADNETVLEEIKRDVFKLTEKYPID

SEQ ID NO: 9149 - DNA, 1245 bp, Oenococcus oeni PSU-1
  CDS (1)..(1245): transl_table=11
atgacaaaaaattttttggatcctcaattggcaaaagctgtttcgggcgaggaagaacggcagcggcataacattgaattggttgcttccgagaattttgtctcaaaagctgtccgccaagcacagggcagtgttttgacgaataaatattctgaaggttatccggggaaacgctattatggcggtaatgaatatatcgatattgccgaaaatttagcgattgaacgagcaaaggaactgtttggtgttagttatgctaatgttcagccgcattccggttccagcgcgaattttgaagcatatatggcttttctgcatcctggcgataaaatccttggaatgaacttggattccgggggccatttaactcatggagccagtgttagtttttcaggcaaaatgtacgaagctcagtcttataaagttgattcagagactgaattacttgattatgatgcgattttaaaacaggcaaaagaatttaagcctaatttaattattgccggcgcttcggcttattcccgaacgatcgattttcaggcttttcgtgatatagctgatgaagtcaatgcttatttgatggttgatattgctcatattgctggtttaattgcggctggattgcatccaagcccggttggattggctgatatcattacaacaactacccataaaactcttcgaggaccttgcggcggtatgattttggctgacgaaaaatatgctaagaggattaattcggccgttttcccgggatcacaaggtggccctttggatcacgtggttgcggccaaggcagcggccttttatgaagatttgcagcctgatttcaagacttattctgctcagatcatcaagaacgcgaaaacaatggccgatgctttttccaaagagccggatgtgcgtgttgtttccggtggtactgacaatcatatgttcactctcgatttaaccaagactggtttaaatggccgacaagttcaagatttgttggattctgtttctattactcttaatcgcgaggcccttccgaacgagaaacgttcgccctttgtcacttccggtgttcgaattggtactccagccatgactaccaagggcttaaaagaaaacgaaatgctgcaaatcgaacacttgattatgcgggctattcacgctcatgatgacaaaaatgaattaacaaagattaagcgggatgtttttgatttgatggataaatttccttttgattccaatcccttctga

SEQ ID NO: 9150 - protein, 414 aa, Oenococcus oeni PSU-1
MTKNFLDPQLAKAVSGEEERQRHNIELVASENFVSKAVRQAQGSVLTNKYSEGYPGKRYYGGNEYIDIAENLAIERAKELFGVSYANVQPHSGSSANFEAYMAFLHPGDKILGMNLDSGGHLTHGASVSFSGKMYEAQSYKVDSETELLDYDAILKQAKEFKPNLIIAGASAYSRTIDFQAFRDIADEVNAYLMVDIAHIAGLIAAGLHPSPVGLADIITTTTHKTLRGPCGGMILADEKYAKRINSAVFPGSQGGPLDHVVAAKAAAFYEDLQPDFKTYSAQIIKNAKTMADAFSKEPDVRVVSGGTDNHMFTLDLTKTGLNGRQVQDLLDSVSITLNREALPNEKRSPFVTSGVRIGTPAMTTKGLKENEMLQIEHLIMRAIHAHDDKNELTKIKRDVFDLMDKFPFDSNPF

SEQ ID NO: 9151 - DNA, 1281 bp, Solibacter usitatus Ellin6076
  CDS (1)..(1281): transl_table=11
atgaccgaatcacaacgcatgtcccgcaccctcgccgaagtagaccctgaaatttaccaggccatccagcacgagacggcgcgccaggacggtcagctcgaactgatcgccagcgagaacttcacctccgaagccgtgctcgaagccaccggcagcgtcttcaccaacaagtacgcggaaggctatcccggcaaacgctactacggcggctgcgagtataccgacgtggtcgaaaacctggcccgcgagcgcgccagcaagctcttcggcgccgagtacgtcaacgtacagccccactccggctcgcaggccaaccaggccgcttacggggccgtggtctcccccggcgataccgtgatgggcctcaacctcgcgcacggcggacacctcacccacggccatgccctcaacttctccggcaagacttacaagatcgtcccctacaacgtccgtaaggaagacgagttgatcgattacgacgaagtcgaaaagctagcccgcgagcaccagcccaagatgatcatcgcgggcgccagcgcctacccgcgcatcatcgatttcgcccgtttccgcaaaatcgccgatgccgtcggcgccgtcttcctcgtcgatatggcgcacatctccggcctggtcgccgccggcgtccatccgaacccttgcgagttcgccgacatcgtcacctccaccacccataagaccctgcgcggaccgcgcgccggcatcatcctcgcccgcgaaaaatacggcaaggagatcgataagaacgtcttccccggcacccagggcggccccctcgtccacgtcatggcggccaaggccgtctgcttcctcgaagccctgcagcccgaattcgccgtctaccagcggcaggtcgtcgccaatgccaaagccctcgcgcagagcctgatcgatgccggcttccgcgtggtctccggcggcaccgatacccacgttgtcctgctcgacgtcttctcgaaagggctccgtggcaaggagagcgaacaggccctcgaccgcgcgcgcatcacggtcaacaagaacgccatcccgttcgataccaatccgcccatgaacccgagcggtatccgcctcggctcgcccgccgtcaccacccgcggcttcaaagaggccgagatgcgcgaagtcggcacgctgatcgccgaggtgctcactaatatcgcaaacgaggatgtcatcgccggcgtacggcagaaggtgcaggcgctcaccacccgcttcccgctctacagttggaaacgcgataccgtccaggcctag

SEQ ID NO: 9152 - protein, 426 aa, Solibacter usitatus Ellin6076
MTESQRMSRTLAEVDPEIYQAIQHETARQDGQLELIASENFTSEAVLEATGSVFTNKYAEGYPGKRYYGGCEYTDVVENLARERASKLFGAEYVNVQPHSGSQANQAAYGAVVSPGDTVMGLNLAHGGHLTHGHALNFSGKTYKIVPYNVRKEDELIDYDEVEKLAREHQPKMIIAGASAYPRIIDFARFRKIADAVGAVFLVDMAHISGLVAAGVHPNPCEFADIVTSTTHKTLRGPRAGIILAREKYGKEIDKNVFPGTQGGPLVHVMAAKAVCFLEALQPEFAVYQRQVVANAKALAQSLIDAGFRVVSGGTDTHVVLLDVFSKGLRGKESEQALDRARITVNKNAIPFDTNPPMNPSGIRLGSPAVTTRGFKEAEMREVGTLIAEVLTNIANEDVIAGVRQKVQALTTRFPLYSWKRDTVQA

SEQ ID NO: 9153 - DNA, 1269 bp, Magnetococcus sp. MC-1
  CDS (1)..(1269): transl_table=11
atgaatactgccgacctgaaaagcttcgatcctgaagtgcaatccgccattgatgaggaactggggcgtcagcgccatcagatcgaactgatcgcttcggaaaatattgtcagcccggcggtgatggccgctcagggcagcgtcatgaccaataagtatgccgaaggctaccccgccaaacgctattatggcggttgtgagtttgtggataaggtggaggtactggccatcgaacgggccaagcagctctttggttgcgcctacgccaacgttcaaccccactccggttcccaggccaacatggcagcctttatggccattgccccggcgggttccaccatcctgggcatgtcgctggcccatggtggacatttgacccacggtgccaaggttaacttttccggccagatctacaatgcggtgcagtatggcttgaatggagagtctgagcgcatcgactttgatcaggtgcaagccttggccatggagcataaacccgccattatcgttgcgggtgcctcggcctacagccgtatcattgattttgccaaatttcgtgaaatctgcgatgccgtgggtgccaaactggtggtggatatggcgcactttgccggtttagtggccaccggcgaacaccccagccccttcccccatgccgatattgtgaccaccaccacccataagaccctgcgcggtccccgtggcggtatgattttaaccaacgatgaagagctggcgaaaaagatcaactccaagatcttccccggtattcagggtggcccgttgatgcatgtgattgccgctaaagcggtggcttttaaagaggcgctctcacctgaatttaagatctacactcaacaggtgcgtaaaaatgctgtcgccttggctgaggtattggtggaggggggactgcgtatcgtctccggcgggacagacaaccatcttatgttggtggatcttaccagccgcgatatcaccggcaaagatacggaacatgcgttggagcgggcaggtctaacctgtaataaaaacgccatccccaacgatccacgcagtcctttcatcacctcgggtgtacgccttggtacccccgctgcgaccacccgtggatttgatgaagaggcctttcgtgcggtgggtcgcctgatcgtgcgggtggtggatgcggtagcagccagcggcggtgcgggagatccggccattgaggctgaggtgcataaagaagtggatgctttgtgccaaaaattcccaatctacgcagacatttaa

SEQ ID NO: 9154 - protein, 422 aa, Magnetococcus sp. MC-1
MNTADLKSFDPEVQSAIDEELGRQRHQIELIASENIVSPAVMAAQGSVMTNKYAEGYPAKRYYGGCEFVDKVEVLAIERAKQLFGCAYANVQPHSGSQANMAAFMAIAPAGSTILGMSLAHGGHLTHGAKVNFSGQIYNAVQYGLNGESERIDFDQVQALAMEHKPAIIVAGASAYSRIIDFAKFREICDAVGAKLVVDMAHFAGLVATGEHPSPFPHADIVTTTTHKTLRGPRGGMILTNDEELAKKINSKIFPGIQGGPLMHVIAAKAVAFKEALSPEFKIYTQQVRKNAVALAEVLVEGGLRIVSGGTDNHLMLVDLTSRDITGKDTEHALERAGLTCNKNAIPNDPRSPFITSGVRLGTPAATTRGFDEEAFRAVGRLIVRVVDAVAASGGAGDPAIEAEVHKEVDALCQKFPIYADI

SEQ ID NO: 9155 - DNA, 1254 bp, Shewanella sp. ANA-3
  CDS (1)..(1254): transl_table=11
atgctgaaaaaagatatgaatatcgcagattatgatccggaactgttcaacgcaattcagaacgaaactctgcgtcaagaagagcatattgagctgattgcttctgaaaactacaccagtccacgcgtgatgcaagcgcaaggttcacaattaaccaacaagtacgccgaaggttatcctggcaagcgttactacggtggttgtgagtatgtggacgtagttgaaaccttagcgattgagcgtgcaaaacaattgtttggtgcgacttacgcaaacgtgcaacctcactcaggttctcaagcaaacagcgccgtttacatggcattgttaaaaccaggcgataccgttttaggtatgaacctcgctcacggtggtcacttgacccacggttcgccagtaaacttctccggtagactgtacaacatcattccttacggcatcgatgaatcaggcaaaatcgactatgacgaaatggaacgtctggcggttgaacataagcctaagatgatgatcggtggtttctctgcttactcaggcatcgttgactgggcaagaatgcgcgaaattgcagacaaaatcggtgcttacctgtttgtcgacatggcgcacgttgcgggtcttatcgccgctggtgtgtatccaaacccagtgccacacgcgcacgttgtgacctcaaccactcacaagaccttagccggtcctcgtggcggtatcattctgtctgctgccgatgatgaagagttatacaagaagctgaactctgcggtattcccaggcggtcaaggcggtcctttgatgcacgttatcgcaggtaaagcggtagccttcaaagaagctttagagccagagttcaaagcttaccaacaacaagtggttaagaatgctaaagccatggttgaagtgttcttagagcgcggttacaagatcgtttctggcggtactgacaaccacttaatgctggtggacttaatcggtcgcgacctgactggtaaagaagccgatgccgctttaggtagcgccaacatcacagtaaacaaaaactctgtgccaaatgacccacgttctccattcgtgacctctggtgtacgtatcggtacgcctgcgatcactcgccgtggctttaaagaagctgaagcgaaagagttaaccggttggatctgtgacatcctcgacgatgcccacaacccagcggtcatcgagcgcgttaaaggccaagtattggcactgtgcgcccgtttccctgtttacggttaa

SEQ ID NO: 9156 - protein, 417 aa, Shewanella sp. ANA-3
MLKKDMNIADYDPELFNAIQNETLRQEEHIELIASENYTSPRVMQAQGSQLTNKYAEGYPGKRYYGGCEYVDVVETLAIERAKQLFGATYANVQPHSGSQANSAVYMALLKPGDTVLGMNLAHGGHLTHGSPVNFSGRLYNIIPYGIDESGKIDYDEMERLAVEHKPKMMIGGFSAYSGIVDWARMREIADKIGAYLFVDMAHVAGLIAAGVYPNPVPHAHVVTSTTHKTLAGPRGGIILSAADDEELYKKLNSAVFPGGQGGPLMHVIAGKAVAFKEALEPEFKAYQQQVVKNAKAMVEVFLERGYKIVSGGTDNHLMLVDLIGRDLTGKEADAALGSANITVNKNSVPNDPRSPFVTSGVRIGTPAITRRGFKEAEAKELTGWICDILDDAHNPAVIERVKGQVLALCARFPVYG

SEQ ID NO: 9157 - DNA, 1251 bp, Azoarcus sp. BH72
  CDS (1)..(1251): transl_table=11
atgttctcctcgcaagacactctcgccaaggtcgatcccgaactctggtccgccatccaggcggagaaccgccgccaggaagatcacatcgagctgatcgcctccgaaaactacgtctcccacgcggtgatggaagcccagggctcccagctcaccaacaagtacgcggaaggctatccgggcaagcgctactacggcggctgtgaacatgtggacgtggtcgagcagctcgcgatcgaccgtctgaagaagctcttcggcgccgacgccgccaacgtgcagccgaactccggctcccaggccaaccaggcggtgctgatggccttcgccaagcccggcgacaccatcatgggcatgagcctggccgaaggcggccacctcacccacggcatgccgctcaacatgtcgggcaaatggttcaacgtcgtcgcctacggcctcgacgagaaggaagagatcaactacgcggcgatggaagcgctcgcccgcgagcacaagccgaagatcatcatcgccggcgcctccgcctatgccctgcgcatcgacttcgagcgcttcgcgcgcatcgcgcgtgaagtgggcgccatcttctgggtggacatggcccactacgccggcctgatcgccgcgggctactaccccaacccggtgccgcacgccgacgtggtcacctccaccacccacaagaccctgcgcggcccgcgcggcggcatcatcctgatgaaggccgagcacgagaaggcgatcaactccgcgatcttccccggcctgcagggcggcccgctggagcacgtcatcgccgccaaggcggtggccttcaaggaagccgccaccccggcgttccgcgactaccaggaacaggtcatcgccaacgcccgcgtgatggcgcgcgtgctcggcgaagaacgcggcctgcgcatcgtctccggccgcaccgagtcccacgtcttcctggtcgacctgcgctccaagaacatcaccggcaaggaagccgaagccgtgctgggcagcgcccacatcacggtcaacaagaactcgatccccaacgatccgcagaagcccttcgtcacttccggcatccgcatcggttcgccggcgatgaccacccgcggcttcaccgagatcgaagccgagcagatcgcccacctgatcgctgacgtgctcgacgccccgcaggacgcggcggtcctcgaacgcgtgcgcggcaaggtcggcgagctgtgcgccaagttcccggtctacggtagctaa

SEQ ID NO: 9158 - protein, 416 aa, Azoarcus sp. BH72
MFSSQDTLAKVDPELWSAIQAENRRQEDHIELIASENYVSHAVMEAQGSQLTNKYAEGYPGKRYYGGCEHVDVVEQLAIDRLKKLFGADAANVQPNSGSQANQAVLMAFAKPGDTIMGMSLAEGGHLTHGMPLNMSGKWFNVVAYGLDEKEEINYAAMEALAREHKPKIIIAGASAYALRIDFERFARIAREVGAIFWVDMAHYAGLIAAGYYPNPVPHADVVTSTTHKTLRGPRGGIILMKAEHEKAINSAIFPGLQGGPLEHVIAAKAVAFKEAATPAFRDYQEQVIANARVMARVLGEERGLRIVSGRTESHVFLVDLRSKNITGKEAEAVLGSAHITVNKNSIPNDPQKPFVTSGIRIGSPAMTTRGFTEIEAEQIAHLIADVLDAPQDAAVLERVRGKVGELCAKFPVYGS

SEQ ID NO: 9159 - DNA, 1245 bp, Acidovorax sp. JS42
  CDS (1)..(1245): transl_table=11
atgtaccaacgcaatattcttgtcgaacaaaccgatcccgaggtgtgggccgccatccaggccgaagaccgccgccaggaagagcatatcgagctgatcgccagcgaaaactacgcctcgcccgccgtgatggccgctcagggctcgcagctcaccaacaagtacgccgaaggctaccctggcaagcgctactacggcggctgcgagaacgtggacgtgatcgagcagttggccatcgaccgcatcaagcaactcttcggcgccgaagcggccaatgtgcagcccaactcgggttcgcaggccaaccaggctgtgctgatggccttcctgaagcccggcgacaccattctgggcatgagcctggccgagggcggccacctcacgcacggcatgccgctgaacatgagcggcaagtggttcaacgtagtctcctacggactgaacgacaaggaagagatcgactacgatgcgctggaagccaaggcccgcgagcacaagcccaagctgatcatcgccggcgcctccgcctacgccctgcgcatcgacttcgagcgcttcgcgaagatcgccaaggaagtcggcgccatcttctgggtggacattgcccactatgccggcctggtcgtcgcgggcgagtaccccaacccggtgccgtttgcggacgtggtgacctccaccacgcacaagagcctgcgaggcccacgcggcggcatcattctgatgaaggcggagcacgagaaggccatcaacagcgccatcttccccggcctgcagggcggcccgctggagcacgtcatcgccgccaaggccgtggccttcaaggaagccctgtcgcccgagttcaagcagtatcagcagcaggtgaccaagaacgccaaggtgttcgcggaaacgctgatccagcgcggactgcgcatcgtgagcggtcgcaccgaaagccacgtgatgctggtggaccttcgcgccaagggcatcaccggcaaggaggccgaggcagccctgggcaaggcccatatcacgatcaacaagaacgcgatccccaacgatcccgaaaagccgatggtcaccagcggcattcgcgtgggcacgcccgccatcacgacacggggtttcaaggaagaggaaacgcgcctcacggccaacctggtggccgacgtgctggacaacccgcatgacgaggcgaacctggaagccgtgcgcgccaaggtgcacgcgctgaccagccgcttcccggtctatcgctga

SEQ ID NO: 9160 - protein, 414 aa, Acidovorax sp. JS42
MYQRNILVEQTDPEVWAAIQAEDRRQEEHIELIASENYASPAVMAAQGSQLTNKYAEGYPGKRYYGGCENVDVIEQLAIDRIKQLFGAEAANVQPNSGSQANQAVLMAFLKPGDTILGMSLAEGGHLTHGMPLNMSGKWFNVVSYGLNDKEEIDYDALEAKAREHKPKLIIAGASAYALRIDFERFAKIAKEVGAIFWVDIAHYAGLVVAGEYPNPVPFADVVTSTTHKSLRGPRGGIILMKAEHEKAINSAIFPGLQGGPLEHVIAAKAVAFKEALSPEFKQYQQQVTKNAKVFAETLIQRGLRIVSGRTESHVMLVDLRAKGITGKEAEAALGKAHITINKNAIPNDPEKPMVTSGIRVGTPAITTRGFKEEETRLTANLVADVLDNPHDEANLEAVRAKVHALTSRFPVYR

SEQ ID NO: 9161 - DNA, 1245 bp, Haemophilus somnus 2336
  CDS (1)..(1245): transl_table=11
atgaatattgccgattacgatccggttttatggcaagccattcaagatgaaaatcttcgtcaagaagagcatattgagctaattgcctcagaaaactatgccagcccacgagtaatggaagcacaaggttgtcaattcaccaataaatatgcagaaggctatccgggtaaacgttattatggcggttgtgaatatgcagatattgttgaacaattagcgattgatcgggctaaagcgttgttcggtgcagattatgctaacgttcaaccgcactccggctcacaagcaaatgcggcggtttatatggcattattaaatccgggggacaccattttaggaatgagccttgctcatgggggacatttaactcacggtgcctcggtcagtttctccggtaaaatttataaagcggagcaatacggtattacatccgaaggactgattgactatgatgcgttgcgtaaacaggctcatgaagtgaaaccaaaaatgatcgtcggcggattttctgcctattctcaaatcgttgactgggcaaaaatgcgtgaaattgccgatgaagtaggtgcatatttatttgttgatatggcacatgttgcagggcttattgccgccggtgtatatccaagcccaatgccacatgctcatgtagttaccaccacaacacacaaaaccttagcgggacctcgtggagggttaattcttgccaacggcaatgaagaactttacaaaaaattaaatagtgcggtatttccggcaggacaaggcggaccgttagttcatgttattgcagcgaaagccgtttgttttaaagaagctttggaacctgagttcaaaacttatcaagcacaagtagtaaaaaatgcaaaagctatggtaaaagtttttaaacaacgtggttacaacgttgtctctgacggtacagaaaaccatttattcttagttgatttagtcaatcatggcttaaccggtaaagcggctgatgcggcgttaagtcgtgccaatattactgttaataaaaatgcggttcctaatgatccgcaaaaaccgttcgttacctcaggtattcgtgtgggaacacctgctgtaactcgtcgaggcttcaacgaagaagatgtggcggaacttgccggttggatgtgcgatattttagacagtatgaataaagataaccatgaacaagtcattgctgatactaaagaaaaagtattagcaatttgcaaacgtcttcctgtttatccataa

SEQ ID NO: 9162 - protein, 414 aa, Haemophilus somnus 2336
MNIADYDPVLWQAIQDENLRQEEHIELIASENYASPRVMEAQGCQFTNKYAEGYPGKRYYGGCEYADIVEQLAIDRAKALFGADYANVQPHSGSQANAAVYMALLNPGDTILGMSLAHGGHLTHGASVSFSGKIYKAEQYGITSEGLIDYDALRKQAHEVKPKMIVGGFSAYSQIVDWAKMREIADEVGAYLFVDMAHVAGLIAAGVYPSPMPHAHVVTTTTHKTLAGPRGGLILANGNEELYKKLNSAVFPAGQGGPLVHVIAAKAVCFKEALEPEFKTYQAQVVKNAKAMVKVFKQRGYNVVSDGTENHLFLVDLVNHGLTGKAADAALSRANITVNKNAVPNDPQKPFVTSGIRVGTPAVTRRGFNEEDVAELAGWMCDILDSMNKDNHEQVIADTKEKVLAICKRLPVYP

SEQ ID NO: 9163 - DNA, 1251 bp, Actinobacillus pleuropneumoniae serovar 1 str. 4074
  CDS (1)..(1251): transl_table=11
atgaacattcaagattacgaccctattttatggcaggcgattgaaaacgaaaatcgccgtcaagaagaacatattgagctgattgcttcggaaaactatgcaagccctcgagtgatgcaggcgcaaggttcgcaatttactaataaatatgccgaaggttatccgggaaaacgctattacggcggttgcgaatatgcggatattgtcgagcaattagcgattgatcgtgcgaaacagttattcggtgcagactatgtaaacgtccaaccgcattcaggctcacaagcgaatgcagctgtttacggcgcattaattcaaccgaacgataccattttaggtatggacttagcacatggaggccatttaacgcacggagcaaaagtgagcttctcaggcaaaatttataattctgtcctctacggcatcacagccgaaggcttaattgattatgaagacgtccgtcaaaaagcgcttgagtgtaagccaaaaatgattgttgccggcttttccgcttattcacaaatcgtagattgggcgaaaatgcgtgaaattgccgatgaagtcggtgcttatttattcgtcgatatggcgcacgttgccggtttaattgcggcaggcgtttacccaagcccgcttccttacgctcacgttgttacaaccacaacccataaaactttaggcggtccgcgcggcggtttaattctttccgcttgtggcgatgaagaaatttataaaaaactgcaatcttcggttttcccggcaaaccaaggagggccattagtgcatattattgcggcgaaagcggtttgctttaaagaagcgcttgagcctgaatataaaatctatcaacaaaatgtagttaaaaatgcgaaagcaatggtagaagtattcaaacaacgcagctatgaagtaatttcaaacggtaccgaaaaccacttattcttagtcagctttgtaaaacaaggcttaaccggtaaagcggcagatgcggcgttaggtcaagcgaatatcaccgtaaataaaaattccgtgccgaatgatccgcaaaaaccgtttattacttccggtattcgcatcggtacgcctgccgttactcgtcgcggtttcaaagaagcggacgttcaagcccttgccggctggatgtgcgacgtattggacagcatcggtaaagacaatcacgaacaagtaattgcggaaaccaaagcgaaagtgcttgatatttgcgctcgcttgccggtatatgccaaataa

SEQ ID NO: 9164 - protein, 416 aa, Actinobacillus pleuropneumoniae serovar 1 str. 4074
MNIQDYDPILWQAIENENRRQEEHIELIASENYASPRVMQAQGSQFTNKYAEGYPGKRYYGGCEYADIVEQLAIDRAKQLFGADYVNVQPHSGSQANAAVYGALIQPNDTILGMDLAHGGHLTHGAKVSFSGKIYNSVLYGITAEGLIDYEDVRQKALECKPKMIVAGFSAYSQIVDWAKMREIADEVGAYLFVDMAHVAGLIAAGVYPSPLPYAHVVTTTTHKTLGGPRGGLILSACGDEEIYKKLQSSVFPANQGGPLVHIIAAKAVCFKEALEPEYKIYQQNVVKNAKAMVEVFKQRSYEVISNGTENHLFLVSFVKQGLTGKAADAALGQANITVNKNSVPNDPQKPFITSGIRIGTPAVTRRGFKEADVQALAGWMCDVLDSIGKDNHEQVIAETKAKVLDICARLPVYAK

SEQ ID NO: 9165 - DNA, 1263 bp, Rickettsia sibirica 246
  CDS (1)..(1263): transl_table=11
atgaatatttttaataataatttacacgaaacggataaagagattaatgaaataataaagcatgaaaagctgcgtcaaagtagcgtaatcgcgcttattgcatcagaaaatttcgtaagtcctgctgtgcttgaagctcaaggggcgcttctgactaacaaatatgccgaaggatacccaagtaagcgattctataacggttgcgaggaagtagataaagctgaaaatttagctatagaacgagtaaaaaaactctttaactgcaaatatgcaaatgtccaacctcattcaggatcacaagcaaatcaggctgtatatcttgctttattacagccgggtgatacggttcttggtatgtccttagatagcggcgggcatctaacgcacggtgcagctcctaatatgtctggtaaatggtttaacgccgtttcttatagcgtaaataaagagacttatttaatcgattatgatgagattgaacgcttagcggatttgcataaaccaaaattacttatagccggtttttctgcttatcctcgtaatattgattttgcaaaatttagagaaatcgtggataaagtaggagcttactttatggcagatattgctcatattgcaggacttgttgccacaggtgagcatcaaagccctattccttatgctcacgctgttacctctactactcataaaacacttagaggtccaagaggcggtttaattttatctaacgatgaagcgataggtcacaaaataaattctgcattatttccaggactacaaggtggtccgttaatgcatataatagctgcaaaagccgtagcttttttagaaaatttgcagcctgaatataaaagttatattcagcaggtaataagtaacgctaaagctttagcaagtagcttgcaagaaagaggatatgatatattaacaggtggtaccgataatcatattgttttagtggatttgcgtaaagacggaatcacgggtaagcttgccgcaaattctttggatagagcagggattatgtgtaataagaatgctatcccgtttgatgaaacttcgccttttatcacttcaggtattcgccttggtactcccgcatgtactactagaggctttaaagaaaaggattttgtattagtcggtcatatggtagcagatattttagacggcttaaaaaataatgaagataatagcgctcttgagcagaaagtattaaatgaagtgacaaaattaattgaattatttccgttttatggctaa

SEQ ID NO: 9166 - protein, 420 aa, Rickettsia sibirica 246
MNIFNNNLHETDKEINEIIKHEKLRQSSVIALIASENFVSPAVLEAQGALLTNKYAEGYPSKRFYNGCEEVDKAENLAIERVKKLFNCKYANVQPHSGSQANQAVYLALLQPGDTVLGMSLDSGGHLTHGAAPNMSGKWFNAVSYSVNKETYLIDYDEIERLADLHKPKLLIAGFSAYPRNIDFAKFREIVDKVGAYFMADIAHIAGLVATGEHQSPIPYAHAVTSTTHKTLRGPRGGLILSNDEAIGHKINSALFPGLQGGPLMHIIAAKAVAFLENLQPEYKSYIQQVISNAKALASSLQERGYDILTGGTDNHIVLVDLRKDGITGKLAANSLDRAGIMCNKNAIPFDETSPFITSGIRLGTPACTTRGFKEKDFVLVGHMVADILDGLKNNEDNSALEQKVLNEVTKLIELFPFYG

SEQ ID NO: 9167 - DNA, 1242 bp, Listeria monocytogenes str. 1/2a F6854
  CDS (1)..(1242): transl_table=11
atggtctatttacaaaagcaagataaggaagtttttgatgcaattaagttagaacttggtagacaacgcgcgaatatcgaattaatcgcatctgagaattttgttagtgagcaagtaatggaagcaatgggttctgtattaacgaataaatatgcagaaggttacccaggaaaacgctattacggcggatgtgaattcgtggatatcgtggaagatttagcacgcgaccgcgcgaaaaaattatttggagctgaatatgcgaacgttcaaccacactcaggtgctcaagcgaatatggcggtttatcatacagtgcttgaaccaggcgataccgttcttggtatgaacctttcacatggtgggcatttaacacatggtagcccagttaattttagcggcattttatacaattttgttgaatacggcgttcgtgaagatacaaaagagattgattatgatatcgtccgtgaagctgctttaaaacataaaccaaaaatgattgtagctggcgcaagtgcttatccacgtaaaattgattttgctaaattccgtgaaattgctgatgaagttggcgcatacttaatggtagatatggcgcatatcgccggtcttgttgctgctggtttacaccaaaatccagttccttatgctgattttacaacgacaactacccataaaacgcttcgtggacctcgcggtggaatgattttagccaaagcagaatgggaacaaaaattaaataaatcgattttcccaggaattcaaggtggaccattaatgcacgtaatcgcagcgaaagcagtggcgtttggtgaagcgttacaacctgaattcacaacgtattgcgagcaaattattcgtaattctaagaaattagcagaaactcttcaagcgaatgatgttgctgttttaacaggtggttcggataatcatttattattaattgatttaaaaccacttggcttaacaggaaaagcagctgaaaaagtattagatgaagttggtattaccgtgaataaaaataccattccattcgaaacggaaagcccatttgtaacaagtggtattcgtgtaggtgttgctgcagtgacgactcgtggattcgatgaagttgcgattgaaaaagtcggcgtacttatttcggaagtactgcataacttagaaaatgaagaagttctcgcagatgtaaaagcacgcgtggctactttaacaaatgaatatccgctttatccaagtttataa

SEQ ID NO: 9168 - protein, 413 aa, Listeria monocytogenes str. 1/2a F6854
MVYLQKQDKEVFDAIKLELGRQRANIELIASENFVSEQVMEAMGSVLTNKYAEGYPGKRYYGGCEFVDIVEDLARDRAKKLFGAEYANVQPHSGAQANMAVYHTVLEPGDTVLGMNLSHGGHLTHGSPVNFSGILYNFVEYGVREDTKEIDYDIVREAALKHKPKMIVAGASAYPRKIDFAKFREIADEVGAYLMVDMAHIAGLVAAGLHQNPVPYADFTTTTTHKTLRGPRGGMILAKAEWEQKLNKSIFPGIQGGPLMHVIAAKAVAFGEALQPEFTTYCEQIIRNSKKLAETLQANDVAVLTGGSDNHLLLIDLKPLGLTGKAAEKVLDEVGITVNKNTIPFETESPFVTSGIRVGVAAVTTRGFDEVAIEKVGVLISEVLHNLENEEVLADVKARVATLTNEYPLYPSL

SEQ ID NO: 9169 - DNA, 1263 bp, Rickettsia akari str. Hartford
  CDS (1)..(1263): transl_table=11
atgaatatttttaataataatttgcatgaaacggataaagaaattaatgaaataataaaacatgaaaagttacgtcaaagtagcgtaatcgagcttattgcatcagagaatttcgtaagtcccgcagtacttgaagctcaagggtcgattctgactaataaatatgcagaagggtattccggtaaacgtttttataacggttgtgaggaagtagataaagctgaaaatttagctatagagagagtaaaaaaattatttaactgcaaatatgcaaatgtgcaacctcattcaggctcacaagcaaatcaagctgtatatcttactttattacagccgggcgatacaattcttggtatgtcattagatagcggtgggcatctaacgcacggtgcatcccctaatatgtccggtaaatggtttaacgccgtttcttatggcgtaaataaaaaaacttatttaatcgattatgatgagattgagaggttagcagttttacataagccaaaactacttatagctggcttttctgcttatcctcgtaatattgattttacaagatttagagaaattgcggataaagtcggagcatatttcatggcagatattgctcatattgcagggcttgttgccacaggtgagcatcaaagccctatttcttatgctcatgttgttacctccactactcacaaaacgcttaggggaccaaggggtggtttagtcttatctgacgatgaagagataggcaaaaaaataaattctgcattatttccaggattacaaggtggtccgttaatgcatatagtcgccgcaaaagcagtagcttttttagaaagcttgcagcctgaatataaaagctatattaagcagataataagtaacgctaaagctttagcaagtagcttgcaagaaagaggatatgatatattaacaggcggaacagataatcatattgttttagtggatttgcgtaaaaacggaattaccggaaagcttgctgctaattctttagataacgcagggattacatgtaataagaatgctatcccgtttgatgaaacttcgccttttatcacttcaggtattcgccttggtactcccgcatgtactactagaggctttaaagaacaggatttcgtatcagtcggtcatatggtagcagatattttagatggtctaaagaataataaagataatactaaagctgaacagcaagtgctacataaagtaacaaaactaattaaattatttccgttttatgactaa

SEQ ID NO: 9170 - protein, 420 aa, Rickettsia akari str. Hartford
MNIFNNNLHETDKEINEIIKHEKLRQSSVIELIASENFVSPAVLEAQGSILTNKYAEGYSGKRFYNGCEEVDKAENLAIERVKKLFNCKYANVQPHSGSQANQAVYLTLLQPGDTILGMSLDSGGHLTHGASPNMSGKWFNAVSYGVNKKTYLIDYDEIERLAVLHKPKLLIAGFSAYPRNIDFTRFREIADKVGAYFMADIAHIAGLVATGEHQSPISYAHVVTSTTHKTLRGPRGGLVLSDDEEIGKKINSALFPGLQGGPLMHIVAAKAVAFLESLQPEYKSYIKQIISNAKALASSLQERGYDILTGGTDNHIVLVDLRKNGITGKLAANSLDNAGITCNKNAIPFDETSPFITSGIRLGTPACTTRGFKEQDFVSVGHMVADILDGLKNNKDNTKAEQQVLHKVTKLIKLFPFYD

SEQ ID NO: 9171 - DNA, 1263 bp, Rickettsia rickettsii
  CDS (1)..(1263): transl_table=11
atgaatatttttaataataatttacacgaaacggataaagagattaatgaaataataaagcatgaaaagctacgtcaaagtagtgtaatcgagcttattgcatcagaaaatttcgtaagtcctgctgtgcttgaagctcaaggggcgcttctgactaacaaatatgccgaaggatacccaagtaagcgattctataacggttgcgaggaagtagataaagctgaaaatttagctatagaacgagtaaaaaaactctttaactgcaaatatgcaaatgtccaacctcattcaggatcacaagcaaatcaggctgtatatcttgctttattacagccgggtgatacggttcttggtatgtccttagatagcggcgggcatctaactcacggtgcagcgcctaatatgtctggtaaatggtttaacgccgtttcttatagcgtaaataaagagacttatttaatcgattatgatgagattgaacgcttagcggatttgcataaaccaaaattacttatagccggtttttctgcttatcctcgtaatattgattttgcaaaatttagagaaatcgtggataaagtaggagcttactttatggcagatattgctcatattgcaggacttgttgccacaggtgagcatcaaagccctattccttatgctcacgctgttacctctactactcataaaacacttagaggtccaagaggtggtttaattttatctaacgatgaagagataggtcacaaaataaattctgcattatttccaggactacaaggtggtccgttaatgcatataatagctgcaaaagccgtagcttttttagaaaatttgcagcctgaatataaaagttatattcagcaggtaataagtaacgctaaagctttagcaagtagcttgcaagaaagaggatatgatatattaacaggtggtaccgataatcatattgttttagtggatttgcgtaaagacggaatcactggtaagcttgccgcaaattctttggatagagcagggattacgtgtaataagaatgctatcccgtttgatgaaacttcgccttttatcacttcaggcattcgccttggtactcccgcatgtactactagaggctttaaagaaaaggattttgtattagtcggtcatatggtagcagatattttagacggcttaaaaaataatgaagataatagcgctcttgagcagcaagtattaaatgaagtgacaaaattaattgaattatttccgttttatggctaa

SEQ ID NO: 9172 - protein, 420 aa, Rickettsia rickettsii
MNIFNNNLHETDKEINEIIKHEKLRQSSVIELIASENFVSPAVLEAQGALLTNKYAEGYPSKRFYNGCEEVDKAENLAIERVKKLFNCKYANVQPHSGSQANQAVYLALLQPGDTVLGMSLDSGGHLTHGAAPNMSGKWFNAVSYSVNKETYLIDYDEIERLADLHKPKLLIAGFSAYPRNIDFAKFREIVDKVGAYFMADIAHIAGLVATGEHQSPIPYAHAVTSTTHKTLRGPRGGLILSNDEEIGHKINSALFPGLQGGPLMHIIAAKAVAFLENLQPEYKSYIQQVISNAKALASSLQERGYDILTGGTDNHIVLVDLRKDGITGKLAANSLDRAGITCNKNAIPFDETSPFITSGIRLGTPACTTRGFKEKDFVLVGHMVADILDGLKNNEDNSALEQQVLNEVTKLIELFPFYG

SEQ ID NO: 9173 - DNA, 1278 bp, Exiguobacterium sibiricum 255-15
  CDS (1)..(1278): transl_table=11
atgaatgggggaattcagatggaacaaacaccactaacgtatctgaaacagcaagatgaggaactcttttcggctatgcgcaaggaactaaaacgtcaacgcgataacatcgagttgattgcgtcagaaaactttgtctcacaagcggtcatggaagctcaaggcagcgtgctgacgaacaaatacgctgaaggttacccgggtcgtcgttattacggcggttgtgagttcgtcgatttagcggaaaacttggcacgtgatcgtgcgaaggccatctttggagcagaacacgttaatgttcagccgcactcaggtgcccaggccaacatggccgtctacttcacaattctcaatcaaggcgacacggtcctcgggatgaacctctcccatggtggtcacctgacacacggcagtcctgtgaatttctccggtgttcaatacaacttcgtcgagtacggcgtcgatccagaaacagagatgatcgattacgatgtcgtcgcgaagcttgcggaagaacacaaaccaaaactgatcgttgcgggagcatcggcttatccgcgcgtgattgacttcaaacgattccgtgaaatcgcggacagtgtcggtgcctacttgatggtcgacatggcccacatcgcgggactcgttgcagcaggtctgcatccgaacccggtcgaacatgcccacttcgtcacgacgacgacgcacaagacgcttcgtggaccgcgcggtggaatgattctttgtaaagaagagcatgccaaagcgatcgataaatcgatcttcccgggtattcaaggcggaccgcttatgcacgtcatcgcagcgaaagccgttgcctttgcggaagcattagcacctgaattcaaggattacatcgagcaagtcgtagcgaatgcgaaagtcctcggtgaagaattgacggcacgcggactgcggattgtctccggcggtaccgacaaccacttgctgctcgtcgacctgcagccgctcggcatcacaggaaaactggcagagcatgcactggacgaagccggtatcacggtcaacaaaaacacgattccatttgatccggcaagtccgttcgtcacgagtggaatccggatcggaacagcggcgatgacatcacgcggtttcaaagaagcagaaatgaaacaaatcgcggaactgatcgaactcgttctgaaaaatccggaagatcaagaaacactgacaagtgcccataagcaagttctcgctttgacaggccgtttcccgctttacccggaacgcggttaa

SEQ ID NO: 9174 - protein, 425 aa, Exiguobacterium sibiricum 255-15
MNGGIQMEQTPLTYLKQQDEELFSAMRKELKRQRDNIELIASENFVSQAVMEAQGSVLTNKYAEGYPGRRYYGGCEFVDLAENLARDRAKAIFGAEHVNVQPHSGAQANMAVYFTILNQGDTVLGMNLSHGGHLTHGSPVNFSGVQYNFVEYGVDPETEMIDYDVVAKLAEEHKPKLIVAGASAYPRVIDFKRFREIADSVGAYLMVDMAHIAGLVAAGLHPNPVEHAHFVTTTTHKTLRGPRGGMILCKEEHAKAIDKSIFPGIQGGPLMHVIAAKAVAFAEALAPEFKDYIEQVVANAKVLGEELTARGLRIVSGGTDNHLLLVDLQPLGITGKLAEHALDEAGITVNKNTIPFDPASPFVTSGIRIGTAAMTSRGFKEAEMKQIAELIELVLKNPEDQETLTSAHKQVLALTGRFPLYPERG

SEQ ID NO: 9175 - DNA, 1323 bp, Prosthecochloris aestuarii DSM 271
  CDS (1)..(1323): transl_table=11
atgagtatagagatccttcagaaacaggataaggagattttcgacgctatatcgaacgaagttcttcgccagaccgaaacgcttgagcttatagcttcggaaaactttgccagcaaggcggttatggaagcctgcgggtccgtgatgaccaacaaatacgcagagggttatcccggaaagcgctattacggcggctgcgagtttgtcgatgttgccgaagaccttgccagagagcgtgcgaaaaaactctttggctgtcagtatgtcaatgttcagcctcattcgggttcaagcgcaaatatgggcgtgcttttttctgtgctgaaacccggggatacaatcatgggcctcgatctttctcacggcggccatttgacccacggtagttcggtgaacttttccggtcagctttttgatgcacactcttacggtgttgatcgtgagacaggactcattgatatggacagggttgaggatatggctctttcggtccgcccgaggctgattatctgcggagcaagcgcttactctcagggatttgatttcaaggcgttccgccagatcgcagacaaagtcggcgcgtttcttatggccgatatcgctcatccggcaggtcttatcgctgcaggtcttctcaacgatcccatgcctcattgccattttgtgacgacgacgacccacaagacgctcagaggtcctcgcggcggcatgatcatgatgggagaggatttcgaaaatcccatggggatcacgatcaagactaaagcgggtcgtaggaccaagatgatgtctgaagttatcgatgccgagatcatgcccggtatccagggtggtccgcttatgcacatcatcgcggcaaaggctgtcgcttttggagaggcgctccagccggagttcaaagaatatgctgttcaggtccgtgcaaatgcagccgcgatggcacagaaatttatcagtctcgattacaatatcgtcagcggaggtacgaaaaatcatctgatgcttatcgatctccgcaataagaatgtcacgggcaaggtagccgaaaaccttctgcatgaggccggtattaccgtcaacaaaaatatggttccgttcgatgacaaatctccttttgtgaccagcggcatccgcatcggcactccggcaatgacgaccagaggtatgacggagtctcatgccgaagccattgtttcgctgatcgaccgtgttatcggagctgccggcagtcctgatgccgggaccgtctgtggtgaagtccgttcggagattaaagccatgtgcggaactctccctctcaatgatttcagcccgactctctga

SEQ ID NO: 9176 - protein, 440 aa, Prosthecochloris aestuarii DSM 271
MSIEILQKQDKEIFDAISNEVLRQTETLELIASENFASKAVMEACGSVMTNKYAEGYPGKRYYGGCEFVDVAEDLARERAKKLFGCQYVNVQPHSGSSANMGVLFSVLKPGDTIMGLDLSHGGHLTHGSSVNFSGQLFDAHSYGVDRETGLIDMDRVEDMALSVRPRLIICGASAYSQGFDFKAFRQIADKVGAFLMADIAHPAGLIAAGLLNDPMPHCHFVTTTTHKTLRGPRGGMIMMGEDFENPMGITIKTKAGRRTKMMSEVIDAEIMPGIQGGPLMHIIAAKAVAFGEALQPEFKEYAVQVRANAAAMAQKFISLDYNIVSGGTKNHLMLIDLRNKNVTGKVAENLLHEAGITVNKNMVPFDDKSPFVTSGIRIGTPAMTTRGMTESHAEAIVSLIDRVIGAAGSPDAGTVCGEVRSEIKAMCGTLPLNDFSPTL

SEQ ID NO: 9177 - DNA, 1293 bp, Xylella fastidiosa Dixon
  CDS (1)..(1293): transl_table=11
atgctgattgcatcccctgtgtttttttccggagttgccatgttcccgcgtgatgctcgtcttgatatgtacgatcccgagttggctaaggccatcgctgctgaagtgaggcgtcaggaggatcacgttgagttgattgccagtgaaaattattgcagtacgttggtgatgcaggtgcaggggagtcaactgactaataagtatgctgaagggtattctggaaagcgttactacggtggttgtgagtatgtcgatatcgctgagcaattggcgattgagcgtgccaaacaactgtttggtgccgactatgccaatgtgcagccccatagcggttcacaagccaatcaagcggtgtactttgccttgttgcagccaggcgatacgatcctcgggatgagcttggcgcatggcggccacttgactcatggcgccaatgtcaatgtgtctggcaagttgttcaatgcggttcagtacggagtgaatgctcaagggttgattgattacgaggctgttgaatcgcttgcgttagagcatcggccgaagatggttgtggcgggcttttcggcgtattcgcagaaaatcgattgggtgcgcttccgtgccattgctgatcaggtgggcgcttacttgcttgtggatatggcacatgtggctggcttggtggcggctggtgtctatccgaatccgctgccgcatgcgcatgttgtgacttcgacgacgcataagacactgcgcggcccacgtggcggcattattgtggcgcaggctccgcaggaggcgttggttaagaagttgcagtcgatagtgtttcctgggatccagggtggtccattgatgcatgtgatcgcggctaaagcggttgcttttaaggaggcgctggagcctgcgtttaaggtgtatcagcagcaggtggtgaagaatgcgaaggcgatggctgagaccctcatgttacgtggctataagattgtctctggtggtacagaaaatcatttgatgctggttgacatgatcggcagggatgtttccgggagggatgctgagggtgcactgggtcaggctcatatcaccgtcaataagaatgccgtgccagatgatccgcgctctccgttcgtaacctccgggttacgcttggggactccggcagtcacgacgcggggttaccaggaacaggattgtgtggacttagcgcactggattgctgatgtgcttgacgcgcctgcggatgcgacggtcattgccgcagtccgtgagaaggttgcggcgcagtgcaagaagtatcctgtgtatcgctga

SEQ ID NO: 9178 - protein, 430 aa, Xylella fastidiosa Dixon
MLIASPVFFSGVAMFPRDARLDMYDPELAKAIAAEVRRQEDHVELIASENYCSTLVMQVQGSQLTNKYAEGYSGKRYYGGCEYVDIAEQLAIERAKQLFGADYANVQPHSGSQANQAVYFALLQPGDTILGMSLAHGGHLTHGANVNVSGKLFNAVQYGVNAQGLIDYEAVESLALEHRPKMVVAGFSAYSQKIDWVRFRAIADQVGAYLLVDMAHVAGLVAAGVYPNPLPHAHVVTSTTHKTLRGPRGGIIVAQAPQEALVKKLQSIVFPGIQGGPLMHVIAAKAVAFKEALEPAFKVYQQQVVKNAKAMAETLMLRGYKIVSGGTENHLMLVDMIGRDVSGRDAEGALGQAHITVNKNAVPDDPRSPFVTSGLRLGTPAVTTRGYQEQDCVDLAHWIADVLDAPADATVIAAVREKVAAQCKKYPVYR

SEQ ID NO: 9179 - DNA, 1260 bp, Streptococcus suis 89/1591
  CDS (1)..(1260): transl_table=11
atgatttttgacaaagttaactacaaagaatttgataaagaagtttgggaagctatccaagctgaagaaaaacgccaacaaaataatatcgaattgattgcgtctgaaaacgttgtttctaaagctgttatggcagctcaaggttctattttgaccaataaatacgcagaaggttacccaggtcgtcgttactatggcggtacggaatgcgttgacgtagttgaaagtttagctattgaacgtgctaaagaaatattcggtgcgaaatttgctaacgttcagccacactcaggaagccaggccaattgtgctgcctacatggccttgattgagccaggagacactgttatggggatggacttagctgcaggtggtcacttgactcacggtgcatcagttagcttctcaggacaaacttacaactttgtagcttacaatgttgacgaagaaactggcttgcttgattacgatgcaattttaaaacaagcaaaagaagtacagccaaaattgattgtagcaggtgcttcagcctatgcacgtacaattgactttgctaaattccgcgaaattgcagatgcagtgggtgccaaactgatggtggatatggctcatattgctggtcttgtagcagcaggtcttcatccgaacccagtgccacatgcccatattacaacaactacgactcataaaactcttcgtgggccacgtggtggtttaattttgaccaatgatgaagagcttatcaagaaaatcaactcagccatcttcccaggcatccaaggtggtccattagagcatgttattgctgcaaaagccgtatctttcaaagaagttttggacccagatttcaaagactatgctcaaaaagtgattgaaaacagcaaggccatggctgaggtcttccttgcaaaccctaactttaaagtcatcacaggaggaacagacaaccatctcttcctcgttgacgtgaccaaagttgttgaaaatggtaaagttgctcagcatctcttggatgaagtaaatattactctcaataaaaactcaattccttacgaaaaactctcaccattcaaaacaagcggtatccgtattggctctgcggccattactgctcgcggttttggagtagaggaagctcgcaaagttgcacaactaactatcaaagcacttgaaaatgcagaaaatgaaaaagctcttgaggaagtccgtcaagaagtgcgtgctttgacagatcaattcccactttacgaaggtttataa

SEQ ID NO: 9180 - protein, 419 aa, Streptococcus suis 89/1591
MIFDKVNYKEFDKEVWEAIQAEEKRQQNNIELIASENVVSKAVMAAQGSILTNKYAEGYPGRRYYGGTECVDVVESLAIERAKEIFGAKFANVQPHSGSQANCAAYMALIEPGDTVMGMDLAAGGHLTHGASVSFSGQTYNFVAYNVDEETGLLDYDAILKQAKEVQPKLIVAGASAYARTIDFAKFREIADAVGAKLMVDMAHIAGLVAAGLHPNPVPHAHITTTTTHKTLRGPRGGLILTNDEELIKKINSAIFPGIQGGPLEHVIAAKAVSFKEVLDPDFKDYAQKVIENSKAMAEVFLANPNFKVITGGTDNHLFLVDVTKVVENGKVAQHLLDEVNITLNKNSIPYEKLSPFKTSGIRIGSAAITARGFGVEEARKVAQLTIKALENAENEKALEEVRQEVRALTDQFPLYEGL

SEQ ID NO: 9181 - DNA, 1320 bp, Croceibacter atlanticus HTCC2559
  CDS (1)..(1320): transl_table=11
ttgctttttgttatttttgggctttcaattaaagatttacctcctatgcaacgtgatactgaaatattcgatttaatttctaaagaaaaagaacgccaaacaaatggtttagagcttatagcaagtgaaaattttgttagtgaccaagttatggaagctgttgggtctgtacttacaaataaatatgccgaaggttatcctggtaagcgttactatggtggttgtgaagttgtagatgttgtcgagcaaattgcaatagatagagcaaaggaactttttggagcttcttgggcaaacgtacaacctcattctggatctcaagctaacactgcagtttttgcagcttgcttaaatgcaggtgacaaatttttaggttttgatttatctcatggcggtcacctaacccatggttctccagtaaacttctctggtaaattatacaatcctgttcattatggtgtagaacgtgaaacaggacgattagattatgataatattcagaaaattgcagagcgcgaacagcctaagcttatcattgcaggagcttctgcctattcaagagagatagattataagcgttttagagaaattgcagatagcgtaggcgcacttttaatggcagatattgcgcatcctgctggtttaattgcaaagggcttactatctgatcctattcctcactgtcacgtttgtacaacaactactcataaaacattacgcggtcctcgtggtggtatgattttaatgggtgaagattttgataatccatttggattaacatttaagagtggcaaacctaaaaagatgtcttctttatttgatagcggcattttccctggaaaccaaggtggacctttagagcacgtaattgcaggaaaggctattgcttttggtgaagcgcttacagatgaatttttacattatatggttcaggttaagaagaatgctcacgttatggcagaagcttttgttgaaagaggttatgatgtgatttctggcggaacagacaaccacatgatgcttattgaccttagaaataaaaatgtaacaggtaaacttgctgaagaaactttaggtaaagcagaaattactgtaaataaaaatatggttccttttgatactgagtcgccatttgtaacatcaggaatacgtattggtactgctgcggttactactcgaggtttggttgaagatgatatgaaaactattgtagagtatattgaccgtgtaattaataatattgaaaatgatagtgagttagatgctgttaaaaatagcattcatgatatgatgaacggcaaacctttatttgttgtttaa

SEQ ID NO: 9182 - protein, 439 aa, Croceibacter atlanticus HTCC2559
MLFVIFGLSIKDLPPMQRDTEIFDLISKEKERQTNGLELIASENFVSDQVMEAVGSVLTNKYAEGYPGKRYYGGCEVVDVVEQIAIDRAKELFGASWANVQPHSGSQANTAVFAACLNAGDKFLGFDLSHGGHLTHGSPVNFSGKLYNPVHYGVERETGRLDYDNIQKIAEREQPKLIIAGASAYSREIDYKRFREIADSVGALLMADIAHPAGLIAKGLLSDPIPHCHVCTTTTHKTLRGPRGGMILMGEDFDNPFGLTFKSGKPKKMSSLFDSGIFPGNQGGPLEHVIAGKAIAFGEALTDEFLHYMVQVKKNAHVMAEAFVERGYDVISGGTDNHMMLIDLRNKNVTGKLAEETLGKAEITVNKNMVPFDTESPFVTSGIRIGTAAVTTRGLVEDDMKTIVEYIDRVINNIENDSELDAVKNSIHDMMNGKPLFVV

SEQ ID NO: 9183 - DNA, 1284 bp, Roseovarius nubinhibens ISM
  CDS (1)..(1284): transl_table=11
atgtccgattccggtttcttcaccgaatccctgagccagcgcgaccccgagctgcatgacgccatcacccaagaactgggccgtcagcgcgacgagatcgagctgatcgcgagcgagaacatcgtctcggccgccgtgatggaggcccagggctctgtcatgaccaacaaatacgccgaaggctatccgggccgccgctactatggtggctgccaatatgtcgacgtggccgagaacctcgccatcgaccgcgccaaacagctcttcggctgcgaatttgccaacgtgcaacccaactcgggcagccaggccaaccagggcgtgttccaggcgctgctgcagcccggcgacacgatcctcggcatgaacctcgcctcgggcggtcacctgacccatggcgcggcccccaaccagtcgggcaaatggttcaacgccgtgcaatatggcgtgcgcaaacaggacaatctgatcgactatgacgaggtcgaagcgctggccaaagaacaccagcccaagctgatcatcgccggcggctctgccatcccgcgcgtcatcgactttgccaagatgcgcgagatcgccgacagcgtcggcgcgctgttgcatgtcgacatggcgcatttcgccggtctcgtcgcggcaggcgaacatccctcgcccttcccgcatgcccatgtggccaccaccaccacgcacaagacgctgcgcggcccccgtggcggcatgatcctcaccaatgacgaggcaatcgccaaaaaggtcaactcggccattttcccgggcatccagggcggccccctgatgcatgtgatcgccgccaaggccgtggcctttggcgaggcgctgcgccccgagttcaaacaatacatgaaacaggtgcgcgccaatgccgacgcgctcgccgatcagctgatcaagggcggtctcgacatcgtcaccggcggcacagacacccatgtcatgctcgtcgacctgcgccccaagaaggtgaccggcaacatcaccgacgcggccctcggtcgcgcccatatcaccaccaacaagaacggtatcccgttcgacccggaaaagcccacggtgacctcgggcatccgtctcggcacccccgccggcaccacccgtggcttcaaagaggccgagttccgccagatcgccgactggatcgtcgaagtggtggacgggcttgccgccaacggtcccgatggcaatgacgaggtcgaggccaaggtccgtgcggaagtggccgaattgtgcgcccgcttcccgctctacccgaaccactaa

SEQ ID NO: 9184 - protein, 427 aa, Roseovarius nubinhibens ISM
MSDSGFFTESLSQRDPELHDAITQELGRQRDEIELIASENIVSAAVMEAQGSVMTNKYAEGYPGRRYYGGCQYVDVAENLAIDRAKQLFGCEFANVQPNSGSQANQGVFQALLQPGDTILGMNLASGGHLTHGAAPNQSGKWFNAVQYGVRKQDNLIDYDEVEALAKEHQPKLIIAGGSAIPRVIDFAKMREIADSVGALLHVDMAHFAGLVAAGEHPSPFPHAHVATTTTHKTLRGPRGGMILTNDEAIAKKVNSAIFPGIQGGPLMHVIAAKAVAFGEALRPEFKQYMKQVRANADALADQLIKGGLDIVTGGTDTHVMLVDLRPKKVTGNITDAALGRAHITTNKNGIPFDPEKPTVTSGIRLGTPAGTTRGFKEAEFRQIADWIVEVVDGLAANGPDGNDEVEAKVRAEVAELCARFPLYPNH

SEQ ID NO: 9185 - DNA, 1293 bp, Synechococcus sp. RS9917
  CDS (1)..(1293): transl_table=11
atgtctcagcgcctttcctctgcgatcaatgccgccctggtggatgccgaccccgccatctccggtctgatcggcaaggagcgggagcgtcaggagacccatctggagctgatcgcctcggagaatttcgcctccagggctgtgatggaagcccagggatcagtgctcaccaacaaatatgcggagggcctcccccacaagcgctactacggcggttgtgagcacgtggatgcgatcgaagagctggcgatcactcgcgccaaagagctcttcggtgccgcctgggccaatgtgcagccccacagcggcgcccaggccaacttcgccgtgttcctggccctgctcaagcccggtgacacgatcatgggcctcgacctcagccatggcggccacctcacccatggatcgccggtgaatgtcagcggcaaatggttcaacgtggtgcagtacggggttgatcgcgacacccagcgcctcgacatggaggcgatccgccagctggcgctgcagcatcggccgaagctgatcgtgtgcggttattccgcttatccgcgcaccatcgatttccaggctttccgcgccatcgctgatgaggtgggtgcctatctgatggccgacatggcccacatcgccggtcttgtggcggctggtgtgcatcccagccctgtgccggtctgtgatgtggtgaccaccaccacccacaagacgctgcgcggaccgcgcgggggtctgattctctgccgcgatgccgacttcgcccgccagttcgacaaggcggtgttccccggcacgcagggcggccccctcgagcatgtgatcgccgccaaagccgtggccttcggagaagcgttgcagcccagcttcaagacctatgcccagcaggtggtggcgaacgcccaggctctggcgtcccggctgcaggagcgggggatcgccgtggtgagtggtggcaccgacaaccatgtggtgctgctcgatctgcgcagcatcggcatgaccggcaaggtcgccgacctcttggtgagtgatgtgcacatcacggccaacaagaacacggttcccttcgacccggagtcgccgttcgtgaccagtggtctgcgtcttggcacggcggctctcaccacccgtggtttcgatcagggcgccttccagatcgtggctgatgtgatcgccgatcgtctgctccatcccgaagacgacgccatgcaggcccgttgcctcgaacgcgtgcgtgatctctgccagcgcttccccctctacgactcttcccccgtggaaccggcgcttgcctga

SEQ ID NO: 9186 - protein, 430 aa, Synechococcus sp. RS9917
MSQRLSSAINAALVDADPAISGLIGKERERQETHLELIASENFASRAVMEAQGSVLTNKYAEGLPHKRYYGGCEHVDAIEELAITRAKELFGAAWANVQPHSGAQANFAVFLALLKPGDTIMGLDLSHGGHLTHGSPVNVSGKWFNVVQYGVDRDTQRLDMEAIRQLALQHRPKLIVCGYSAYPRTIDFQAFRAIADEVGAYLMADMAHIAGLVAAGVHPSPVPVCDVVTTTTHKTLRGPRGGLILCRDADFARQFDKAVFPGTQGGPLEHVIAAKAVAFGEALQPSFKTYAQQVVANAQALASRLQERGIAVVSGGTDNHVVLLDLRSIGMTGKVADLLVSDVHITANKNTVPFDPESPFVTSGLRLGTAALTTRGFDQGAFQIVADVIADRLLHPEDDAMQARCLERVRDLCQRFPLYDSSPVEPALA

SEQ ID NO: 9187 - DNA, 1290 bp, Synechococcus sp. WH 7805
  CDS (1)..(1290): transl_table=11
atggtggatttcgcaaccgctccgatcaatgcacccctggcagactctgatcctgcgattgcccgcctgatcgatcaggagcgcgagcgtcaggaaacccatcttgagctgatcgcgtcggagaactttgcttcgagcgccgtgatggcggcccaggggtccgttttgaccaacaaatacgcggaaggccttccaaacaagcgctactacggcggttgtgagcacgtagatgccatcgaggaactggcgattgagcgggccaaggaactctttggtgcagcctgggccaacgttcagcctcacagtggtgcccaggccaatttcgctgttttcctggccctgcttcagcctggcgacacgatcatgggtctggatctgtcccatggcggtcacctgacccatggctcaccggtgaatgtgagtgggaaatggttcaacgttgtccaatacggggtcgatcaagagacccagcgattggatatggaggcgatccgtcagctggctctcgagcacaagcccaagctgatcatctgtggttactcggcctaccctcgcacgattgattttgcggcttttcgttcgattgccgatgaagttggcgcttacttgcttgccgacatggctcatatcgctggactcgtggcagcaggcgtccatcccagccctgttccgtactgcgatgtggtcaccacaacaacgcataagacgctgcgcggtcctcgcggtggtctgattctctgccgggatgcagatttcgccaagaagttcgacaaggccgtgttccctggcacgcaaggcgggcctctcgaacatgtgatcgcggcaaaggccgtggccttcggtgaggctctccggccatcattcaaggtctacagccagcaggttgtggctaacgctcaagcgttggccgaccgattgatggcccgcggcattgacgtggtgagtggggggactgataaccatgtggtgctgcttgatctgcgcagcatcggtatgaccggcaaggtggctgatctcctggtgagcgatgtgcacatcacggccaacaagaacacggttccttttgatccagaatcccccttcgtgaccagcgggctgcgcttagggaccgctgctctcaccacccgaggctttgataccgatgcatttgctgaggtggcggaggtgattgccgatcgcctcttgaatcccgcagacgacgcggttcagtcgcgctgtcttgagcgagtggcgaatctctgccgtcgcttccccctttacgcacaggcgacggagccggcgcttgtctga

SEQ ID NO: 9188 - protein, 429 aa, Synechococcus sp. WH 7805
MVDFATAPINAPLADSDPAIARLIDQERERQETHLELIASENFASSAVMAAQGSVLTNKYAEGLPNKRYYGGCEHVDAIEELAIERAKELFGAAWANVQPHSGAQANFAVFLALLQPGDTIMGLDLSHGGHLTHGSPVNVSGKWFNVVQYGVDQETQRLDMEAIRQLALEHKPKLIICGYSAYPRTIDFAAFRSIADEVGAYLLADMAHIAGLVAAGVHPSPVPYCDVVTTTTHKTLRGPRGGLILCRDADFAKKFDKAVFPGTQGGPLEHVIAAKAVAFGEALRPSFKVYSQQVVANAQALADRLMARGIDVVSGGTDNHVVLLDLRSIGMTGKVADLLVSDVHITANKNTVPFDPESPFVTSGLRLGTAALTTRGFDTDAFAEVAEVIADRLLNPADDAVQSRCLERVANLCRRFPLYAQATEPALV

SEQ ID NO: 9189 - DNA, 1257 bp, Pseudoalteromonas tunicata D2
  CDS (1)..(1257): transl_table=11
atgttagaacgcagcatgaacatcgcagattttgatccagagttattcgaagcaatcaataaagaaacggctcgtcaagaagagcacattgagcttatcgcttcagaaaactactgtagcccacgcgttttagaggctcaaggctcacaattaactaacaaatatgcagaaggatacccaggtaagcgttactacggtgggtgtgagcatgttgatgtagtagagcaattggcaatcgaccgtgcaaatgaattatttggcactgattacgcaaacgtacagccgcatgcgggttctcaagcaaatgctgctgtttttcaagcattacttcaaccacacgatactgtattagggatgagtcttgctcacggtggtcacttaactcacggttcacacgtaaacttttcaggtaaaacatataatgcgattcaatatggtttgaatgaagaaacaggtgaaatcgattatgcacaagttgaggcgttagcccttgaacataaaccaaaaatgattatcgctggtttctctgcatattcaggaattgttgactgggcaaaattccgtgaaatcgcggataaagtaggcgcgtatttattcgtcgatatggctcacgttgcaggcttaattgctgctggcgtttacccaagtccaattccatttgctcacgttgttacaacaacaactcacaaaacattagcaggccctcgtggtggtttaattgtttcggcatgtggcgatcaagaaatttataaaaagttaaacagtgctgtgttccctggtggtcaaggcggtcctttatgtcacattattgcagcaaaagctgtggcatttaaagaagcgttacagcctgagtttaaagtgtatcaagcgcaagttgtaaaaaatgcacaagctatggttgaagttcttcaagagcgtggctataaagttgtatctggtaaaacagacaaccacttatttttacttgatttgattgataaagatatcacaggtaaagatgctgatgcggcactaggtaatgctaacattactgttaacaaaaactcagtacctaacgatccacgttcaccatttgtgacctcaggcttacgtatcggttctcctgcaatcactcgtcgtggttttaaagaagctgaatcaaaagagttagcgggttggatttgtgatgttctagacaacatcaacgatgcatcagtgcaagcgcaagtaaaagaaaaagtaaaagcaatttgtaaaaagcttcctgtttacgcttaa

SEQ ID NO: 9190 - protein, 418 aa, Pseudoalteromonas tunicata D2
MLERSMNIADFDPELFEAINKETARQEEHIELIASENYCSPRVLEAQGSQLTNKYAEGYPGKRYYGGCEHVDVVEQLAIDRANELFGTDYANVQPHAGSQANAAVFQALLQPHDTVLGMSLAHGGHLTHGSHVNFSGKTYNAIQYGLNEETGEIDYAQVEALALEHKPKMIIAGFSAYSGIVDWAKFREIADKVGAYLFVDMAHVAGLIAAGVYPSPIPFAHVVTTTTHKTLAGPRGGLIVSACGDQEIYKKLNSAVFPGGQGGPLCHIIAAKAVAFKEALQPEFKVYQAQVVKNAQAMVEVLQERGYKVVSGKTDNHLFLLDLIDKDITGKDADAALGNANITVNKNSVPNDPRSPFVTSGLRIGSPAITRRGFKEAESKELAGWICDVLDNINDASVQAQVKEKVKAICKKLPVYA

SEQ ID NO: 9191 - DNA, 1251 bp, Photobacterium sp. SKA34
  CDS (1)..(1251): transl_table=11
atgctaaagcgcgatatgaatattgctgattatgatgcggaactatttgcagccattcaggaagaaacagctcgtcaggaagaacacatcgagttgattgcttctgaaaactatacaagcccacgtgtaatggaagcgcaaggatctcagctaactaataaatatgctgaaggttacccaggcaagcgttattacggtggttgtgagtttgttgataaagctgagcaactggctatcaaccgtgcttgtcagctatttggtgcagaatacgcgaacgttcagcctcactcaggctcacaagcgaataatgctgtttacatggcacttttgaatgctggcgataccgtattaggtatgagtcttgctcacggcggtcacttaactcacggttcaccagtaaacttctcgggtaagctttacaacgtgataccatacggtatcgatgaaagcggtcaaattgattacgctgaagttgaagcgttagcgcttgagcataaaccaaagatgatcatcggtggtttttctgcttactctcaaattgttgattggaaacgcatgcgtgaaatcgcagacaaagttggtgcatacttctttgttgatatggcgcacgtagcgggtctgattgctgcaggcgtttatcctaaccctgtgccacatgcacatgttgttacaacaacaacgcacaaaacactagcaggtcctcgtggtggtcttatcctttctaatgaaggtgaagatctttataagaagctgaactctgcagtattccctggtggtcaaggtggtcctctaatgcatgttattgcggcaaaagcagtagcatttaaagaagcaatggagcctgaatttaaaggttaccaagcacgtgttgttgaaaacgcaaaagtaatggtaggtgaattcctagagcgcggttacaagattgtttccggtagcactgaaaaccatttattccttgttgatttgatcgacaaaggtatcacaggtaaagaagcagatgcagcactaggtgcagcaaacatcactgttaataagaacagtgtaccaaatgatccacgtagcccatttgtaacatcaggtatccgtgtaggtacaccgtcaattactcgccgtggctttactgctgatgatgcacgtcaacttgcaggttggatgtgtgatgttttagacaatgttgataacgaagaagttattgcatcaacaaaagcaaaagttttagatatttgtaagcgtctacctgtttacgcttaa

SEQ ID NO: 9192 - protein, 416 aa, Photobacterium sp. SKA34
MLKRDMNIADYDAELFAAIQEETARQEEHIELIASENYTSPRVMEAQGSQLTNKYAEGYPGKRYYGGCEFVDKAEQLAINRACQLFGAEYANVQPHSGSQANNAVYMALLNAGDTVLGMSLAHGGHLTHGSPVNFSGKLYNVIPYGIDESGQIDYAEVEALALEHKPKMIIGGFSAYSQIVDWKRMREIADKVGAYFFVDMAHVAGLIAAGVYPNPVPHAHVVTTTTHKTLAGPRGGLILSNEGEDLYKKLNSAVFPGGQGGPLMHVIAAKAVAFKEAMEPEFKGYQARVVENAKVMVGEFLERGYKIVSGSTENHLFLVDLIDKGITGKEADAALGAANITVNKNSVPNDPRSPFVTSGIRVGTPSITRRGFTADDARQLAGWMCDVLDNVDNEEVIASTKAKVLDICKRLPVYA

SEQ ID NO: 9193 - DNA, 1257 bp, Oceanospirillum sp. MED92
  CDS (1)..(1257): transl_table=11
atgtttagcaaagatatgactatcgctgatttcgacgctgatctgtggtctgctatgcaggctgaagcagtacgtcaggaagagcacatcgaactgatcgcgtctgaaaactacactagcccacgtgtaatggaagctcagggttcagaactgactaacaagtatgctgaaggttaccctagcaagcgctactacggcggttgtgagcacgttgatgtagttgaagatctggcgattgaccgtgctaaagagttgtttggtgctacatacgcaaacgttcagcctcactcaggttcacaggctaacgctgctgtttacatggcgctttgtcagccgggtgatactgttctgggtatgagcctggcacacggtggtcacctgactcatggtgcatcagtatctttctcaggtcgtatctataacgctgtccagtacggtctgaacccagaaacaggtgagatcgattacgcagaagttgagcgcctggctgaagagcacaagccaaaaatgatcgttgccggtttctctgcatactcacgtgttgttgattggcagcgtttccgtgatatcgcagataaagtaggcgcttacctgtttgttgatatggcgcacattgcgggtctggttgcggcgggcgaatacccatcaccaattcagattgctgacgtagtaacgacaacgacacataaaacactgggcggtcctcgcggtggtctgatcctgtctgcgcgcgctgatgaagatctgcagaagaagctaaacttcgcagtattccctgaatctcagggggggccactgatgcacgttatcgctgctaaagcggtttgctttaaagaagcgatggagcctgagtggaaagcgtatcaaggccaggttgttaagaatgctcaggcaatggctgaaacattcaaatcacgtggtattaagatcgtttctgatggtacagatgatcacctgttcctggttgatctgatcggtaaagagtacacaggtaaagatgcggatgcggcgctgggtcgtgcaaacatcactgtgaataaaaactctgtaccaaatgatccacgctctccgtttgtgacgtctggcctgcgtattggtacaccagcggtaacgcgccgtggcttcaaagaagcagaagtgacagagctgactaactggatctgtgacgttcttgataacatcgataacgatgaagtgattgcacgtgttaaaggtcaggtaaaagagatctgcgcacgttaccctgtttacaagtaa

SEQ ID NO: 9194 - protein, 418 aa, Oceanospirillum sp. MED92
MFSKDMTIADFDADLWSAMQAEAVRQEEHIELIASENYTSPRVMEAQGSELTNKYAEGYPSKRYYGGCEHVDVVEDLAIDRAKELFGATYANVQPHSGSQANAAVYMALCQPGDTVLGMSLAHGGHLTHGASVSFSGRIYNAVQYGLNPETGEIDYAEVERLAEEHKPKMIVAGFSAYSRVVDWQRFRDIADKVGAYLFVDMAHIAGLVAAGEYPSPIQIADVVTTTTHKTLGGPRGGLILSARADEDLQKKLNFAVFPESQGGPLMHVIAAKAVCFKEAMEPEWKAYQGQVVKNAQAMAETFKSRGIKIVSDGTDDHLFLVDLIGKEYTGKDADAALGRANITVNKNSVPNDPRSPFVTSGLRIGTPAVTRRGFKEAEVTELTNWICDVLDNIDNDEVIARVKGQVKEICARYPVYK

SEQ ID NO: 9195 - DNA, 1305 bp, Oceanospirillum sp. MED92
  CDS (1)..(1305): transl_table=11
atgagtcacagtgatctgtaccgcaacgacgctgtttgcgaagcattttttactcaggatctgacaagccgtgatgctgagttgcagtccgctcttaatgaagaatttgatcgtcaggagatggggatcgaactgatcgcctctgaaaacattgtatctaaggctgttatgcaggctcagggtactgtactgactaacaagtatgctgaaggttacccaggccgtcgttactacggtggttgtgagtatgctgataaagcagaaggtctggcaattgagcgtgctaagcagctgtttgattgtgaatttgtcaacgttcagccgcactcgggtgctcaggcgaacggtgcagttatgctggcgctactacagcctggcgatactgttctgggtatgtctctggacgctggtggtcacctgactcacggtgcacgtcctgcactgtctggtaagtggttcaatgcagttcagtacggtgtttcccgtgaagacagccgtatcgattacgacgagatcgagaaactggcagtagagtgccagcctaaaatgatcatcgcaggtggttctgctatcccacgtcagattgacttcgcacgtttccgtgagatcgctgacaaagtaggcgcatacctgtttgtcgacatggcgcacattgctggtctggttgctacgggtgctcacccatcaccactgccacatgctcacgttgttacgacaacgacacacaaaactctgcgtggtccacgtggcggtatgatcctgtctaatgatctggatctgggtaagaagatcaactcggctgtattccctggccttcagggcggtcctctgatgcacgtgattgctgctaaagccgttgctttcggtgaagcgcttcagcctgagttcaagacttacatcgatcgtgtagtagagaacgcaaaagtattggctggcgttatggttgagcgtggttgtgacatcgtaacaggtggtactgatacccatctgatgctggtagatctgcgtccaaaaggtctgaaaggtaatgctgcagatgaagcgcttgagcgcgcgggcatcacttgtaacaagaacggtatcccgtttgatcctgaaaaaccgatggttacatctggtatccgtctgggtacaccagcgggcactagccgtggcttcggtcctgaagaattccgtctgatcggtaacctgatcagtgatgttctggatggcctggtggctaacccagaagataactcaaaagttgaagcggaagtacgtgcgcaggttgaagagctgtgcaagaagttccctctgtatcgataa

SEQ ID NO: 9196 - protein, 434 aa, Oceanospirillum sp. MED92
MSHSDLYRNDAVCEAFFTQDLTSRDAELQSALNEEFDRQEMGIELIASENIVSKAVMQAQGTVLTNKYAEGYPGRRYYGGCEYADKAEGLAIERAKQLFDCEFVNVQPHSGAQANGAVMLALLQPGDTVLGMSLDAGGHLTHGARPALSGKWFNAVQYGVSREDSRIDYDEIEKLAVECQPKMIIAGGSAIPRQIDFARFREIADKVGAYLFVDMAHIAGLVATGAHPSPLPHAHVVTTTTHKTLRGPRGGMILSNDLDLGKKINSAVFPGLQGGPLMHVIAAKAVAFGEALQPEFKTYIDRVVENAKVLAGVMVERGCDIVTGGTDTHLMLVDLRPKGLKGNAADEALERAGITCNKNGIPFDPEKPMVTSGIRLGTPAGTSRGFGPEEFRLIGNLISDVLDGLVANPEDNSKVEAEVRAQVEELCKKFPLYR

SEQ ID NO: 9197 - DNA, 1356 bp, Xanthobacter autotrophicus Py2
  CDS (1)..(1356): transl_table=11
atgcgtcccgccggggtgccccgacattaccggagacctgccatggcctcgcaggacgcgaaccgctcctccatttcggaggaaatgaaccgcttcttcactgcccctctcgccgagagcgatcccgagatcgccggcgcggtgaaggcggagctgggtcgccagcgcgacgagatcgagctgatcgcgtccgagaacatcgtctcgcgcgccgtgctcgaggcccagggctccgtgctcaccaacaagtatgccgagggctatccgggcaagcgctactacggcggctgccagttcgtggacgtggcggaaaacctcgccatcgagcgcgccaagaagctgttcggctgcggcttcgccaacgtccagcccaattccggcagccaggccaaccagggcgtgttcttcgccctgctgcagccgggcgatacctttctgggcctcaaccttgccgccggcggtcacctgacccacggctcgccggtcaacatgtccggcaagtggttcaagcccgtgccctacacggtgcgcgaggacgatcagcgcatcgactatgacgaggtggcgcggctcgccgacgagcacaagcccaagctcatcgtggccggcggctcggcctacccgcgcgtcatcgatttcccgaagatgcgcgccatcgccgacagcgtgggcgccaagctcatggtggacatggcgcattttgccggtctcgtcgccggtggcgcccacccgagcccgttcccccacgcccatgtggtgaccaccaccacccacaagaccctgcgtgggccgcgcggcggcatgatcctcaccaatgacgaggacctggccaagaagatcaattcggccatcttccccggcatccagggcgggccgctgatgcatgtcatcgctgccaaggcggtggccttcggcgaggcgctgcgccccgagttcaagctctatgcgaagaacgtggtggagaatgccaaggcgctggccgagaccctgaagggccacggcttcaacatcgtctccggtggcaccgacacccacctgatgctggtggacctgcgccccaagcgcctcaccggcaagacctcggaaggcgcgctgggccgggcgcacatcaccaccaacaagaacggcatcccgttcgatcccgagaagccgttcgtgacctccggcatccgcctcggcacgccggcctgcaccacgcgcggcttcggggtggccgagttccagcaggtgggcgacttcatcgccgaggtgctcgacgtgctctcccagaagggcgtggacgaggattcgctggtggaagccacggtgcgtgagaaggtctcgggcctgctcgcccgcttccccatctatccctga

SEQ ID NO: 9198 - protein, 451 aa, Xanthobacter autotrophicus Py2
MRPAGVPRHYRRPAMASQDANRSSISEEMNRFFTAPLAESDPEIAGAVKAELGRQRDEIELIASENIVSRAVLEAQGSVLTNKYAEGYPGKRYYGGCQFVDVAENLAIERAKKLFGCGFANVQPNSGSQANQGVFFALLQPGDTFLGLNLAAGGHLTHGSPVNMSGKWFKPVPYTVREDDQRIDYDEVARLADEHKPKLIVAGGSAYPRVIDFPKMRAIADSVGAKLMVDMAHFAGLVAGGAHPSPFPHAHVVTTTTHKTLRGPRGGMILTNDEDLAKKINSAIFPGIQGGPLMHVIAAKAVAFGEALRPEFKLYAKNVVENAKALAETLKGHGFNIVSGGTDTHLMLVDLRPKRLTGKTSEGALGRAHITTNKNGIPFDPEKPFVTSGIRLGTPACTTRGFGVAEFQQVGDFIAEVLDVLSQKGVDEDSLVEATVREKVSGLLARFPIYP

SEQ ID NO: 9199 - DNA, 1275 bp, Xanthobacter autotrophicus Py2
  CDS (1)..(1275): transl_table=11
atgacccttcacgttgccccgacccacgccgccgaccccgccgtgttcgacgccatccgcgccgagctgaagcgccagcaggaccagatcgagctgatcgcctcggagaacatcgtgtccgaggcggtgctggcggcgcagggctcggtgctcaccaacaagtatgccgagggcctgccgggcaagcgctactacggcggctgcgagcatgtggacgtggtggaggagatcgccatcgcccgcgccaaggcgctgttcggcgccggcttcgccaatgtgcagccgcactcgggcgcgcaggccaatgcggcggtgctgatggccctgctccagcccggcgacaccctgctcggcatgtcgctggcggcgggcgggcatctcacccacggcgcgccgcccacgctctccggcaagtggttcaaggccatcggctatggcgtgacgcgcgacaacgcactcatcgactatgacgaggtggagcgcctggcgcaggagcacaggcccaagctcatcatcgccggcggctcgtcctatccgcgcatcatcgatttcgcccgcttccgtgccatcgccgatgcggtgggcgcgcacctgatggtggatgcggcccactatgccgggctcatcgtggcgggggcctatccttcccccttcccccatgcccacgtggtgacgaccaccacccacaagaccctgcgcggaccgcgcggcggcctcatccttaccaatgacgaggcgctagcgaagaagctgaactcggcggtcttccccggcctccagggcggccccctgatgcatgtgatcgcggccaaggcggtggccttcggcgaggccctcaccgacgatttccgcacctatgcgctcaaggtggtctccaacgcgcgggcgctggccggccggctgtccgagcgcggggcggccatcgtctcgggaggcaccgacagccacatggtgctggtggacctgcggcccttcggcgtcaccggcaaggcggcggaagccgctctcgagcgagccggcctcacctgcaacaagaacggcatcccgttcgatccggaaaagccgttcgtgacctcgggcatccgcctcggcaccccggccggcaccacgcgcggcttcggcatcgccgagttcgaagaggtcggcgacctcatcgccgacgtgctcaccggccttgcggccaatggcgccgaagccaacggcaaggcggaggtggcgacccgcgccagggtggccgagctgtgcgcccgcttcccgctctatgcggggatgtga

SEQ ID NO: 9200 - protein, 424 aa, Xanthobacter autotrophicus Py2
MTLHVAPTHAADPAVFDAIRAELKRQQDQIELIASENIVSEAVLAAQGSVLTNKYAEGLPGKRYYGGCEHVDVVEEIAIARAKALFGAGFANVQPHSGAQANAAVLMALLQPGDTLLGMSLAAGGHLTHGAPPTLSGKWFKAIGYGVTRDNALIDYDEVERLAQEHRPKLIIAGGSSYPRIIDFARFRAIADAVGAHLMVDAAHYAGLIVAGAYPSPFPHAHVVTTTTHKTLRGPRGGLILTNDEALAKKLNSAVFPGLQGGPLMHVIAAKAVAFGEALTDDFRTYALKVVSNARALAGRLSERGAAIVSGGTDSHMVLVDLRPFGVTGKAAEAALERAGLTCNKNGIPFDPEKPFVTSGIRLGTPAGTTRGFGIAEFEEVGDLIADVLTGLAANGAEANGKAEVATRARVAELCARFPLYAGM

SEQ ID NO: 9201 - DNA, 1278 bp, Flavobacteria bacterium BBFL7
  CDS (1)..(1278): transl_table=11
atgagttacaacgataaggagatttttgacttaattcaagaagaacaatcaagacaaaaaacaggattagaattaatagcgagtgagaattatgtaagtgatgatgttcttgcggcggcaggatctatcttgactaataaatatgcagaaggttatcctggaaaaaggtattatggaggttgcgaagttgttgatgagatagaaactatcgcaattgaacgagctaaagaattatttaatgctgaatatgttaatgtccagccccactctggtagtcaggcaaacacagccgtatttcatgcttgtcttaaaccaggtgataaaattttaggatttgatttatcgcatggtggtcatttaactcatgggtcacctgtaaatttttcaggaaagctttacaaaacatcattttatggtgttgaaaaagagacaggcttattaaattatgaaaagatacaatctatagcagaacaagaaaaacctaaattgattattgccggagcttctgcttacagtagagaaattgattataaaaaatttcgtgatatcgcaaatagtgtaaatgctattttattggccgatattgcacatcctgcaggtttaattgctaaaggaattttacaagatgcagttcagttttcacatatttgtacaagtacaacccataaaactttaagaggtcctcgaggcggtattataattatggggaaggattttgaaaatccatttgggcaaaaactcaaaaatggtaatctaaagaaaatgtcatccctacttaatagtggagtattcccaggtaatcaaggtggcccattagaacatattattgccgcaaaggctgtggcatttaaagaagctttatcagaaaacttcttacactacatggtacaagtaaagaaaaatgctaaagctatggctagtgaattcattaaaagagattaccatattatttcaggcggcacagataatcatatgatgctgattgatttaagaaataaaaatattactggtaaacaagctgaagaagcattaggtaaatctcatataactgtaaataaaaacatggtgccatttgatgaccaatctccttttatcacaagtggtatcagaattggtacagctgctataactacacgaggtttagttgaaagtgatatggctgaaattgtcaaacttatagatatggttatatccaatcctgaagatgatgaaacattaaataattgcaaagatttcgtgaataactttatcacagattatccgttatttaagaattaa

SEQ ID NO: 9202 - protein, 425 aa, Flavobacteria bacterium BBFL7
MSYNDKEIFDLIQEEQSRQKTGLELIASENYVSDDVLAAAGSILTNKYAEGYPGKRYYGGCEVVDEIETIAIERAKELFNAEYVNVQPHSGSQANTAVFHACLKPGDKILGFDLSHGGHLTHGSPVNFSGKLYKTSFYGVEKETGLLNYEKIQSIAEQEKPKLIIAGASAYSREIDYKKFRDIANSVNAILLADIAHPAGLIAKGILQDAVQFSHICTSTTHKTLRGPRGGIIIMGKDFENPFGQKLKNGNLKKMSSLLNSGVFPGNQGGPLEHIIAAKAVAFKEALSENFLHYMVQVKKNAKAMASEFIKRDYHIISGGTDNHMMLIDLRNKNITGKQAEEALGKSHITVNKNMVPFDDQSPFITSGIRIGTAAITTRGLVESDMAEIVKLIDMVISNPEDDETLNNCKDFVNNFITDYPLFKN

SEQ ID NO: 9203 - DNA, 1260 bp, marine gamma proteobacterium HTCC2207
  CDS (1)..(1260): transl_table=11
atgttcgataaaaaccagactattgagaattttgatgccgaggtatggcatgccatgcagcaggaagatcagcgtcaagagcagcatattgagttgattgcctcggagaattacaccagcccagcggttatggcagctcagggtggtcagatgaccaataaatatgcagaaggttatcctggtaagcgttactacggtggttgcgagtatgtcgatatcactgaacagttggcgattgatcgcctgaaaagcctctacggcgcaaagtttgccaatgtgcagccccattcgggttctcaggctaacagcgcagtatttttggcgctgatcaaaggcggcgatactattttgggtatgagcctggccgacggtggtcaccttactcacggcgccaagccaaacttttctggcaagctttacaaccccattcaatatggcctcaacgccgagactggtctgatcgattacgatcaggttgaagcgctggcgatcgagcacaaaccggcaatgattatcgctggtttctctgcctactctggcatcatggactgggcgcgtttccgtgaaatcgccgacaaggtcggtgcctatctgatggttgatatggctcacgtctccggtttgattgctgcgggtgtttatcctaacccagtgccacacgctcacgttgtgacctcaactacgcacaaaacactgcgtggtccccgcggcggaatcattattactaatgatgaagacgtggctaaaaaatgtaactctgcggttttccctggcggacagggtggccctctgtgtcacgtgattgcggccaaggcgattgcctttaaagaagcagccagccaagaatttgtcgattatcaaaagcaggttgtggctaacgccaaagctatggcggcgagctttatcaagcgtggattcaatattgtttccaacggcactgaaaaccacctgatgctggttagcctgatcggcaaagagtacacaggtacagacgctgaccgcgctatgggcgaagcctttattacggtcaacaaaaatgcggtacccaatgacccccgttcaccgtttgtgacctctggcttacgcgtgggtacaccggctattacgactcgcggttttggtatcgaagagactgtgcagttgactgagtggatgtgcgatattctcgatagccttgagaacggtacttctgagcaggtgattgctgatgttaaagccaaggtcctggaaatctgtgcccgattccctgtctatggttag

SEQ ID NO: 9204 - protein, 419 aa, marine gamma proteobacterium HTCC2207
MFDKNQTIENFDAEVWHAMQQEDQRQEQHIELIASENYTSPAVMAAQGGQMTNKYAEGYPGKRYYGGCEYVDITEQLAIDRLKSLYGAKFANVQPHSGSQANSAVFLALIKGGDTILGMSLADGGHLTHGAKPNFSGKLYNPIQYGLNAETGLIDYDQVEALAIEHKPAMIIAGFSAYSGIMDWARFREIADKVGAYLMVDMAHVSGLIAAGVYPNPVPHAHVVTSTTHKTLRGPRGGIIITNDEDVAKKCNSAVFPGGQGGPLCHVIAAKAIAFKEAASQEFVDYQKQVVANAKAMAASFIKRGFNIVSNGTENHLMLVSLIGKEYTGTDADRAMGEAFITVNKNAVPNDPRSPFVTSGLRVGTPAITTRGFGIEETVQLTEWMCDILDSLENGTSEQVIADVKAKVLEICARFPVYG

SEQ ID NO: 9205 - DNA, 1266 bp, delta proteobacterium MLMS-1
  CDS (1)..(1266): transl_table=11
gtgtcttatctagccagcagtgatccggaagtatatcgtgccattggtggggagtttgatcgccagtaccatcaactggagatgatcgcctcggagaatattgtcagtgaagcggtgctggaagcccagggttcggtcttcaccaacaaatacgccgaaggctatcccggcaaacgttattacggcggctgcgaatacgccgatgtcattgaggagttggcgattaatcgggccctggagctgttcggggccgagtacgccaacgtccaggcccattccggcagccaggccaatatggcggtctattttgcctgtttaaaacccggcgataaagtgctggggatggatctggcccatggcggccatcttacccatggcagcagtgtcaacttctccggccagctctaccagttcgcctcctacggggtggatcggcaaagcgaacggatcgatatggccgaagtggaacggctggccctggagcatcgccccaaaatgatcgtcgccggcgccagcgcctacccccgggagatcgattttgccgccatcggtgagatcgccaggaagatcggggcctattacatggtggatatggcccatatcgccgggctggtggccgccggggtgcatccctcgccggtgccccatgccgattttgttaccaccaccacccataagaccctgcgcggtccccggggcggcctgattctggccaggggggattacggcaagatgctcaacagcaagatcttccccggcatccagggcggccccctggtccatgtgatcgccgccaaagcggtgaccttccgcgaggccatggaagattccttcaaggaatacatgcgccaggtggttaagaacacccgggccctgggtgaagccctggtagcccgcggttttcggctggtctccggcggcagtgacaatcacctgctgctggtggatctgacccccaaacagatcaccggcaaggaggccgatggtctgctggagcaggccgggatcacggttaacaagaacgccatcccctttgataccgccaagcgctttgtcaccagcggcatccgggtcgggactccggcggtgaccacccgcgggctcaaggagccggagatggaacagatcgccgcctggatggatcgggccctggccaccgccgagggggccggccgggaggccgcactggccgccatccgggaagaggtccgcgccctttgcgaccgtttcccgatctatcccgggatgcagaacgggatggtatga

SEQ ID NO: 9206 - protein, 421 aa, delta proteobacterium MLMS-1
MSYLASSDPEVYRAIGGEFDRQYHQLEMIASENIVSEAVLEAQGSVFTNKYAEGYPGKRYYGGCEYADVIEELAINRALELFGAEYANVQAHSGSQANMAVYFACLKPGDKVLGMDLAHGGHLTHGSSVNFSGQLYQFASYGVDRQSERIDMAEVERLALEHRPKMIVAGASAYPREIDFAAIGEIARKIGAYYMVDMAHIAGLVAAGVHPSPVPHADFVTTTTHKTLRGPRGGLILARGDYGKMLNSKIFPGIQGGPLVHVIAAKAVTFREAMEDSFKEYMRQVVKNTRALGEALVARGFRLVSGGSDNHLLLVDLTPKQITGKEADGLLEQAGITVNKNAIPFDTAKRFVTSGIRVGTPAVTTRGLKEPEMEQIAAWMDRALATAEGAGREAALAAIREEVRALCDRFPIYPGMQNGMV

SEQ ID NO: 9207 - DNA, 1296 bp, Rickettsiella grylli
  CDS (1)..(1296): transl_table=11
atgtcgtattcattacaagacacaattaataattttgatcctgatttatggtcatcaatgaataaagaaatgcaacgtcaagaagatcatttggaattaattgcttcggaaaactatgcaagcccccgtgtgctacaagcacaagggtcaggtttaaccaataagtatgcagaaggttatccgggtaaacgttactatggcgggtgtgaatatgttgatgaggtagaacaattagcagtagagagggccaagaaattatttaaagcggattatgcgaacgtacaaccccattcgggttcgcaagcgaatgcggcggcttatatggctttattaaaacccggtgagtcgttgctagggatgagtttagcgcatggtggacatttaacgcatggcgcaaaagtgagtttttcaggaaaaatatatcaatcgtatgcgtatggtgtcacgtccgatacacaacgtattcattacgaagaagtcgaagcgcttgcaaaaaaatacaaaccggcgttaattattgcagggttttcagcgtattcacgtgaagtggattggcaacgattcagagatatcgccgatgaagtcggggcctattttttggttgatatcgcgcatgttgccgggttagttgctgcgggtctttattcttcaccgatttccattgcggatgtggtgaccagtacgacccataaaacattacgtggacctcgtggaggcctcattttagcgcgttctaatcctgagattgaaaaaaaattaaacgcagcagtatttccaggtcaacaaggagggcctttgatgcatgtgattgctgcaaaggcggttgcgttcaaggaagcattagagccccactttaaagcgtatcagaggcaagttattttgaatgcgaaggcgatggttcaggtgatgcaagaaagaggctataacattgtttcgggtggaacggataaccatctttttttaatcgatctgattgacaagaaaatgacagggaaggaagcagaagccttattagaaaaagcctctatcaccttaaataaaaatatgttgcccaatgatccctgtaaaccgtttataacgagtggcttgcgcgtgggaacacccgctgtgaccacccgtggttttaaagaaagtcaggttcgcgaggttgcccattggatgtgcgatctgctggataatcgaaacgattcggctcgtctagaaatgattaaaaaacaagtcgtagcgctgtgccatcaatttccagtatactccgccgagagacgagacgataacccgatggattctattgaataa

SEQ ID NO: 9208 - protein, 431 aa, Rickettsiella grylli
MSYSLQDTINNFDPDLWSSMNKEMQRQEDHLELIASENYASPRVLQAQGSGLTNKYAEGYPGKRYYGGCEYVDEVEQLAVERAKKLFKADYANVQPHSGSQANAAAYMALLKPGESLLGMSLAHGGHLTHGAKVSFSGKIYQSYAYGVTSDTQRIHYEEVEALAKKYKPALIIAGFSAYSREVDWQRFRDIADEVGAYFLVDIAHVAGLVAAGLYSSPISIADVVTSTTHKTLRGPRGGLILARSNPEIEKKLNAAVFPGQQGGPLMHVIAAKAVAFKEALEPHFKAYQRQVILNAKAMVQVMQERGYNIVSGGTDNHLFLIDLIDKKMTGKEAEALLEKASITLNKNMLPNDPCKPFITSGLRVGTPAVTTRGFKESQVREVAHWMCDLLDNRNDSARLEMIKKQVVALCHQFPVYSAERRDDNPMDSIE

SEQ ID NO: 9209 - DNA, 1263 bp, Oceanobacter sp. RED65
  CDS (1)..(1263): transl_table=11
atgtttaaacgagacatgaatattgctgattttgacccagctgtttgggaagcgatgcaggctgaagtaaagcgtcaggaagatcacattgagttgatcgcatctgaaaactataccagcccacgcgtcatggaagcccaaggcagccagcttaccaacaagtacgctgaaggctatccaggcaagcgttattacggcggttgtgagcatgttgacgtcgttgagcagctagcaattgatcgcgctaaagagttgtttggcgcaggctacgctaatgttcagcctcactctggttcgcaggcaaacgccgctgttttcatggcactttgtaagccgggcgacaaagtactaggtatgagtttggctcatggtggtcacttaacccatggtgcgtcggtatccttctctggccgcatttatgatgccgttcagtacggtttacacccagaaacgggtgatattgactatgaagaagtggagcgtcttgcgctagagcacaaacctaaaatgatcattggtggcttctctgcgtttagtcgtattgttgattggcagcgtttccgtgatatcgccgataaagtaggtgcttacttatttgtcgatatggctcatattgcaggtcttgttgcggcaggcgtttatccctctcctgtgggtatcgctgatgttgtgacgactacaacgcacaaaacgttgcgcggtcctcgtggcggtttgattcttgccaaagaagatgaagagttaaacaaaaaacttaattttgctgtcttcccagaatcgcaaggtggtcctttgatgcacgtgatcgccgcgaaagcagtgtgcttcaaagaagctatgtcagaagaatacaagacgtaccaagcgcaagtggttaagaatgctcaggcaatggccgaagtattcattgagcgtggtattaatatcgtttctggtggtaccgatgatcaccttttcctagttgatctgattggcaaggagtacacaggtaaagacgcagatgccgcattaggcgaagctcatattacagtgaacaaaaatgccgtaccgaatgacccacgttctccgtttgttacgtcaggtttgcgtattggtacgccggcaattacctctcgtggcttcaaagaagagcaagctcgtgatttaacatcctggatttgtgatgtgcttgatagtcttgagaatggcaataaagatgaagtagcagctcaggttcgtgctaaagttcaggctttgtgtgcagaatttcctgtatacagctaa

SEQ ID NO: 9210 - protein, 420 aa, Oceanobacter sp. RED65
MFKRDMNIADFDPAVWEAMQAEVKRQEDHIELIASENYTSPRVMEAQGSQLTNKYAEGYPGKRYYGGCEHVDVVEQLAIDRAKELFGAGYANVQPHSGSQANAAVFMALCKPGDKVLGMSLAHGGHLTHGASVSFSGRIYDAVQYGLHPETGDIDYEEVERLALEHKPKMIIGGFSAFSRIVDWQRFRDIADKVGAYLFVDMAHIAGLVAAGVYPSPVGIADVVTTTTHKTLRGPRGGLILAKEDEELNKKLNFAVFPESQGGPLMHVIAAKAVCFKEAMSEEYKTYQAQVVKNAQAMAEVFIERGINIVSGGTDDHLFLVDLIGKEYTGKDADAALGEAHITVNKNAVPNDPRSPFVTSGLRIGTPAITSRGFKEEQARDLTSWICDVLDSLENGNKDEVAAQVRAKVQALCAEFPVYS

SEQ ID NO: 9211 - DNA, 1254 bp, Desulfitobacterium hafniense DCB-2
  CDS (1)..(1254): transl_table=11
atggattatattaaggaatggattctccctcaggatcccgaagtggcggaggctattgcccaggaggaacaaaggcagcgctataaaatcgagctgattgcctcagagaattttgtgagccgagcggtcatggccgcccagggttccgttcttaccaataagtatgcggaaggatatccgggaaaacgctattatggcggctgtgagtatgtggatatcgttgaggatctggcccgggagcgggtgaaaaagctttttggtgcggaacatgccaatgtccagcctcattccggcgcccaggctaataccgctgtatattttgccatgcttaaacccggggatacggttctcggcatgaatctttcccatgggggtcatttaacccacggcagcccggtgaatatctccgggatgtattataactttgtcgcctatggggtggatcaagtcaccgaacgcattgattatgatgtggtgcgccaattagcccttgagcatcgccctaagctgattgtagcgggagccagtgcctatcccagacaaatcgactttgcccgcttaagagaaattgccgatgaggcagactcttacttcatggtggatatggcccatattgcgggcctggtggcagccgggcttcatcaaaaccctgttccctacgcacattttgtaaccaccaccactcataaaaccctgcggggcccccgggggggactgattctatgccaagaagaatttgccaaagctatcgataaagccatcttccccggcattcagggcggcccgctgatgcatgtgatcgcggctaaggctgttgccttcggcgaggctttaaagccggaattcgtggaatatcaaaaacgcattgtggagaatgctaaagtattatcggaaactctggcggaaaaaggcttccgcatcgtttccggaggtacggacaaccatttgatgcttgtggatgtacggtctaaaggcttgacagggaaagaagcagagtatattttagatgaggtcggtattacggtgaataagaacaccatcccctatgatccggccagccctatggtaaccagcggcatccgcatcggcacccctgccgtgaccagccgcggtatggataccctggcgatgaaaaagattgccgcagccatcgacattgctttatcagaacccaatgaagcgggggctgccaaagcccgggatatggttgcagcactctgcgcggaatacccgctctacccaaatctagattag

SEQ ID NO: 9212 - protein, 417 aa, Desulfitobacterium hafniense DCB-2
MDYIKEWILPQDPEVAEAIAQEEQRQRYKIELIASENFVSRAVMAAQGSVLTNKYAEGYPGKRYYGGCEYVDIVEDLARERVKKLFGAEHANVQPHSGAQANTAVYFAMLKPGDTVLGMNLSHGGHLTHGSPVNISGMYYNFVAYGVDQVTERIDYDVVRQLALEHRPKLIVAGASAYPRQIDFARLREIADEADSYFMVDMAHIAGLVAAGLHQNPVPYAHFVTTTTHKTLRGPRGGLILCQEEFAKAIDKAIFPGIQGGPLMHVIAAKAVAFGEALKPEFVEYQKRIVENAKVLSETLAEKGFRIVSGGTDNHLMLVDVRSKGLTGKEAEYILDEVGITVNKNTIPYDPASPMVTSGIRIGTPAVTSRGMDTLAMKKIAAAIDIALSEPNEAGAAKARDMVAALCAEYPLYPNLD

SEQ ID NO: 9213 - DNA, 1296 bp, Vibrio sp. Ex25
  CDS (1)..(1296): transl_table=11
atgaataagagttaccctaaccacagcttggaaaactttttctctaccaacctctctgcgacagatgatgctgtctttgctggaattcaggcggaatccgctcgccaaaacgaacaaatcgaacttatcgcttctgagaacattgtttctaaagcggtaatgcaagctcaaggcacatgcctaacaaacaaatacgctgaaggttatccaggtcgtcgttactacggtggttgtgagcacgtagatacagtggaagccattgccatcgaacgcgcgaaaaaactttttaattgcgaatacgcaaacgttcaacctcactcaggcgctcaagcaaatggtgcggtgaaactggctcttcttcaaccaggcgacaccattcttggcatgtctttggacgctggtggccacctaacgcacggtgcacgcccagcactttctggtaaatggtttaacgcagttcaatacggcgttgatcgcgaaacactggaaatcaactacgacgacgttcgtgcacttgcagtagaacacaaaccaaagatgatcatcgcgggcggcagtgctattccacgcgttatcgattttgctaagttccgtgaaatcgctgacgaagttggcgcaattcttatggtcgatatggcacacattgctggccttatcgcaacaggtgcacaccctagcccattgccacatgcgcatgttgtgacaaccacaacacacaaaacattgcgtggccctcgcggcggtatgatcctgactaaccacgaagacatcattaagaaaatcaactccgccgtattccctggcctacaaggcggcccactaatgcacgttatcgcagcaaaagcggttgcatttggagaggcgcttggccctgaatttaaaacttatattgattcggtgatcaataacgcaaaagtcctagcggaagtattgcaaactcgcggttgcgacatcgtaactggtggcacagacacgcacctaatgctggttgaccttcgccctaaaggcttgaaaggcaacaaagcagaagaagctctagaacgtgctgggatcacatgtaacaaaaatggcatcccattcgatacagagaagcctatgattacatcgggcatccgtttaggaacgcctgcgggtacaagccgcggctttggcgctgaagaattcaaactcatcggtaattggattggtgacgtactggatggtttggtgaacaacccagaaggtgacgcagacgttgaaaaacgcgtccgcaaagaagtaaaagaactttgcagtcgcttccctctttaccaataa

SEQ ID NO: 9214 - protein, 431 aa, Vibrio sp. Ex25
MNKSYPNHSLENFFSTNLSATDDAVFAGIQAESARQNEQIELIASENIVSKAVMQAQGTCLTNKYAEGYPGRRYYGGCEHVDTVEAIAIERAKKLFNCEYANVQPHSGAQANGAVKLALLQPGDTILGMSLDAGGHLTHGARPALSGKWFNAVQYGVDRETLEINYDDVRALAVEHKPKMIIAGGSAIPRVIDFAKFREIADEVGAILMVDMAHIAGLIATGAHPSPLPHAHVVTTTTHKTLRGPRGGMILTNHEDIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGIRLGTPAGTSRGFGAEEFKLIGNWIGDVLDGLVNNPEGDADVEKRVRKEVKELCSRFPLYQ

SEQ ID NO: 9215 - DNA, 1257 bp, Alteromonadales bacterium TW-7
  CDS (1)..(1257): transl_table=11
atgttagaacgtagcatgaatatttcggactttgatccagagttatttgacgcgatgagtaaagaaacatcacgtcaagaagagcacattgagttaattgcatctgaaaactactgtagcccacgcgtacttgaagcacagggttctcaacttactaacaaatatgcggaaggttatcctggcaagcgttactacggtggctgtgagcacgtagacgtggttgagcaattagctattgaccgcgcaaacgaattgtttggtactgactacgcaaacgttcagccgcatgcaggttcgcaagccaatgccgctgttttccaagccttattaagcccgcttgatacagtacttggcatgagcctagcacacggtggccatttaactcatggttcacacgtaaacttttcaggtaaaacatataacgcgattcagtatggcctaaacgaagagactggcgaaattgattacgcacaagttgaagcgttagcactagagcacaagccaaaaatgattatcgcaggtttttctgcttattcaggtattgttgattgggctaagtttcgcgaaattgcagataaagtagatgcttacttgtttgttgatatggcgcatgttgcaggtttaattgctgcgggtgtttacccaagcccagtaccatttgcacatgttgttactacaacaacgcataaaacattagcgggccctcgtggcggtttaataatttctgcatgtggtgacgaagcaatttacaaaaagcttaacagtgctgtattccctggtggccaaggtggtcctttatgtcacgttattgctgcaaaagcagtggcattcaaagaagctttacaaccagagtttaaagaataccaaacacaagttgttaaaaatgcgcaagcaatggttagcgtattacaagagcgtggctacaaagttgtttctggtaaaacagacaatcacttgttcttacttgatttaatcgataaagacattacgggtaaagatgctgatgcagcactaggtaatgcgaacattacggttaacaaaaactcagttcctaatgatccgcgttctccgtttgtaacgtctggcttacgcattggttctcctgcaatcacgcgccgtggtttcaaagaggctgaatctaaagagcttgctggctggatttgtgatgtactagacaacattgctgatgagtctgttcaagcgcaagtaaaagaaaaagtgaaagcaatttgtgcaaaactacctgtttacgcttaa

SEQ ID NO: 9216 - protein, 418 aa, Alteromonadales bacterium TW-7
MLERSMNISDFDPELFDAMSKETSRQEEHIELIASENYCSPRVLEAQGSQLTNKYAEGYPGKRYYGGCEHVDVVEQLAIDRANELFGTDYANVQPHAGSQANAAVFQALLSPLDTVLGMSLAHGGHLTHGSHVNFSGKTYNAIQYGLNEETGEIDYAQVEALALEHKPKMIIAGFSAYSGIVDWAKFREIADKVDAYLFVDMAHVAGLIAAGVYPSPVPFAHVVTTTTHKTLAGPRGGLIISACGDEAIYKKLNSAVFPGGQGGPLCHVIAAKAVAFKEALQPEFKEYQTQVVKNAQAMVSVLQERGYKVVSGKTDNHLFLLDLIDKDITGKDADAALGNANITVNKNSVPNDPRSPFVTSGLRIGSPAITRRGFKEAESKELAGWICDVLDNIADESVQAQVKEKVKAICAKLPVYA

SEQ ID NO: 9217 - DNA, 1263 bp, marine gamma proteobacterium HTCC2143
  CDS (1)..(1263): transl_table=11
atgtttactaaagatatgcaaattgaagattttgataacgaaattttttcagctatccagcaggaaaatcagcgccaagaacagcatattgaactaatcgcgtcagaaaactatgccagtccgcgggtgatggaagctcagggtagctccatgactaataaatacgcagagggctatcctggcaagcgttactacggcggttgcgagtttgttgataaagccgaagtgttagctatcgagcgcgcaaagaccttgtttggagcagattatgccaacgtgcaaccgcattccggttctcaggctaactcggcagtctatctggctttgctggaggcgggtgatacggttttgggtatgagtctcgatgcgggtggccatttaacccacggagccaagcctaatttttccggtaaggtatacaatgctgtccaatatgggctgaacgctgagacgggcattattgactatgagcaagttgaagcattggcgctggagcacaagccaaaaatgattgtagccggcttttccgcttattcgggtattgtcgattgggctaagtttcgcgagatagctgataaagttggtgcttacttgttggtggatatggctcatattgccgggctcgttgccgcgggtttataccctaatccagtgccttttgccgacgtcgttacatcgaccacccataaaacactgcgtggccctcgtggcggtatcattttagctaagcacaatgaagcgttggaaaagaaatttaactcagcggtatttccgggaggccagggcgggccgctgatgcatgtgattgctgctaaagcggtaagttttaaagaggcggccaccgcagagttcaaagagtatcagcagcaggttattactaatgccaaagtgatggctgagacctttatcgcgcgcggtataaaaattgtctcaggtggcacctataaccacttgatgttggttgatctgatcggtaaagaatataccggcaaagatgccgatgccgcactgggtgatgcatttattaccgtcaataaaaatgccgtgcccaacgatcctcgctcaccttttgtcacctctggcctgcgcgttggcacgcccgctattactacccggggctttaaagaagatgaaactcgcgagttgacccactggatgtgtgatgtgctggaatcattggaaagcgggaatagtgaaacggttattcctcaggtaaaagccaaggtgcttgatatttgcagtcgtttccccgtgtataaatag

SEQ ID NO: 9218 - protein, 420 aa, marine gamma proteobacterium HTCC2143
MFTKDMQIEDFDNEIFSAIQQENQRQEQHIELIASENYASPRVMEAQGSSMTNKYAEGYPGKRYYGGCEFVDKAEVLAIERAKTLFGADYANVQPHSGSQANSAVYLALLEAGDTVLGMSLDAGGHLTHGAKPNFSGKVYNAVQYGLNAETGIIDYEQVEALALEHKPKMIVAGFSAYSGIVDWAKFREIADKVGAYLLVDMAHIAGLVAAGLYPNPVPFADVVTSTTHKTLRGPRGGIILAKHNEALEKKFNSAVFPGGQGGPLMHVIAAKAVSFKEAATAEFKEYQQQVITNAKVMAETFIARGIKIVSGGTYNHLMLVDLIGKEYTGKDADAALGDAFITVNKNAVPNDPRSPFVTSGLRVGTPAITTRGFKEDETRELTHWMCDVLESLESGNSETVIPQVKAKVLDICSRFPVYK

SEQ ID NO: 9219 - DNA, 1260 bp, Candidatus Desulfococcus oleovorans Hxd3
  CDS (1)..(1260): transl_table=11
atgatcattgactatctggcacagcaggaccccgaggtggccggggccgttgcccgtgaagtggagcggcagcagcacaacctggaactgatcgcatcggaaaacatcgccagccgggccgtaatggcggcccagggaagcgtgctgaccaacaaatatgccgaggggtacccgggcaaacgctattacggcggatgtgaatacgtggaccaggccgagcagatcgccattgaccgggccaaaaccctgttcggcgccgcctacgccaatgtccagccccactccggttcccaggccaacatggcggtctattttgccctgctgtcgcccggcgacacgggactgggcatggacctggcccatggcggccacctgacccacggcagcccggtgagtttttccggccggctgtttgactttaaacactatggcgtaaaaaaagagaccggcaccatcgactatgatcaggtggccgacctggcgaaaacccaccggccgaaaatgatcatcgccggcgccagcgcctatccccgaaccctggattttgaaaagttcgcgcagatcgccgcgtcagtggaggcctgcctggtggtggacatggcccatatcgccggcctggtggcggccggggttcatccgtcgccggttccccacgcggacgtggtcacctccaccacgcacaagacgctgcgcggcccccggggcggcctgattctttcagccagggccgatttcggaaaggccttgaacaaggagatttttcccggcattcagggcgggcccctgatgcacgtgatcgcggcaaaggccgtggcctttggcgaggcccttaccgacggttttgtggcctaccagcagcaggtggtaaaaaacgcccgcgcactggccgcgcacctgatggaacagggcattgagctggtatccggcggcaccgacaatcacatgatgctggccgacctgcgcaacatcagcgtcaccggcaaagccgccgagaccgccctggaacgggccggcctgaccctgaacaaaaacgccgtgccctttgacacggaaaaccccaccgtgaccagcggggtccgcatcggcaccccggtgatgaccacccggggcatgaaggagccggaaatggcggtggtggccgggctgatcgtgaacgtgctgaagaacatttccaacgataccgtgattcaggccacccggaagcgggtcatggagctgtgcgaggcctttccgatttaccgtgacaacgacaatggataa

SEQ ID NO: 9220 - protein, 419 aa, Candidatus Desulfococcus oleovorans Hxd3
MIIDYLAQQDPEVAGAVAREVERQQHNLELIASENIASRAVMAAQGSVLTNKYAEGYPGKRYYGGCEYVDQAEQIAIDRAKTLFGAAYANVQPHSGSQANMAVYFALLSPGDTGLGMDLAHGGHLTHGSPVSFSGRLFDFKHYGVKKETGTIDYDQVADLAKTHRPKMIIAGASAYPRTLDFEKFAQIAASVEACLVVDMAHIAGLVAAGVHPSPVPHADVVTSTTHKTLRGPRGGLILSARADFGKALNKEIFPGIQGGPLMHVIAAKAVAFGEALTDGFVAYQQQVVKNARALAAHLMEQGIELVSGGTDNHMMLADLRNISVTGKAAETALERAGLTLNKNAVPFDTENPTVTSGVRIGTPVMTTRGMKEPEMAVVAGLIVNVLKNISNDTVIQATRKRVMELCEAFPIYRDNDNG

SEQ ID NO: 9221 - DNA, 1254 bp, Pseudomonas putida GB-1
  CDS (1)..(1254): transl_table=11
atgttccataaaagcctgaccctgtctgacttcgaccctgcgctgtccgaggccattcgccgagaagtgcaacgccaggaagaccacatcgagctgatcgcctcggaaaactacaccagcccgcaggtgatgcaggcccaaggtaccgaactgaccaacaagtacgccgaaggctacccaggcaagcgctattacggtggctgcgagcatgtcgacgtggtcgagcaactggccatcgagcgtgccaggcaactgttcggcgcgggttacgccaacgtccagccgcactcaggctcgcaggccaacgccgcggtctacctggccttgctgcaggccggggataccctgctgggcatgagcctggcgcacggcggccacttgacccacggcgccaaggtgtcggcttcgggcaagctgtacaacgctgtgcaatacggcatcgatgccaacggcttgatcgactacgacgaggttgagcgcctggccgtcgagcaccagccgaagatgatcgtggcaggcttctcggcctattcgaaaaccctcgacttcccgcgtttccggcagatcgccgacaaggtcggggcctacctgttcgttgacatggcccacgtcgccggcttggtggcggcaggcctgtaccccaatccgctgccttatgccgatgtggtcaccaccaccacccacaagaccctgcgcgggccacggggtggtttgattctggccaaggcggacccggagcttgagaaaaagctcaattcggcggtgttcccaggcgggcagggtgggccgctgatgcatgtgatcgcagccaaggcggtgtgcttcaaggaggccctggaacctggtttcaaggactaccagcgccaggtcgtcaacaacgcacaggccatggcgcaagtcttcatgcagcggggcttcgacgtggtttccgggggcaccgacaaccacctgttcctgcttagcctgatccgccagggcatcaccggcaaggacgccgacgccgcgctgggccgggcgcacatcacggtgaacaagaacgccgtgcctaatgacccacagtcgccgttcgtgacgtcgggcctgcgcattggcaccccggcggtaacgacccgtggtttcaaggaagcggaatgccgggccctggcgacctggatctgcgacatcctcgaccaccttggtgatgccgatgtcgaggcccatgtggcggggcaggtgggcgaactgtgcaagttgttcccggtttatccggcctga

SEQ ID NO: 9222 - protein, 417 aa, Pseudomonas putida GB-1
MFHKSLTLSDFDPALSEAIRREVQRQEDHIELIASENYTSPQVMQAQGTELTNKYAEGYPGKRYYGGCEHVDVVEQLAIERARQLFGAGYANVQPHSGSQANAAVYLALLQAGDTLLGMSLAHGGHLTHGAKVSASGKLYNAVQYGIDANGLIDYDEVERLAVEHQPKMIVAGFSAYSKTLDFPRFRQIADKVGAYLFVDMAHVAGLVAAGLYPNPLPYADVVTTTTHKTLRGPRGGLILAKADPELEKKLNSAVFPGGQGGPLMHVIAAKAVCFKEALEPGFKDYQRQVVNNAQAMAQVFMQRGFDVVSGGTDNHLFLLSLIRQGITGKDADAALGRAHITVNKNAVPNDPQSPFVTSGLRIGTPAVTTRGFKEAECRALATWICDILDHLGDADVEAHVAGQVGELCKLFPVYPA

SEQ ID NO: 9223 - DNA, 1629 bp, Ostreococcus tauri
  CDS (1)..(1629)
atgatttcgacggtgtctctcgcgcccgcgcgcgcgcgcgcgaccgctcggagggatgggcgcgcgacggtgtccgcgcggtcgtccgggtcgatgaaagtcgcgaatccgcgctcgagagcggtcgtcgggagggccaagccgcagccgttcgaggacgtctcggtgcgagagctcgacggcgagctgcacgagatcctgctcaaggagaagcgacgacagaggctcgggttggagctgatcgcgagtgaaaacttcacgagcaaggcggtgatggaggtgaacgggtcgtgcctgacgaataagtattcggagggtttgccgggacagcggtactacggcgggaacgagttcatcgacgaggtggagcgattgtgtcaaaaccgtgcgctgagcacctaccgcctcgatccggcggaatggggggtgaacgtacaagtgctctctggttccccggccaactttgcggtgtacaccgcgcttcttcagccgcacgagcgtatcatgggtctcgacttgccgcacggcggtcacctcacgcacggcttctatacgccgaagaagaagatctccgcgacgtccgtgtacttcgagtcgatgccgtatcgcttgaacgaggccacgggtttggtggattacgacaagctcgaggagaacgcgatgcttttccgaccgaagttgatcatcgctggcgcctcggcgtacgctcgtaactttgattacaagcgcatgcgcgagatttgcgacaaggttggcgcatacctgatgtccgacatggcccatatctccggtctcgtcgccgctcagctcgcggacgatcctttcaagtactctgacattgtcaccacgacgacgcacaagtctcttagaggtccgcgcggcggcatggtcttctacaggaaggaacacgagcaagccgtcaactctgccgtctttccgggtctccaaggcggcccgcacaaccacaccatcggtgccctggctgtggcgctcaagcaagcgcaaactcccgggtttgtcaagtaccaagagcaagtcatcaagaactgcgccgcaatggcaaagcgcttgatggaactcggatacacgctcgtctctggcggtaccgacaaccacttggtgctgtgtgatttgcgtccgaagggcgtggacggtgcgcgcgttgagaagatcctcgacctgtgccacatcacgttgaataagaactccgttcctggcgacacctctgcgctcgtcccgggcggcatccgcatcggatctccggcgatgacgacgcgcggcatgacggaggcggatttcattcgcgtcgccgacctcatcgataagggcgtcaatatcgctatcgatatcaagggtaagaccgaaggcggtaagttgaaggatttcaaggcgtatttagaagccaacgacgtgccggccatcgccgagttgagggctgaggttgaggctttcgccgatgagttccacatgcccggcgggatttcgaaaataatgtatgtgtcgaaaaaacctgaattaattaacatgcgcgttttctcgcgccgtcgctcgtcactccgcgtcgcgcgcgcgcccgggcggcgcggagggacatcatctatccgtttctcgcgagatccgaccgtttaa

SEQ ID NO: 9224 - protein, 542 aa, Ostreococcus tauri
MISTVSLAPARARATARRDGRATVSARSSGSMKVANPRSRAVVGRAKPQPFEDVSVRELDGELHEILLKEKRRQRLGLELIASENFTSKAVMEVNGSCLTNKYSEGLPGQRYYGGNEFIDEVERLCQNRALSTYRLDPAEWGVNVQVLSGSPANFAVYTALLQPHERIMGLDLPHGGHLTHGFYTPKKKISATSVYFESMPYRLNEATGLVDYDKLEENAMLFRPKLIIAGASAYARNFDYKRMREICDKVGAYLMSDMAHISGLVAAQLADDPFKYSDIVTTTTHKSLRGPRGGMVFYRKEHEQAVNSAVFPGLQGGPHNHTIGALAVALKQAQTPGFVKYQEQVIKNCAAMAKRLMELGYTLVSGGTDNHLVLCDLRPKGVDGARVEKILDLCHITLNKNSVPGDTSALVPGGIRIGSPAMTTRGMTEADFIRVADLIDKGVNIAIDIKGKTEGGKLKDFKAYLEANDVPAIAELRAEVEAFADEFHMPGGISKIMYVSKKPELINMRVFSRRRSSLRVARAPGRRGGTSSIRFSRDPTV

SEQ ID NO: 9225 - DNA, 1632 bp, Ostreococcus tauri
  CDS (1)..(1632)
atgcacaccgcgctgacgatcgcgcgacgatgcgcgcgacgcgcggtgacgtccggacggcatctcggccggccgtacgcggcggtgccgcagggcgcgagcggggtgaactcgaacgcggatgcgtacgcggcgattcgcgccgtgaacgcgaacgtgacggtgcggagtcgccggggactgacgatcgtgccgcgacgctcgccgcgctcgcagtggccggagatgattaataagccgctggaggagatcgatccggagatgtgcgagatcatcgagcacgaaaaggctcgacagtggaagggcctcgagctcattccgagcgaaaactttgtctctcgctcggtgatggacgccgtgggttccatcatgaccaacaagtactccgagggttacccgggggcgagatactacggtggtaatgaattcatcgatatggcggaaacgttgtgccaagagcgcgcgctcaaggctttcggtttggacccggcgaagtggggcgtgaacgtgcagtcgttgtccggttccccggccaacttccaggtgtacacggcgctcttgcagccgcacgataagatcatggcgctcgacttgccgcatggcggtcacttgtcccacggctaccaaacggacacgaagaagatcagcgccacgtccatcttcttcacgtcggtgccgtaccgcctcaacgaggaaaccggtttcattgattacgaaatgtgcgaaaagacggcgacgctcgtccgtccgaagttaatcgtcgctggtgcctctgcgtacgcgcaactttacgactacaagaagatgcgtgacatctgcgacaagacgaactccatcttgctcgccgacatggcgcacatctccggcttggtcgccgcgggcgtcgttccgtctccgttcgagtacgccgacgtcgtgaccacgactacgcacaagtccctccgaggtccgcgcggtgccatgatcttctaccgcaagggtgagaagggcaaggacaagaagggtaacgcgatcatgtacgactacgaggacaagatcaactttgccgtcttcccgggtctccaaggcggtccacacaaccacaccatcaccggtctcgcggttgccctcaagcaagcggcgagcccggagttcaaggcttaccaactgcaggtgttgagcaacatgcaagcctgcgcgaagcgcctccaagagcacggcgtcaagctcgtctctggcggcaccgtcaaccacttggctttgcttgacttgcgcccaatgggtgtcgacggctcccgtgttgaacgtgttttagagctcgcgcacatcgcgtgcaacaagaacacggttccgggtgacgtctctgccatggttccgggcggcttgcgcattggtaccccagcgttgacttcccgaggcttcttggagaaggatttcgaaaccgtcgccgacttgatcgtccgaggcatccacatcaccaaaactatcaacgactccgccaagggcaccaagctcaaggatttccgcgaggctttggcctccaaggagtggccggagctcacgcaacttaccaaggacgtcgagaacctcgccacgcgcttcccgaccattggtttcgagaaggcggagggcaagtacacgcaaggcttgtaa

SEQ ID NO: 9226 - protein, 543 aa, Ostreococcus tauri
MHTALTIARRCARRAVTSGRHLGRPYAAVPQGASGVNSNADAYAAIRAVNANVTVRSRRGLTIVPRRSPRSQWPEMINKPLEEIDPEMCEIIEHEKARQWKGLELIPSENFVSRSVMDAVGSIMTNKYSEGYPGARYYGGNEFIDMAETLCQERALKAFGLDPAKWGVNVQSLSGSPANFQVYTALLQPHDKIMALDLPHGGHLSHGYQTDTKKISATSIFFTSVPYRLNEETGFIDYEMCEKTATLVRPKLIVAGASAYAQLYDYKKMRDICDKTNSILLADMAHISGLVAAGVVPSPFEYADVVTTTTHKSLRGPRGAMIFYRKGEKGKDKKGNAIMYDYEDKINFAVFPGLQGGPHNHTITGLAVALKQAASPEFKAYQLQVLSNMQACAKRLQEHGVKLVSGGTVNHLALLDLRPMGVDGSRVERVLELAHIACNKNTVPGDVSAMVPGGLRIGTPALTSRGFLEKDFETVADLIVRGIHITKTINDSAKGTKLKDFREALASKEWPELTQLTKDVENLATRFPTIGFEKAEGKYTQGL

SEQ ID NO: 9227 - DNA, 1479 bp, Ostreococcus tauri
  CDS (1)..(1479)
atgtcgtttccttcctcgcgatcgcgcgcgcggcacttcgcccacacgtcgtctctcgcgtctcaaaacacgcgggcgcgaaagatggaccgcgtcttccccgaggctttgtctccgctcaaggaggccgacagagaggtgtacgacttgattcaaaatgaaaagaagcgacagatcggcggcatcgagctcatcgcgagcgaaaactttaccagcgcgcccgtgatggaggcgctcggctcggcgctcacgaacaagtactcggaggggcttcccggtgcgcggtactacggtgggaacgagatcatcgataaggtggagacgttgtgccaagagagagcgttgcacgcgtatcgcctggacgcgaaggactggggcgtgaacgtgcagccgtacagcggatcgcccgcgaatctggcggtgtacaccgcgcttttacaaccgcacgaccgtatcatgggtttggatctgccgagtggaggacacctgacgcacggatattacacggcgcacgggaagaagatttcggcgacgagcatcttcttcgagtcgttgccgtacaaggtggatccgaagactggtttgatcgattacgaaaagctcgaggagaaggcgatggatttccgaccgaagatgatcatctgcggcgggtcggcgtacgcgagagattgggattacgcgcgattcagggaaatcgcggataagtgcggggcgatgctcatgatggacatggcgcacatctctggtttggtcgctgcggaggaacaggcgcaaccgttcgagtactgcgatatcgtcaccacaactacgcacaagtcccttcgcggtcctcggtcggggatgatcttcttccgtcgaggcgtgaatgcgaaaactggtaaggactacgactacgagtcgcgcataaacatggcggtgttcccgtcgctccagggcggtcctcacaaccaccaaatcggcgctctgtgcgtcgccctcaagtacgcggcgacgccggcattcaaggagtacatcaagcaagtcaaggctaacgccaaggctcttggtgaacgcctcgtcgagaagggatactccctcgtcaccggcggcacggataaccacttggtgctctgggatctgcgcccgctcggcctcaccgggagcaagatggagtacctgtgcgatctcctgcacatcaccctgaacaagaacgcagtgtttggcgacgcgagcgcgctgtccccgggcggtgtacgcattggcgctcccgcgatgacgtctcgcggcttggtggaaaaggatttcgtccaaatcgctgacttcctctcccgcgccgttgatttgtgcttggaggtgcaacagagccacgggaagatgttgaaggactggaaaaagggcttagacggcaatcccaaggtcgcgtcgatgcgcgccgaggttgaggcattctcgtcggcgttcgacatgcccgccttcacgaaggaaagcatcgacatttag

SEQ ID NO: 9228 - protein, 492 aa, Ostreococcus tauri
MSFPSSRSRARHFAHTSSLASQNTRARKMDRVFPEALSPLKEADREVYDLIQNEKKRQIGGIELIASENFTSAPVMEALGSALTNKYSEGLPGARYYGGNEIIDKVETLCQERALHAYRLDAKDWGVNVQPYSGSPANLAVYTALLQPHDRIMGLDLPSGGHLTHGYYTAHGKKISATSIFFESLPYKVDPKTGLIDYEKLEEKAMDFRPKMIICGGSAYARDWDYARFREIADKCGAMLMMDMAHISGLVAAEEQAQPFEYCDIVTTTTHKSLRGPRSGMIFFRRGVNAKTGKDYDYESRINMAVFPSLQGGPHNHQIGALCVALKYAATPAFKEYIKQVKANAKALGERLVEKGYSLVTGGTDNHLVLWDLRPLGLTGSKMEYLCDLLHITLNKNAVFGDASALSPGGVRIGAPAMTSRGLVEKDFVQIADFLSRAVDLCLEVQQSHGKMLKDWKKGLDGNPKVASMRAEVEAFSSAFDMPAFTKESIDI

SEQ ID NO: 9229 - DNA, 1254 bp, Pseudomonas syringae pv
  CDS (1)..(1254)
atgttcagccgtgatttgactatcgccaagtacgacgccgatctgtttgccgccatggagcaagaagctctgcgtcaggaagaacacatcgagctgatcgcctcggaaaactacaccagtccggccgtcatggaagctcaaggctcggtactgaccaacaagtacgctgaaggctacccaggcaagcgttattacggtggctgcgagtacgtcgacgttgtcgagcaactggccatcgaccgtgccaaggagctgttcggcgccgattacgccaacgtccagccacacgccggttcgcaagccaactcggcggtctacctggctctgctgcaaggcggcgacaccattctgggcatgagcctggcccacggcggtcacttgacccacggtgccagcgtttcgtcctcgggcaagctgtacaacgctgttcagtacggcatcgacggcaatggcatgatcgactacgacgaagtcgagcgcctggctgttgaacacaagccaaaaatgatcgttgccgggttctctgcctactcgcagatcctcgacttcccgcgctttcgcgctatcgccgacaaggtcggtgcctacctgttcgtcgatatggcgcacgtagccggtctggttgccgcaggtgtctacccgaacccggtgccgttcgccgacgtcgtcaccaccaccacgcacaagaccctgcgcggtccacgtggcggcctgatcctggcgcgcgccaacgccgacatcgagaaaaagctgaactccgccgtattccctggctcccagggcggcccgctggagcacgtcatcgcagccaaggccatctgcttcaaggaagcgctgcagcctgagttcaagacctaccagcaacaagtggtcaagaacgccaaggcaatggccggtgtgttcatcgagcgcggtttcgacgtagtgtccggaggtactgaaaaccacctgttcctgctctcgctgatcaagcaggacatctccggtaaagacgccgacgccgctctgggtcgcgccttcatcaccgtcaacaaaaactcggtacccaacgacccacgctccccgttcgtcacctccggcctgcgcttcggcaccccggcggtgaccactcgcggcttcaaggaagcagagtgcaaggaactggccggctggatctgcgacatcctggcagacctgaacaacgaagccgtgattgacgctgtgcgcgagaaggtcaaagccatctgcgcgaagctgccggtttacggcgcttga

SEQ ID NO: 9230 - protein, 417 aa, Pseudomonas syringae pv
MFSRDLTIAKYDADLFAAMEQEALRQEEHIELIASENYTSPAVMEAQGSVLTNKYAEGYPGKRYYGGCEYVDVVEQLAIDRAKELFGADYANVQPHAGSQANSAVYLALLQGGDTILGMSLAHGGHLTHGASVSSSGKLYNAVQYGIDGNGMIDYDEVERLAVEHKPKMIVAGFSAYSQILDFPRFRAIADKVGAYLFVDMAHVAGLVAAGVYPNPVPFADVVTTTTHKTLRGPRGGLILARANADIEKKLNSAVFPGSQGGPLEHVIAAKAICFKEALQPEFKTYQQQVVKNAKAMAGVFIERGFDVVSGGTENHLFLLSLIKQDISGKDADAALGRAFITVNKNSVPNDPRSPFVTSGLRFGTPAVTTRGFKEAECKELAGWICDILADLNNEAVIDAVREKVKAICAKLPVYGA

SEQ ID NO: 9231 - DNA, 1416 bp, Phaeosphaeria nodorum
  CDS (1)..(1416)
atgtctacttacgcgctccccaagtcccaccaggacctcatggagaagtccctggtggacacggacaatgaggttgcccagatcatggagaaggagattcagcgtcagcgcgagtccatcctcctcatcgcgtccgagaatgtcacatcccgcgccgtcttcgatgctctcggctcgcccatgtccaacaagtactccgagggctaccccggtgcccgctactacggcggaaacgagcacatcgacgccattgagctgctgtgccagaagcgcgctctcgaggccttcggtctggatgcagagaagtggggtgtgaacgtccagtgcttgagcggcagcccagccaacctccaggtctaccaggccatcatgcgcccacacgacaggctcatgggtcttgatctgccccacggcggacatttgagccacggataccagacaccgcagaggaagatctctgccgtctccacatacttcgagaccttcccttaccgcgtgaacctcgacaccggcatcatcgactacgaccagctcgagcagaatgccctcatgtaccgccccaaggtcctcgtcgctggaacctctgcctactgccgtgagatcgactacgcccgcatgcgcgagattgccgacaaggtcggatgctacctgatgatggacatggcacacatttctggactcgtcgccgctggcgttaacaagtcgcccttcccatactgcgatattgtcacaaccaccacccacaagtctctccgtggaccccgtggtgccatgatcttcttccgcaagggcgtccgcaagaccgacgcgaagaccggcaaggagaccctgtacgatctcgagggacccatcaacttctccgtgttccctggtcaccagggtggaccccacaaccacaccatcactgcgcttgcagtcgcgctcaagcaggctcagaccgaggacttcaagctttaccagcagcaggtcatcaagaacgccaagcagctcgaggtcaccttcaaggagcttggcttcaagctcgtcaccgacggcacagacaaccacatggtcctcatcgacctcaagcccttcgccctcgacggtgcgcgtgttgaggctgtgctcgagcaggtcaacatcgcctgcaacaagaacaccacacccggcgacaagagcgcgctatcacccatgggtatccgtatcggtgcgcccgccatgacctcaagaggtctcggcgaggacgacttcaagaagattgccggctacatcaacaagtgcgtcgagatgtgcaagaagatccagggcgagttgcccaaggacaacaacaagctcaaggacttcaaggccaaggttgcatctggcgaggttgaggagatcaacagcctgaagaaggaaattgccgcgtgggccgttaccttccctcttcccatctaa

SEQ ID NO: 9232 - protein, 471 aa, Phaeosphaeria nodorum
MSTYALPKSHQDLMEKSLVDTDNEVAQIMEKEIQRQRESILLIASENVTSRAVFDALGSPMSNKYSEGYPGARYYGGNEHIDAIELLCQKRALEAFGLDAEKWGVNVQCLSGSPANLQVYQAIMRPHDRLMGLDLPHGGHLSHGYQTPQRKISAVSTYFETFPYRVNLDTGIIDYDQLEQNALMYRPKVLVAGTSAYCREIDYARMREIADKVGCYLMMDMAHISGLVAAGVNKSPFPYCDIVTTTTHKSLRGPRGAMIFFRKGVRKTDAKTGKETLYDLEGPINFSVFPGHQGGPHNHTITALAVALKQAQTEDFKLYQQQVIKNAKQLEVTFKELGFKLVTDGTDNHMVLIDLKPFALDGARVEAVLEQVNIACNKNTTPGDKSALSPMGIRIGAPAMTSRGLGEDDFKKIAGYINKCVEMCKKIQGELPKDNNKLKDFKAKVASGEVEEINSLKKEIAAWAVTFPLPI

SEQ ID NO: 9233 - DNA, 1452 bp, Phaeosphaeria nodorum
  CDS (1)..(1452)
atggaagcccagcaaaaggtgctttcgcaagacctcgagaaagcggatccaacggtctatgagatcatccagaaggagaagaacagacaaaagcactttatcaacctcatcccctcggagaacttcacgtcgcaagctgttctcgatgctctcggcagtgttatgcaaaacaaatactcggagggatatccaggcgcgcgatactacggtggtaacgagcacatcgatgaggcggagcggctatgccagtcaagagcgctcaaggcgttcggtctgagcccggaggaatggggggtcaacgtacaaccactctcggggtctccagcaaacctctacgcatactcggccatccttaacacacacgatcgcatcctcagtctcgatcttcctcatggcggccacttgtcccacggttaccaaataccaggaaagaagatctcggcagtctccaagtattacgagactctaccatataggctgaacgagaagaccggcattatcgattatgatcgcatggaagaattggcatacctgtaccgacccaaggtcattgttgccggtacatcagcatacagccgattgatcgactatgagcgcttccgtaaggtggcagacggcgtaggcgcatatctcctgtctgatatggctcacatctctggtcttgttgccgcgtccgtcatcccgtcaccattccctcactccgacatcgtcacaaccacaacccataagtcgttgcgcggcccgcgaggtgccatgattttcttccgtaagggcacaaggcgtgtggataagaagggcaaggaggagaagtacgatcttgaaggcccaatcaaccagtctgtcttccctggccaccaaggaggacctcacaaccacactatcacagctctggctgtcgccttacaacaagcccaaagcaaggagttcaaggactaccagcaacaagtacttgagaatgccaagtctcttgcacagcgtctcggtgataccaaagaaaacggcggcctgggctacaacgtcgttagcggtggaactgacaaccaccttgtccttattgacttgaaggacaagggcgtagacggagctcgagttgagcgcatcctcgagcttgtcggcgtggcgtccaataagaacaccgttcctggtgacaagtccgccatgaagcctggcggtctgcgcatgggcactcccgcaatgacgacccgtggctttgcacctggcgacttcaagcgtgtcgccgatgttgtccaccgcgccgtcggcatcactcagaagctcgataaggaggcgaagaagaaggccgaggagactggtcgcaagaaccccggcagcgtcgctgccttcaaggaatacgtaggtgaaggagaggacatcaccgacgttgttcagttacgaaaggaagtcgaggactgggtagctacttttgctctcccatgggacaagagcgaatag

SEQ ID NO: 9234 - protein, 483 aa, Phaeosphaeria nodorum
MEAQQKVLSQDLEKADPTVYEIIQKEKNRQKHFINLIPSENFTSQAVLDALGSVMQNKYSEGYPGARYYGGNEHIDEAERLCQSRALKAFGLSPEEWGVNVQPLSGSPANLYAYSAILNTHDRILSLDLPHGGHLSHGYQIPGKKISAVSKYYETLPYRLNEKTGIIDYDRMEELAYLYRPKVIVAGTSAYSRLIDYERFRKVADGVGAYLLSDMAHISGLVAASVIPSPFPHSDIVTTTTHKSLRGPRGAMIFFRKGTRRVDKKGKEEKYDLEGPINQSVFPGHQGGPHNHTITALAVALQQAQSKEFKDYQQQVLENAKSLAQRLGDTKENGGLGYNVVSGGTDNHLVLIDLKDKGVDGARVERILELVGVASNKNTVPGDKSAMKPGGLRMGTPAMTTRGFAPGDFKRVADVVHRAVGITQKLDKEAKKKAEETGRKNPGSVAAFKEYVGEGEDITDVVQLRKEVEDWVATFALPWDKSE

SEQ ID NO: 9235 - DNA, 1557 bp, Medicago truncatula
  CDS (1)..(1557)
atggcaatggcaatggctcttcgtaggctttcttcttccatcaacaaatcttcacgtcctctcttcagtgcttcttctgtttactacaagtcatctttgcctgatgaagctgtgtatgataaagagaattcacgtgtttcgtggccaaagcaattgaattcttcacttgaggaaattgaccctgaaattgctgatattattgagcttgagaaagctagacaatggaaggggctggaactgattccatcagaaaacttcacttctttatctgttatgcaagctgttggctctatcatgacaaacaaatacagtgaaggttatcccggagcaagatattacggaggaaatgagtatattgacatggcagaaacactatgccaaaagcgtgccttggaagcatttcggttggatccagctaaatggggagtgaacgtgcagcctttgtctggttcaccttcaaattttcatgtttacactgcattgttgaaacctcatgacagaatcatggcacttgatctccctcatggaggacatctttctcatggttaccagaccgacaccaaaaagatatctgcagtctctatattttttgagacaatgccatatagattggatgaaagcacaggatacattgattatgaccagctagagaaatctgctaccctcttcaggccaaaactaattgttgccggtgctagtgcctatgcacgtctgtatgattatgcacgcattcgcaaggtgtgcgataaacaaaaagctgtgatgttagcagatatggcacatatcagtggactggttgcagctggtgttatcccttcaccttttgattatgcagatgtagtgactaccacaactcacaagtcacttcgtggaccacgtggagctatgatctttttccggaagggattaaaagaagtcaacaaacaaggaaaagaggtgttctatgactatgaggataaaatcaatcaagctgtcttccctggactgcaaggtggtcctcacaaccataccatcactggtttagccgttgcattgaaacaggctacaactccagagtataaagcataccaagagcaggttctcagcaattgcgcaaaatttgcacaggctttgagtgagaaaggctatgagcttgtttctggtgggactgagaatcatctagttttggtgaatcttaagaacaagggtattgatggctccagagttgagaaggtgttggaagcagtacatattgcagctaataaaaacactgttccaggagatgtgtctgctatggttcctggtggtatcaggatgggaactcctgctcttacttcaaggggatttgttgaggaggatttcgttaaggtagcagagtattttgatgcatccgtgaatttggctttgaagatcaaggcagagagcaaaggaacaaaattaaaggacttcgtagaaacattgcagtcatcctcctacgtgcagtcagagatctccaaacttcgtcatgatgttgaggagtttgcaaaacaatttccaaccattggttttgaaaaatcaagcatgaagtacaacaaataa

SEQ ID NO: 9236 - protein, 518 aa, Medicago truncatula
MAMAMALRRLSSSINKSSRPLFSASSVYYKSSLPDEAVYDKENSRVSWPKQLNSSLEEIDPEIADIIELEKARQWKGLELIPSENFTSLSVMQAVGSIMTNKYSEGYPGARYYGGNEYIDMAETLCQKRALEAFRLDPAKWGVNVQPLSGSPSNFHVYTALLKPHDRIMALDLPHGGHLSHGYQTDTKKISAVSIFFETMPYRLDESTGYIDYDQLEKSATLFRPKLIVAGASAYARLYDYARIRKVCDKQKAVMLADMAHISGLVAAGVIPSPFDYADVVTTTTHKSLRGPRGAMIFFRKGLKEVNKQGKEVFYDYEDKINQAVFPGLQGGPHNHTITGLAVALKQATTPEYKAYQEQVLSNCAKFAQALSEKGYELVSGGTENHLVLVNLKNKGIDGSRVEKVLEAVHIAANKNTVPGDVSAMVPGGIRMGTPALTSRGFVEEDFVKVAEYFDASVNLALKIKAESKGTKLKDFVETLQSSSYVQSEISKLRHDVEEFAKQFPTIGFEKSSMKYNK

SEQ ID NO: 9237 - DNA, 1545 bp, Aspergillus oryzae
  CDS (1)..(1545)
atgctgagccgctgtggtcgccaggctttgcgattgatcccgcgcacgggaagctcttccagagctatcgccatcactactcaactccgaccggctgctcccttgtgtgtctccagctcaatttctcagagccggagtgtgtcatcctccagtcgtgatggacagcaacatgagaaaaaacgtcaaaagcactttatcaacctgatcccttcggagaacttcacttcacaagcggtccttgatgccctgggcagtgtgatgcaaaacaagtattcagagggttatcccggtgccagatactacggaggaaatgagcacatcgacgagtcggagaggttatgtcaacagcgtgccttggagaccttccggctcaatcccgaagaatggggcgtgaatgttcaaccactttccggctctcccgcgaacttgtatgccatctccgcccttctcaacacgcatgaccgcctgatgggcctggacttgcctcatggtggtcacttgtcacatggttatcagacacccaccaagaagatttcattcatctcgaaatactttgagacccttccttaccgccttgatgagtcgactggtctcattgattacgacgccctcgagaagcaggcgttgctctatcgtccaaagctcattattgccggtacttcggcctatagccgattaatcgactaccctcggatgcgccagatcgcagacgcagctggtgcataccttctcagtgacatggcccacatatctggactggttgctgcggatgtacttccctcgcctttcactcactctgatgtggtaacaacgactactcacaagtccctgcgtgggccccgtggtgccatgatcttctaccgcaagggtgtccgccggacggacaagaagggcaacccggagatgtacgacttagagaatcctatcaatgcctccgtcttcccgggccaccagggtgggcctcataaccacaccattactgctctagcagttgcactgaagcaggcccagtcaaccgagttcaagacttaccaggaaaccgtcttagccaacgctaaggcattggctgaccgacttggcagccctctcagcaatgggggtttgggatacaacattgtgtccggtggaacggataaccacctggtcctcgtggatctgaagaaccgtggggttgatggagcccgtgttgaacgtgttctagagctctgcggcgttgctagcaacaagaacaccgttccgggagatcggtcggctttgaagcccggtggtctccgcctgggtactcctgccatgactacccgtggcttccagcccgaggacttccgccgcgtggccgatatcgttgatcgcgcggtcattatcacccaaaagctggacaaggctgccaaggagagcgctgcggctaagggcgttaagaacccgaacactgtcaaggccttcctggaatatgttggtgagggtgaggagatttcagagattgtgctcttgcggcaggaagttgaggactgggtgggaactttcagcctcccttggaaggacgagtaa

SEQ ID NO: 9238 - protein, 514 aa, Aspergillus oryzae
MLSRCGRQALRLIPRTGSSSRAIAITTQLRPAAPLCVSSSISQSRSVSSSSRDGQQHEKKRQKHFINLIPSENFTSQAVLDALGSVMQNKYSEGYPGARYYGGNEHIDESERLCQQRALETFRLNPEEWGVNVQPLSGSPANLYAISALLNTHDRLMGLDLPHGGHLSHGYQTPTKKISFISKYFETLPYRLDESTGLIDYDALEKQALLYRPKLIIAGTSAYSRLIDYPRMRQIADAAGAYLLSDMAHISGLVAADVLPSPFTHSDVVTTTTHKSLRGPRGAMIFYRKGVRRTDKKGNPEMYDLENPINASVFPGHQGGPHNHTITALAVALKQAQSTEFKTYQETVLANAKALADRLGSPLSNGGLGYNIVSGGTDNHLVLVDLKNRGVDGARVERVLELCGVASNKNTVPGDRSALKPGGLRLGTPAMTTRGFQPEDFRRVADIVDRAVIITQKLDKAAKESAAAKGVKNPNTVKAFLEYVGEGEEISEIVLLRQEVEDWVGTFSLPWKDE

SEQ ID NO: 9239 - DNA, 1413 bp, Aspergillus oryzae
  CDS (1)..(1413)
atggccacctacgctctgtcgcaggcccaccgggaccaaatggagaagactctcgttgagtctgatcccgaaattgctcagatcatggaaaaagagattcagcgtcagcgtgaatccatagtcctgatcgcttcggagaacttcacttctcacgccgttttcgacgcccttggttctcccatgtccaacaagtactccgagggttaccccggtgcccgttactacggtggtaatcagcacatcgatgccatcgagctcacatgccaggcccgtgccctgaaggccttcaacctcgaccctgccaagtggggcgtcaacgttcagtgcctgagtggcagccctgccaacttgcaggtctaccaggctcttatgcgcccccatgaccgtctgatgggtctggatcttccccacggaggccatctgtcccacggttatcagacccccgccagaaagatctctgctgtctctacttacttcgagaccttcccctaccgtgtcaaccttgagactggtatcattgattacgatgccctggaggccaacgctgagctctaccgccccaagtgtctggttgccggtacctccgcctactgccgcttgatcgactatgagcgcatgcgcaagatcgctgacaaggtcggcgcttacctcattgttgatatggcccatatctccggattgatcgccgccggtgtcattccttctcccttcgagtacgccgatgttgtcactaccaccacccacaagtctcttcgtggcccccgtggtgccatgatcttcttccgcaagggtgtgcgcagcactgacaagaccggaaaggagattctttacgaccttgagggtcctatcaacttctccgttttccctggtcaccagggtggtccccacaaccacaccatcactgcccttgctgttgctctcaagcaggttgacactcccgagttcaagcagtaccagcagcaggtcctgaacaacgccaaggctctggagaacgagttcaagcagctgggccacaagctcgtctctgacggcactgacagccacatggtcctggtcgacctccgtgctcagaagttggacggtgctcgtgttgaggctgtcctggagcagatcaacattgcttgcaacaagaactccatccctggtgacaagtctgcccttaccccctgtggtatccgtatcggtgctcctgccatgaccacccgtggtatgggtgaggaggacttcaagcgcatcgctcactacatcgacaaggccatcaagatctgcaaggatgttcagggtgcgctccccaaggaggccaacaagctcaaggacttcaaggccaaggttgcctccgagaccgtctcggacatcctggagctgcgcaaggagattgccgcctgggcttccaccttccctctccccgtttaa

SEQ ID NO: 9240 - protein, 470 aa, Aspergillus oryzae
MATYALSQAHRDQMEKTLVESDPEIAQIMEKEIQRQRESIVLIASENFTSHAVFDALGSPMSNKYSEGYPGARYYGGNQHIDAIELTCQARALKAFNLDPAKWGVNVQCLSGSPANLQVYQALMRPHDRLMGLDLPHGGHLSHGYQTPARKISAVSTYFETFPYRVNLETGIIDYDALEANAELYRPKCLVAGTSAYCRLIDYERMRKIADKVGAYLIVDMAHISGLIAAGVIPSPFEYADVVTTTTHKSLRGPRGAMIFFRKGVRSTDKTGKEILYDLEGPINFSVFPGHQGGPHNHTITALAVALKQVDTPEFKQYQQQVLNNAKALENEFKQLGHKLVSDGTDSHMVLVDLRAQKLDGARVEAVLEQINIACNKNSIPGDKSALTPCGIRIGAPAMTTRGMGEEDFKRIAHYIDKAIKICKDVQGALPKEANKLKDFKAKVASETVSDILELRKEIAAWASTFPLPV

SEQ ID NO: 9241 - DNA, 1524 bp, Medicago truncatula
  CDS (1)..(1524)
atggccatggcacttcgaagactcacttccaccatcaacaaacctacttctctctatcgcttgtcatcttctctctccgctcaacacactcacaaatctcaccccgattggattaaacaactcaacgatcctcttggtgtagtagatcctgagatcgaagatataatcgaactagaaaaagctcgtcaatggaaggggctagagcttataccatcagaaaattttacgtcgttgtcggtgatgcaagcggttggatcggttatgacgaataaatacagtgaaggttatcctggtgctagatactatggtggaaatgagtacattgacatggctgagactttgtgtcagaagcgtgcattggaaacttttggattggatccaacacaatggggagggttcagtacctcagtttctggtcaactgaaaccttctaacttccaagtttacactgctttattgaaacctcatgagagaattatggcacttgatctcccccatggtgggcatctatcacatggaactgacaccaagaagatatcagctgtatctatattctttgaaacaatgccatacaggttggatgagagcactggttatattgactatgaccagatggagaaaagtgctgcactttttaggccaaaattaatagttgccggtgctagtgcttatgcccgtctttatgattatgcgcgtattcgcaaggtctgtgataaacagaaggcagttatgttggctgatatggcacacatcagtggattagttgctgcaggtgttattccttctccttttgattatgcagatgttgtaacaaccacaacacataagtcacttcgtggaccacgtggggctatgatattcttcaggaagggtctgaaagagataaacaagaaagggcaggaagtgctgtatgactacgaagacaagataaatcaggctgttttccctggacttcaaggtggtccccacaatcacactattacaggcttagcagttgcattgaagcaggctatgacaccggaattcaagaattaccagaaacaagttcttagtaactcctcgacatttgcacagagcttgttagagaaaggctatgaccttgtatcgggtggaactgagaaccatttggtgttggtaaacttaagaaacaagggcattgatggttcaagggttgagaaggtgttagaatcagttcatatagctgccaataaaaacactgttccaggagatgtgtctgcaatggttcctggagggatcagaatgggaactcctgctcttacatctaggggttttgttgaggatgattttaaaaaagtagctgaatactttgacgcggctgtcaaaatagccttacagattaaggaaaattctaaaggcacaaagttgaaggattttgtggaagctatggagtccgattcacaagttcaatctcaaatcgctgatctccgccatgacgtagaaggttatgctaagcagtttcccacaattggttttgagatagagacaatgaagtataacaagtga

SEQ ID NO: 9242 - protein, 507 aa, Medicago truncatula
MAMALRRLTSTINKPTSLYRLSSSLSAQHTHKSHPDWIKQLNDPLGVVDPEIEDIIELEKARQWKGLELIPSENFTSLSVMQAVGSVMTNKYSEGYPGARYYGGNEYIDMAETLCQKRALETFGLDPTQWGGFSTSVSGQLKPSNFQVYTALLKPHERIMALDLPHGGHLSHGTDTKKISAVSIFFETMPYRLDESTGYIDYDQMEKSAALFRPKLIVAGASAYARLYDYARIRKVCDKQKAVMLADMAHISGLVAAGVIPSPFDYADVVTTTTHKSLRGPRGAMIFFRKGLKEINKKGQEVLYDYEDKINQAVFPGLQGGPHNHTITGLAVALKQAMTPEFKNYQKQVLSNSSTFAQSLLEKGYDLVSGGTENHLVLVNLRNKGIDGSRVEKVLESVHIAANKNTVPGDVSAMVPGGIRMGTPALTSRGFVEDDFKKVAEYFDAAVKIALQIKENSKGTKLKDFVEAMESDSQVQSQIADLRHDVEGYAKQFPTIGFEIETMKYNK

SEQ ID NO: 9243 - DNA, 1674 bp, Oryza sativa subsp
  CDS (1)..(1674)
atgctgatgcgtccggtgtggtgggtgctggggctgatcactgcagataaaaacgccacgcgaatccactacctcccaaaccccgagacccccccgcctccaccaccacccgccgctcgccgctcgcccaccatggccatggcgacggcgctccgcaagctctcctccgacgccctccgccgccagccgctctcccgcatcaccccgctctactacatggcgtccctgccggcgacggaggagagatccggagtcacctggccgaagcagctgaacgcgccgctggaggaggtggatcccgagatcgccgacatcatcgagcacgagaaggcccgccaatggaagggtctggagctcatcccgtcggagaacttcacctcggtgtcagtgatgcaggcggtgggatccgtcatgaccaacaagtacagcgaggggtaccccggcgcgagatactacggtggaaacgaatacattgatatggccgagtcattgtgccagaaacgtgctttggaggccttccgcttggacccagcgaaatggggagtgaatgtgcaacctctatcagggtcacctgccaacttccatgtttacactgccctattgaaaccacatgagagaatcatggctttggatcttcctcatggtggacatctttctcacggctaccagactgatactaagaagatttcagcagtttcgatattctttgagacaatgccctacagattggatgaaagcactggcttgattgattatgatcagatggagaaaagtgccgttctttttaggccaaagttgatcgttgcgggtgcaagtgcatatgcgcgtctttatgactatgaccgcatgcggaaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggttatgtatgactttgaggacaagatcaatgctgctgtcttcccaggtctgcaaggtggaccacataatcataccattactggcttagctgttgcgcttaagcaggcaactactccggagtacagagcttatcaagagcaagttatgagtaactgtgcaaaatttgcacagagcttgacagcaaaaggctacgaacttgtctctggtgggactgacaaccatttagtgttggtaaatctcaagagcaagggcatagatggttcaagagtggagaaggttttagaaaacgtgcacattgcagcaaacaagaacacagttcctggtgatgtttcagctatggtaccaggaggcatcaggatgggaaccccagcactgacctcaagaggatttgttgaggaggactttgctaaggttgctgatttcttcgatgcagcagtgaacttggctttgaaggttaaggctgcagcaggtggaacaaaactgaaggactttgttgccactttgcaatctgatagcaacattcaatccgagattgcaaaacttcgccatgatgtggaggaatatgcaaaacagttccccacaattgggtttgagaaagaaaccatgaagtacaagaactaa

SEQ ID NO: 9244 - protein, 557 aa, Oryza sativa subsp
MLMRPVWWVLGLITADKNATRIHYLPNPETPPPPPPPAARRSPTMAMATALRKLSSDALRRQPLSRITPLYYMASLPATEERSGVTWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMVPGGIRMGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 9245 - DNA, 1281 bp, Bacteroides forsythus
  CDS (1)..(1281): transl_table=11
atgaaacgagacagtgtaatttttgaaattatcgaacgtgaccatcaacgccagttgaaaggtatcgagttgattgcttcggaaaacttcgtgagtgaacaggtgatgcaggccatgggcagttaccttaccaacaagtatgccgaaggatatcccgggaaacgttattacgggggctgcgaagtggtagacgaaagcgagaatctggccatcgaacggctgaaaaagctcttcggggccgaatgggctaacgtgcagccacattctggagcacaggcaaacgcggccgtctttctggcagtcctgaatccgggcgatacgttcttaggcttaaacctctcgcacggagggcatctttcgcacggttcgccggtaaacagctcaggtatcttgtatcgcgccgtcgaatataatgtaaaagaagatacgggacgcgtggattacgaacagatggaagaagtggcattgcgcgagaaaccgaaattaattgtcggaggagcttccgcttattctcgggactgggattatgccagaatgcgtgcgattgccgacaaagtcggcgcattgctgatgatcgatatggcacacccggccggcctgattgctgccggtttactgaacaacccgctgccacacgcccatatcgtcacttcaacgacgcataagaccctgcgcggcccgcgcggtggtgtgattttgctgggcaaggattttgaaaatccatggggcaagaaaacaccgcaaggcgaaatcaaaaccatgtctcagctgctcgattcggcggtattccccggtattcagggtggtccgctcgaacatgtgattgccgccaaagccgtgtcattcggcgaagcgcttgaacccgaatacaagacttatcaaacacaggtaaagaaaaatgcagccgtgatggcacaagcctttatcgataagggctacaaaatcatttcgggcggaacggacaaccacagcatgcttatcgacctgcgtaccaaattccccgagttgacaggtaaggtagctgaaaaagcgctagttgccgccgatattacggtgaacaagaatatggtaccgttcgacagccgttcgccgttccaaacatcgggcatccgtatcggtacgccggccatcaccacacgcggagtaaaagagccgctgatgggtgagattgtcgagatgatcgacaccgtactttccaatcccgaatcggaaacaacgatcgcttccgtgcgcagcaaagtgaatcagacgatgaaagactatccgttgtatgcatggtaa

SEQ ID NO: 9246 - protein, 426 aa, Bacteroides forsythus
MKRDSVIFEIIERDHQRQLKGIELIASENFVSEQVMQAMGSYLTNKYAEGYPGKRYYGGCEVVDESENLAIERLKKLFGAEWANVQPHSGAQANAAVFLAVLNPGDTFLGLNLSHGGHLSHGSPVNSSGILYRAVEYNVKEDTGRVDYEQMEEVALREKPKLIVGGASAYSRDWDYARMRAIADKVGALLMIDMAHPAGLIAAGLLNNPLPHAHIVTSTTHKTLRGPRGGVILLGKDFENPWGKKTPQGEIKTMSQLLDSAVFPGIQGGPLEHVIAAKAVSFGEALEPEYKTYQTQVKKNAAVMAQAFIDKGYKIISGGTDNHSMLIDLRTKFPELTGKVAEKALVAADITVNKNMVPFDSRSPFQTSGIRIGTPAITTRGVKEPLMGEIVEMIDTVLSNPESETTIASVRSKVNQTMKDYPLYAW

SEQ ID NO: 9247 - DNA, 1299 bp, Rhizobium meliloti
  CDS (1)..(1299): transl_table=11
atgctttcacagaccaacgacgctttcttcacccgctctctcgccgacagcgatccggaaatcttcggtgcgatcgagaaggagctgggccgccagcgccatgagatcgagctgatcgcctccgagaacatcgtttcacgggccgtgctcgaggcgcagggctcgatcatgaccaacaaatacgccgagggttacccgggcaagcgctattacggcggctgccaatatgtcgatatcgccgaggcactcgcgatcgagcgcgccaagaagctcttcggcgtcaacttcgcgaacgtgcaaccgaattcgggctcccagatgaaccaggcggtcttcctggcgctgctgcagccgggcgacaccttcatgggcctcgacctcaattccggcggccacctgacccatgggtccccggtgaacatgtcgggcaaatggttcaacgtcgtttcctacggcgtgcgcgaagacgatcaccttctcgacatggacgaagtcgccaggaaggcgcgcgagcagaagccgaaactgatcatcgccggcggaacggcctattcccgcatctgggactggaagcgcttccgcgagatcgccgacgaggtgggcgcgtggctgatggtcgacatggcccacatcgccggtctcgtggccggtggccagcatccgtcgccgttcccgcactgccacgttgcgacgacgaccacgcacaagtccctgcgcggcccccgcggcggcatgatcctcaccaatgacgaggaaatcgccaagaagatcaactccgccgtattccccggtctccagggtgggccgctgatgcacgtgattgccgccaaggccgtcgcgcttggcgaggcgctgcagccctccttcaaggattatgcggcccaggtcgtcaagaacgcccgcacccttgccgaaaccttgaaggccaacggcctggatggacatcgtctcggcggtaccgacacccacctgatgcctggtcgacctgcgcaagaagaatgcgaccggcaagcgtgccgaagctgctctcggccgtgctacgtcacctgcaacaagaacggcattcccttcgaccccgaaaagcccttcgtcacctccggcgtgcgcctcggtgcaccggccggtacgacgcgcggcttcaaggaggcggagttcaaggaggtcggcgaactgatcgtcgaggtgctcgacggtctcaaggccgccaattccgacgagggcaatgccgctgtcgaggctggcgtgcgcgagaaggtgatcaagctcaccgaccgcttcccgatgtacggctatatgtga

SEQ ID NO: 9248 - protein, 432 aa, Rhizobium meliloti
MLSQTNDAFFTRSLADSDPEIFGAIEKELGRQRHEIELIASENIVSRAVLEAQGSIMTNKYAEGYPGKRYYGGCQYVDIAEALAIERAKKLFGVNFANVQPNSGSQMNQAVFLALLQPGDTFMGLDLNSGGHLTHGSPVNMSGKWFNVVSYGVREDDHLLDMDEVARKAREQKPKLIIAGGTAYSRIWDWKRFREIADEVGAWLMVDMAHIAGLVAGGQHPSPFPHCHVATTTTHKSLRGPRGGMILTNDEEIAKKINSAVFPGLQGGPLMHVIAAKAVALGEALQPSFKDYAAQVVKNARTLAETLKANGLDGHRLGGTDTHLMPGRPAQEECDRQACRSCSRPCYVTCNKNGIPFDPEKPFVTSGVRLGAPAGTTRGFKEAEFKEVGELIVEVLDGLKAANSDEGNAAVEAGVREKVIKLTDRFPMYGYM

SEQ ID NO: 9249 - DNA, 1723 bp, Arabidopsis thaliana
  CDS (80)..(1495)
ctcttcccacttctcactctctgatctcagatctctccctccctcttttcacagatccattcaacaatctccaaagaagatggaaccagtctcttcatggggtaacacctctctcgtctccgtagatccagagatccacgacctaatcgagaaggagaaacgtcggcaatgtcgaggaatcgaacttatcgcttccgagaatttcacttccttcgccgtcatcgaagctctcggaagtgccttaaccaacaaatactccgaaggtattcctggtaatcgttattacggaggtaacgaattcatcgatgagatcgagaatctttgccgttcacgtgctctcgaagctttccattgtgatccagcagcgtggggcgttaatgttcagccgtattctggatctccggcgaatttcgctgcttacacggctttgcttcagcctcacgatcgtatcatggggcttgatttgccttcaggtggtcatttgactcatggttactatacatctggtggtaagaagacctctgcgacttcgatctactttgagagtcttccgtataaggtgaatttcaccactggttacattgattacgataagcttgaagagaaggcgttggatttcaggcctaagttgcttatctgtggtggtagtgcgtatcctagggattgggattacgctagatttagagctattgctgataaggttggagctcttttgctttgtgacatggctcacatcagtggtctcgttgctgctcaggaagctgcaaacccatttgagtactgtgacgttgtgacaaccacaacccacaagagtttgaggggtccaagggctggtatgattttctacaggaagggtccaaaaccaccaaagaagggtcaacccgagggtgcagtctatgattttgaggacaaaatcaactttgctgtattccctgcgcttcaaggtggtcctcacaatcaccagattggtgctttagctgttgcgttgaagcaggctaatactcctgggttcaaggtctacgcaaaacaagtgaaagccaatgctgttgcccttggaaactacctaatgagcaagggttaccagattgtgaccaatggaactgagaaccaccttgttctctgggatcttcgccctcttggattgaccggaaacaaggttgagaagctctgcgatctgtgcagcattacattgaacaagaacgcagtatttggagacagtagtgctcttgctcctggaggtgtaagaatcggtgcacccgcgatgacatcgagaggattggtggagaaggactttgagcagataggagaattcctgagccgtgcagtgacactgacgttggacatccaaaagacatacggtaagttgttgaaggacttcaacaagggtttggtgaacaacaaagatctcgaccagctcaaggctgacgtcgagaagttctctgcgtcttatgaaatgcctggattcctcatgtctgagatgaagtaccaggattagagatctttctctatatgcaagagtaatcttctattatctaccatatatataaaatatgcttttgtaggatcgccttaaaggcgaagagatgaagatgcaaacagtaaaaaagggttttcttttcagctatttcttcttgaatgtttttttttctttttattttggtttcttattgaaattgttgtatttttgttggctttttttctaataatatcagcgagttttttc

SEQ ID NO: 9250 - protein, 471 aa, Arabidopsis thaliana
MEPVSSWGNTSLVSVDPEIHDLIEKEKRRQCRGIELIASENFTSFAVIEALGSALTNKYSEGIPGNRYYGGNEFIDEIENLCRSRALEAFHCDPAAWGVNVQPYSGSPANFAAYTALLQPHDRIMGLDLPSGGHLTHGYYTSGGKKTSATSIYFESLPYKVNFTTGYIDYDKLEEKALDFRPKLLICGGSAYPRDWDYARFRAIADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALGNYLMSKGYQIVTNGTENHLVLWDLRPLGLTGNKVEKLCDLCSITLNKNAVFGDSSALAPGGVRIGAPAMTSRGLVEKDFEQIGEFLSRAVTLTLDIQKTYGKLLKDFNKGLVNNKDLDQLKADVEKFSASYEMPGFLMSEMKYQD

SEQ ID NO: 9251 - DNA, 2000 bp, Arabidopsis thaliana
  CDS (68)..(1804)
aacgtttatggatttgagtcgttctcaaacaaattttcaattagggtttggttgttcacacgcatcaatgactccaacaccaacaccaagagctccaatcgcagacgattcgattaatctacaagtcgatcaaagtttccgatcattaccaacaactttctctccgattccgttacaattactcgaacaaaaagccgagaagaccaccaccgttgatgagccaaagaaagatggaggaggaggaggagatcaaaaggaagacgagcatttcagaatcttaggtcaccatatgtgtctcaaaaggcaaagagattgtccacttttgttaacgcaatcaaagcatccgaagagaagttccatcggtgattcagatctggaatcgcgacgtgctgctgtacgagcttggggtgatcaaccgattcatttggcggatcctgatattcatgagcttatggagaaagagaagcaacgacaagtaagaggaattgaattgattgcttctgagaatttcgtgtgtagagctgtaatggaagctttaggtagtcatttaacgaataaatactctgaaggtatgcctggagctagatactatactgggaatcaatatattgatcagattgagaatctctgtattgagcgtgctcttactgcgtttggtcttgaatctgataaatggggtgttaatgttcagccttattcttgtacttctgctaacttcgcggtgtataccggacttttattgcccggtgaacggattatggggcttgattcgccttctggtggtcatatgagtcatggttattgtactcctggtgggaagaagatttcggctgcttccatcttctttgagagttttccttataaagtgaatcctcaaactgggtatattgattatgataaggttgaagataaggcgcttgattaccgtcctaagattcttatttgtggtgggagttcttatcctagggattgggattttgcaagggttagacagattgcagataagtgtggagctgttttgatgtgtgatatggctcatattagcggtcttgttgcaactaaggaatgttcaaatccatttgatcactgtgacatagtaacctccactactcacaaaggtctacgtggtcctagaggaggtatcatcttctacaggagaggcccaaagataagaaagcagggccatcactctagccattgtgacacttccacgcattacgatctagaggaaaagatcaactttgctgtttttccatctctacaaggaggtccacacaacaaccatatcgctgctcttgccattgcattgaaacaagtggccactccagagtacaaagcttacatacaacagatgaagaaaaacgcccaagctttagcagcagctcttcttagaagaaaatgcagactggttactggtggtacagacaaccatttgttgctgtgggatctcactcctatgggcttaacagggaaagtctacgagaaagtgtgtgagatgtgccatatcactttaaacaagacggctatattcggggacaatggtacaatatctcctggaggtgtaagaatagggacacccgcaatgacaacccgaggctgtatagagtctgatttcgagacaatggcggattttctgataaaggcggctcagataacaagtgcgttgcagagagagcatggaaagtcacacaaggagtttgtgaaaagtttatgcaccaacaaagacatagctgagcttagaaaccgagtcgaagcatttgctttgcagtatgagatgcctgcttctcttattcgaattgaatgaaagaaaactccacacaacagctttatttacagttgaattttatcttatctctgggtcaatttttttttttttttggagttctatcttgtaaattagagtaaatatatatttatattgggattgatttgcattatttttttccattgtaattctgtaaacattttgataaatgggaatgattactacaaatttactt

SEQ ID NO: 9252 - protein, 578 aa, Arabidopsis thaliana
MTPTPTPRAPIADDSINLQVDQSFRSLPTTFSPIPLQLLEQKAEKTTTVDEPKKDGGGGGDQKEDEHFRILGHHMCLKRQRDCPLLLTQSKHPKRSSIGDSDLESRRAAVRAWGDQPIHLADPDIHELMEKEKQRQVRGIELIASENFVCRAVMEALGSHLTNKYSEGMPGARYYTGNQYIDQIENLCIERALTAFGLESDKWGVNVQPYSCTSANFAVYTGLLLPGERIMGLDSPSGGHMSHGYCTPGGKKISAASIFFESFPYKVNPQTGYIDYDKVEDKALDYRPKILICGGSSYPRDWDFARVRQIADKCGAVLMCDMAHISGLVATKECSNPFDHCDIVTSTTHKGLRGPRGGIIFYRRGPKIRKQGHHSSHCDTSTHYDLEEKINFAVFPSLQGGPHNNHIAALAIALKQVATPEYKAYIQQMKKNAQALAAALLRRKCRLVTGGTDNHLLLWDLTPMGLTGKVYEKVCEMCHITLNKTAIFGDNGTISPGGVRIGTPAMTTRGCIESDFETMADFLIKAAQITSALQREHGKSHKEFVKSLCTNKDIAELRNRVEAFALQYEMPASLIRIE

SEQ ID NO: 9253 - DNA, 2025 bp, Chlamydomonas reinhardtii
  CDS (14)..(1576)
gcacgaggtacagatgcagcgcactgtgcagggtatttcgcagcttgcgcgtgcgctgtcgtccgcgcacgcggtcgcgggccagcgctgcttcgctgcgcagccggcgctgtccaacgaggaggagtacagtcgcttctctcaggatgctagccgggcgcatgtgacgtggcccaaggtcctgaacgccggcctggctgaggtggacccagatctcttcgacatcattgagaaggagaagaaccgccagttcaagggcctggagctgatcccctcggagaacttcgtgtctgcctcggtgatggaggcggtgggcagcgtcatgaccaacaagtacagcgagggctaccccggcgcccgctactacggcggcaacgagttcattgaccaggcagagcgcctgtgccaggagcgtgcgctgaaggcattccacctggacccggctcagtggggcgtcaacgtgcagtcgctgtcgggctcgccctccaacttccaggtgtacacggcgctgctgcagccgcacgaccgcatcatggcgctggacctgccccacggcggccacctcagccacggctaccagactgataccaagaagatcagcgccacctccatctactttgagcaaatgccgtaccgcctgaacgaggagactggcctgatcgactacgacatgctggagaagacggccgtgctgttccgccccaagctcattgtggcgggtgcctccgcctacacccgccactacgactatgcccgcatgcgcgccatcgccgacaaggtgggcgcctggctgctggcggacatggcgcacatcagtggcctggtggcggcggacctggtgccctcgcccttcggcttcgcggacgtggtcaccaccaccactcacaagtccctgcgcggtccccgcggcgccatgatcttctaccgcaagggtgtgcgccgcacggacgccaagaccggcaagcccatcaactacgacatcgaggacaagatcaacttcgccgtgttccccggcctgcagggtggcccccacaaccacaccatcgccggtctggcctgcgcgctgaagcaggcggccacccctgagttcaagtcctaccagcagcaggtgctgtccaacagccaggccctggccggcgccctggccaagcgcggcttcaagctggtgtcgggcggcaccgacaaccacatcgtgctggtggacctgcggccaaagggcgtcgacggcagccgcgtggagcgtgtgctggagctggcgcacatcgccgccaacaagaacactgtgcccggcgacgtgagcgcgctggtgcccggcggcctgcgcatgggctcgcctgccctcacctcgcgcggctttgtggagaaggacttcgagcaggtggctgagtttgtggaccgcgccgtgaacatcgcggtggacctcaagaagaagtaccccaagctcaaggagttccgcgaggccatggccaaggagtccacccccgacatcaacgcgctgaagaaggacgtggagaccttcgcgatgcgcttccccacgataggcttcgacaaggccgccatgcgctacaagaactaagcagcgcatcggatgtccatcagcttcccgtgggttttggaccgtctgccttcttgagtgctagtagcgaaagaagaataagttgcgtgtattggcgtgggcactgtttcgcacgtcgcaaaaccggtggcgctttttggtgggataagtgagtccaagtaggagtcgcggttaagctctgttgtaggagtggttaacagtgtgttggccccggtaggggtgtgttagcttcacgcgtcggtctgttggtgaacggagggtggcgctttcgagtcgaaccggcactgtcccagcacgggtaacaatgaacccctgtttgtcagggcccggaaaggtttgcatgtgtgtgatcgggatcgcgcttcagtggagggttttgtctcctcaactccacctgtaacgcgcgcaaccctgaaaaaaaaaaaaaaaaaaaaaaaaaaaaaaaaaaa

SEQ ID NO: 9254 - protein, 520 aa, Chlamydomonas reinhardtii
MQRTVQGISQLARALSSAHAVAGQRCFAAQPALSNEEEYSRFSQDASRAHVTWPKVLNAGLAEVDPDLFDIIEKEKNRQFKGLELIPSENFVSASVMEAVGSVMTNKYSEGYPGARYYGGNEFIDQAERLCQERALKAFHLDPAQWGVNVQSLSGSPSNFQVYTALLQPHDRIMALDLPHGGHLSHGYQTDTKKISATSIYFEQMPYRLNEETGLIDYDMLEKTAVLFRPKLIVAGASAYTRHYDYARMRAIADKVGAWLLADMAHISGLVAADLVPSPFGFADVVTTTTHKSLRGPRGAMIFYRKGVRRTDAKTGKPINYDIEDKINFAVFPGLQGGPHNHTIAGLACALKQAATPEFKSYQQQVLSNSQALAGALAKRGFKLVSGGTDNHIVLVDLRPKGVDGSRVERVLELAHIAANKNTVPGDVSALVPGGLRMGSPALTSRGFVEKDFEQVAEFVDRAVNIAVDLKKKYPKLKEFREAMAKESTPDINALKKDVETFAMRFPTIGFDKAAMRYKN

SEQ ID NO: 9255 - DNA, 1933 bp, Arabidopsis thaliana
  CDS (104)..(1657)
aactccaatgctcacttatacagaagctgagaagcagaaccgcttttatataatcgcactcactcagagaaacagagaagacgatagatagagaaaaaaaaaaatggcgttggctcttcgtagactctcctcttccgttaagaaaccgatctcgcttctctcctctaatggcggttcactccgtttcatgtcgtctttatcaaccgcagctatggcggaatcggagaaatctcgttctagttggattaagcaattgaatgcatctctagatgaaatcgatcctgaagttgcggatattatcgaattagagaaggctagacaatggaagggatttgaacttataccgtcagagaatttcacttctctatctgtgatgcaagccgttggttctgttatgactaataagtatagtgaaggataccctggagctagatactatggaggaaatgagtacattgacatggctgagacattatgtcaaaaacgcgcattagaagcttttcagttagatccttctaaatggggagtcaatgtgcagtctttatcaggatcaccagctaatttccaagtttacactgcattgttgaagcctcatgaaagaatcatggcacttgatttacctcatggtggacatctttctcatggttatcagactgacacgaagaaaatatcggctgtatccatcttttttgagacaatgccatacagattggatgagaacactggttacattgattatgaccagctagaaaagagtgccgtgcttttcagaccgaaacttattgttgcgggtgcaagtgcttatgctcgtctatatgactatgcacgtattcgtaaggtctgtaacaagcaaaaggcagttatgttggctgatatggctcatattagtgggttggttgctgctggcgttattccttctccttttgagtatgcagatgttgttacgactacaactcacaaatcgcttcgcggtcctagaggggctatgatattctttaggaaggggttaaaagagattaacaaacaagggaaagaggtcatgtatgactatgaggacagaattaatcaagctgtttttcctggactgcaaggtggtccacataatcacactataacgggtctagcagttgctctgaagcaggcaagaactcctgagtacaaggcctaccaggatcaagttctccgtaattgctcaaagtttgctgagactttgcttgcgaaaggatatgatttagtgtctggaggcactgataatcatttagttttggtgaatctgaaaaacaagggaatagatggatcaagagtggaaaaagtattagaattagtacatattgcagcaaacaagaatactgttcctggtgatgtttctgccatggttcccggtggcatccatatgggaacaccagccctcacatcaagaggattcattgaggaagattttgcaaaagtggcggagtattttgatttagccgtcaagatagccttaaagatcaaagcagagtctcaaggaacaaagttgaaagactttgtagcaacaatgcaatcaaatgagaaattacagtcagagatgtcaaagctccgtgagatggtagaagaatatgctaagcaattcccaacgattgggttcgagaaagagacgatgagatacaaagagtagttttcatcgtgtggattgacacgtttccacatctctgagatgctttagtgatcatggaccagaggcgcaaccgatggtctgaagtatcgctgaaactaaagttgaactaaaaaaatcgcactccaatgttgtctcttaccctttccttttgtctctcaaattttatctttgcttccttaagttggttcctcaaaattcaaaatttgtaatgcaactggtttaaggttgctatgatggataatggcaactaaagttataggaaaaaaaaaaaaaaaa

SEQ ID NO: 9256 - protein, 517 aa, Arabidopsis thaliana
MALALRRLSSSVKKPISLLSSNGGSLRFMSSLSTAAMAESEKSRSSWIKQLNASLDEIDPEVADIIELEKARQWKGFELIPSENFTSLSVMQAVGSVMTNKYSEGYPGARYYGGNEYIDMAETLCQKRALEAFQLDPSKWGVNVQSLSGSPANFQVYTALLKPHERIMALDLPHGGHLSHGYQTDTKKISAVSIFFETMPYRLDENTGYIDYDQLEKSAVLFRPKLIVAGASAYARLYDYARIRKVCNKQKAVMLADMAHISGLVAAGVIPSPFEYADVVTTTTHKSLRGPRGAMIFFRKGLKEINKQGKEVMYDYEDRINQAVFPGLQGGPHNHTITGLAVALKQARTPEYKAYQDQVLRNCSKFAETLLAKGYDLVSGGTDNHLVLVNLKNKGIDGSRVEKVLELVHIAANKNTVPGDVSAMVPGGIHMGTPALTSRGFIEEDFAKVAEYFDLAVKIALKIKAESQGTKLKDFVATMQSNEKLQSEMSKLREMVEEYAKQFPTIGFEKETMRYKE

SEQ ID NO: 9257 - DNA, 1590 bp, Arabidopsis thaliana
  CDS (1)..(1590)
atgcaagcttgttgtggtggtaattcgatggcttctcttcagcaacctggacgggttcaaggatctgtctttcccccaattatgcctccagtgaccaaattttctcagcagttgaagttcaatatttcaaaacctttccgttcttcatttctgaaaagaaacctggtctctgaaatgagagcatcttcagtctcgctacctaatgtcgagataagcagcaaagaaatcccttttgaggactatggtcttggtgaagttgatccagaggtccgaaccatcatcacaaaggagaaagatagacaattcaggagcttggagcttattgcatctgagaatttcacgtctcgagcagttatggaggcggttggctcatgccttaccaacaagtattctgagggactgcctggtaaaagatattatggtggcaatgagtacattgatcagttggagacgctttgccagaaccgggctttggcagccttccgcttagattctacgaaatggggggttaatgttcagccgttatctggttcacctgcaaactttgctgtctacactgcgatacttagccctcatgatcggatcatgggtttggatttacctcacggtggtcatctgtcgcatgggttcatgaccgctaaaaggcgtgtatctggaacttcaatatactttgagtccatgccttatcgacttgatgaatcaacaggcattgttgactacgatatgctcgagaaaactgctacacttttcagaccaaagcttattatcgcaggagctagtgcatacagccgagattttgactatcctcgcatgaggaagatcgcagactcagttggtgcttttctgatgatggatatggctcatatcagtgggcttgtggctgcttctgtggtagctgacccttttgagtattgtgatattgttacaacaacaactcacaagtctttgagaggtccgagaggtggcatgatcttcttcaggaaggatccaattaatggggttgatcttgaatctgccgtgaacaatgctgtcttccctggtttgcagggtggccctcataaccacacaattggaggattagcagtctgcttgaaacacgcacaatcaccggaattcaaggcgtaccagaaaagagttgtgtctaactgtagagctctagctaaccgattggttgaactcgggtttaagctagtttctggtggcagcgataaccacttggttctcgtcgatcttagacccatgggtatggatggtgcgcgggttgagaaaatcttagacatggcatctattactctcaacaagaactctgtccctggggacaaaagtgcgttggtaccagggggaataaggataggatcccccgcgatgacgacaagaggactgtcagagaaagactttgtagtagtggctgacttcatcaaggaaggtgtggagataacaatggaagccaagaaagccgcgccgggttcaaagcttcaagatttcaacaagttcgtgacatctcctgagtttccattgaaagagagagtgaagagtctaacggagagagtggaaaccttcacatctcgttttcccattcctggcgtttaa

SEQ ID NO: 9258 - protein, 529 aa, Arabidopsis thaliana
MQACCGGNSMASLQQPGRVQGSVFPPIMPPVTKFSQQLKFNISKPFRSSFLKRNLVSEMRASSVSLPNVEISSKEIPFEDYGLGEVDPEVRTIITKEKDRQFRSLELIASENFTSRAVMEAVGSCLTNKYSEGLPGKRYYGGNEYIDQLETLCQNRALAAFRLDSTKWGVNVQPLSGSPANFAVYTAILSPHDRIMGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLTERVETFTSRFPIPGV

SEQ ID NO: 9259 - DNA, 1828 bp, Arabidopsis thaliana
  CDS (61)..(1797)
atggatttgagtcgttctcaaacaaattttcaattagggtttggttgttcacacgcatcaatgactccaacaccaacaccaagagctccaatcgcagacgattcgattaatctacaagtcgatcaaagtttccgatcattaccaacaactttctctccgattccgttacaattactcgaacaaaaagccgagaagaccaccaccgttgatgagccaaagaaagatggaggaggaggaggagatcaaaaggaagacgagcatttcagaatcttaggtcaccatatgtgtctcaaaaggcaaagagattgtccacttttgttaacgcaatcaaagcatccgaagagaagttccatcggtgattcagatctggaatcgcgacgtgctgctgtacgagcttggggtgatcaaccgattcatttggcggatcctgatattcatgagcttatggagaaagagaagcaacgacaagtaagaggaattgaattgattgcttctgagaatttcgtgtgtagagctgtaatggaagctttaggtagtcatttaacgaataaatactctgaaggtatgcctggagctagatactatactgggaatcaatatattgatcagattgagaatctctgtattgagcgtgctcttactgcgtttggtcttgaatctgataaatggggtgttaatgttcagccttattcttgtacttctgctaacttcgcggtgtataccggacttttattgcccggtgaacggattatggggcttgattcgccttctggtggtcatatgagtcatggttattgtactcctggtgggaagaagatttcggctgcttccatcttctttgagagttttccttataaagtgaatcctcaaactgggtatattgattatgataagcttgaagataaggcgcttgattaccgtcctaagattcttatttgtggtgggagttcttatcctagggattgggattttgcaagggttagacagattgcagataagtgtggagctgttttgatgtgtgatatggctcatattagcggtcttgttgcaactaaggaatgttcaaatccatttgatcactgtgacatagtaacctccactactcacaaaggtctacgtggtcctagaggaggtatcatcttctacaggagaggcccaaagataagaaagcagggccatcactctagccattgtgacacttccacgcattacgatctagaggaaaagatcaactttgctgtttttccatctctacaaggaggtccacacaacaaccatatcgctgctcttgccattgcattgaaacaagtggccactccagagtacaaagcttacatacaacagatgaagaaaaacgcccaagctttagcagcagctcttcttagaagaaaatgcagactggttactggtggtacagacaaccatttgttgctgtgggatctcactcctatgggcttaacagggaaagtctacgagaaagtgtgtgagatgtgccatatcactttaaacaagacggctatattcggggacaatggtacaatatctcctggaggtgtaagaatagggacacctgcaatgacaacccgaggctgtatagagtctgatttcgagacaatggcggattttctgataaaggcggctcagataacaagtgcgttgcagagagagcatggaaagtcacacaaggagtttgtgaaaagtttatgcaccaacaaagacatagctgagcttagaaaccgagtcgaagcatttgctttgcagtatgagatgcctgcttctcttattcgaattgaatgaaagaaaactccacacaacagctttatttaca

SEQ ID NO: 9260 - protein, 578 aa, Arabidopsis thaliana
MTPTPTPRAPIADDSINLQVDQSFRSLPTTFSPIPLQLLEQKAEKTTTVDEPKKDGGGGGDQKEDEHFRILGHHMCLKRQRDCPLLLTQSKHPKRSSIGDSDLESRRAAVRAWGDQPIHLADPDIHELMEKEKQRQVRGIELIASENFVCRAVMEALGSHLTNKYSEGMPGARYYTGNQYIDQIENLCIERALTAFGLESDKWGVNVQPYSCTSANFAVYTGLLLPGERIMGLDSPSGGHMSHGYCTPGGKKISAASIFFESFPYKVNPQTGYIDYDKLEDKALDYRPKILICGGSSYPRDWDFARVRQIADKCGAVLMCDMAHISGLVATKECSNPFDHCDIVTSTTHKGLRGPRGGIIFYRRGPKIRKQGHHSSHCDTSTHYDLEEKINFAVFPSLQGGPHNNHIAALAIALKQVATPEYKAYIQQMKKNAQALAAALLRRKCRLVTGGTDNHLLLWDLTPMGLTGKVYEKVCEMCHITLNKTAIFGDNGTISPGGVRIGTPAMTTRGCIESDFETMADFLIKAAQITSALQREHGKSHKEFVKSLCTNKDIAELRNRVEAFALQYEMPASLIRIE

SEQ ID NO: 9261 - DNA, 1716 bp, Arabidopsis thaliana
  CDS (68)..(1483)
ctctgatctcagatctctccctccctctttctccgatctcagatccattcaacaatctacaaagaagatggaaccagtctcttcatggggtaacacctctctcgtctccgtagatccagagatccacgacctaatcgagaaggagaaacgtcggcaatgtcgaggaatcgaacttatcgcttccgagaatttcacttccttcgccgtcatcgaagctctcggaagggccttaaccaacaaatactccgaaggtattcctggtaatcgttattacggaggtaacgaattcatcgatgagatcgagaatctttgccgtccaagagctctcgaagctttccattgtgatccagcagcgtggggcgttaatgttcagccgtattctggatctccggcaaatttcgctgcttacacggctttgcttcagcctcacgatcgtatcatggggcttgatttgccttcaggtggtcatttgactcatggttactatacatctggtggtaagaagatctctgcgacttcgatctactttgagagtcttccgtataaggtgaatttcaccactggttacattgattacgataagcttgaagagaaggcgttggatttcaggcctaagttgcttatctgtggtggtagtgcgtatcctagggattgggattacgctagatttagagctattgctgataaggttggagctcttttgctttgtgacatggctcacatcagtggtctcgttgctgctcaggaagctgcaaacccatttgagtactgtgacgttgtgacaaccacaacccacaagagtttgaggggtccaagggctggtatgattttctacaggaagggtccaaaaccaccaaagaagggtcaacccgagggtgcagtctatgattttgaggacaaaatcaactttgctgtattccctgcgcttcaaggtggtcctcacaatcaccagattggtgctctagctgttgcgttgaagcaggctaatactcctgggttcaaggtctacgcaaaacaagtgaaagccaatgctgttgcccttggaaactacctaatgagcaagggttaccagattgtgaccaatggaactgagaaccaccttgttctctgggatcttcgccctcttggattgaccggaaacaaggttgagaagctctgcgatctgtgcagcattacattgaacaagaacgcagtatttggagacagtagtgctcttgctcctggaggtgtaagaatcggtgcacccgcgatgacatcgagaggattggtggagaaggactttgagcagataggagaattcctgagccgtgcagtgacactgacgttggacatccaaaagacatacggtaagttgttgaaggacttcaacaagggtttggtgaacaacaaagatctcgatcagctcaaggctgatgtcgagaagttctcggcgtcttatgagatgcctggattcctcatgtctgagatgaagtacaaggattagagatctttctctatatgcaagagtaatcttctattattatctaccatatatataaaatatgcttttgtaggatcgccttaaaggcgaagagatgaagatgcaaacagtaaaaaaaaagggttttcttttcagctatttcttcttgaatgttttttttctttttcttttggtttcttattgaaattgttgtatttttgttggcttttttctaataatatcagcgagtttttcct

SEQ ID NO: 9262 - protein, 471 aa, Arabidopsis thaliana
MEPVSSWGNTSLVSVDPEIHDLIEKEKRRQCRGIELIASENFTSFAVIEALGRALTNKYSEGIPGNRYYGGNEFIDEIENLCRPRALEAFHCDPAAWGVNVQPYSGSPANFAAYTALLQPHDRIMGLDLPSGGHLTHGYYTSGGKKISATSIYFESLPYKVNFTTGYIDYDKLEEKALDFRPKLLICGGSAYPRDWDYARFRAIADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALGNYLMSKGYQIVTNGTENHLVLWDLRPLGLTGNKVEKLCDLCSITLNKNAVFGDSSALAPGGVRIGAPAMTSRGLVEKDFEQIGEFLSRAVTLTLDIQKTYGKLLKDFNKGLVNNKDLDQLKADVEKFSASYEMPGFLMSEMKYKD

SEQ ID NO: 9263 - DNA, 1389 bp, Arabidopsis thaliana
  CDS (1)..(1389)
atgactgaatatctaggcaaagaaatcccttttgaggactatggtcttggtgaagttgatccagaggtccgaaccatcatcacaaaggagaaagatagacaattcaggagcttggagcttattgcatctgagaatttcacgtctcgagcagttatggaggcggttggctcatgccttaccaacaagtattctgagggactgcctggtaaaagatattatggtggcaatgagtacattgatcagttggagacgctttgccagaaccgggctttggcagccttccgcttagattctacgaaatggggggttaatgttcagccgttatctggttcacctgcaaactttgctgtctacactgcgatacttagccctcatgatcggatcatgggtttggatttacctcacggtggtcatctgtcgcatgggttcatgaccgctaaaaggcgtgtatctggaacttcaatatactttgagtccatgccttatcgacttgatgaatcaacaggcattgttgactacgatatgctcgagaaaactgctacacttttcagaccaaagcttattatcgcaggagctagtgcatacagccgagattttgactatcctcgcatgaggaagatcgcagactcagttggtgcttttctgatgatggatatggctcatatcagtgggcttgtggctgcttctgtggtagctgacccttttgagtattgtgatattgttacaacaacaactcacaagtctttgagaggtccgagaggtggcatgatcttcttcaggaaggatccaattaatggggttgatcttgaatctgccgtgaacaatgctgtcttccctggtttgcagggtggccctcataaccacacaattggaggattagcagtctgcttgaaacacgcacaatcaccggaattcaaggcgtaccagaaaagagttgtgtctaactgtagagctctagctaaccgattggttgaactcgggtttaagctagtttctggtggcagcgataaccacttggttctcgtcgatcttagacccatgggtatggatggtgcgcgggttgagaaaatcttagacatggcatctattactctcaacaagaactctgtccctggggacaaaagtgcgttggtaccagggggaataaggataggatcccccgcgatgacgacaagaggactgtcagagaaagactttgtagtagtggctgacttcatcaaggaaggtgtggagataacaatggaagccaagaaagccgcgccgggttcaaagcttcaagatttcaacaagttcgtgacatctcctgagtttccattgaaagagagagtgaagagtctaaaggagagagtggaaaccttcacatctcgttttcccattcctggcgtttaa

SEQ ID NO: 9264 - protein, 462 aa, Arabidopsis thaliana
MTEYLGKEIPFEDYGLGEVDPEVRTIITKEKDRQFRSLELIASENFTSRAVMEAVGSCLTNKYSEGLPGKRYYGGNEYIDQLETLCQNRALAAFRLDSTKWGVNVQPLSGSPANFAVYTAILSPHDRIMGLDLPHGGHLSHGFMTAKRRVSGTSIYFESMPYRLDESTGIVDYDMLEKTATLFRPKLIIAGASAYSRDFDYPRMRKIADSVGAFLMMDMAHISGLVAASVVADPFEYCDIVTTTTHKSLRGPRGGMIFFRKDPINGVDLESAVNNAVFPGLQGGPHNHTIGGLAVCLKHAQSPEFKAYQKRVVSNCRALANRLVELGFKLVSGGSDNHLVLVDLRPMGMDGARVEKILDMASITLNKNSVPGDKSALVPGGIRIGSPAMTTRGLSEKDFVVVADFIKEGVEITMEAKKAAPGSKLQDFNKFVTSPEFPLKERVKSLKERVETFTSRFPIPGV

SEQ ID NO: 9265 - DNA, 1290 bp, Agrobacterium tumefaciens
  CDS (1)..(1290): transl_table=11
atgtcgaacacagatgctttcttctcccgtccgcttgccgaagtcgatccggatattttcggcgcgatcgagaaggaactgggtcgccagcgccacgagatcgaactgatcgcctcggaaaacatcgtttcccgcgctgtgcttgaagcgcagggttcgatcatgaccaacaaatatgcggaaggttatccgggcaagcgttattacggcggctgccagttcgtcgatatcgctgaagagcttgccatcgagcgcgccaagaagctgttcggcgtcaacttcgccaacgttcagccgaactccggttcgcagatgaatcaggccgtgttcctcgcgcttttgcagccgggcgataccttcatgggtctcgatctgaactcggggggccacctgacgcatggttcgccggtcaacatgtccggtaaatggttcaacgtcgtgtcctacggcgtgcgtgaaggcgacaacctgctcgacatggacgaagtggagcgcaaggccaaggaaacccggccgaagctgatccttgccggcggcaccgcctattcgcgcgtctgggactggaagcgcttccgcgagatcgccgatgaagtcggcgcctatctgatggtcgacatggcccacatcgccggtctcgttgccggtggccagcacccgtcgccgttcccgcattgccatgttgccaccaccacgacgcacaagtctctgcgcggcccgcgtggcggcatgatcctcaccaatgacgaggatctggccaagaagttcaactcggccgtattccccggcctgcagggtggcccgctgatgcatgtcatcgccgccaaggccgttgccttcggcgaagcgctgcagccggaattcaaggactatgccgcgcaggtcgtgaagaacgccaaggcgctggccgaaaccctgatcgaaggcggtctcgatgtcgtctccggcggcaccgacaaccacctgatgctggtcgatcttcgcaagaagaacgccaccggcaagcgcgcggaagcagcccttggccgcgcttacatcacctgcaacaagaacggcattcctttcgacccggaaaaacccttcgtcacgtcgggtgtccgtctcggcacgccggccggcacgacgcgcggtttcaaggaagcggaattccgcgaaatcggcaagctgatcgtcgaggttctcgacggcctgaaggttgccaattcggatgaaggtaatgcctccgtcgaggctgccgtgcgcgaaaaggtcgtcggtttgaccgaccgtttcccgatgtatccgtacatgtaa

SEQ ID NO: 9266 - protein, 429 aa, Agrobacterium tumefaciens
MSNTDAFFSRPLAEVDPDIFGAIEKELGRQRHEIELIASENIVSRAVLEAQGSIMTNKYAEGYPGKRYYGGCQFVDIAEELAIERAKKLFGVNFANVQPNSGSQMNQAVFLALLQPGDTFMGLDLNSGGHLTHGSPVNMSGKWFNVVSYGVREGDNLLDMDEVERKAKETRPKLILAGGTAYSRVWDWKRFREIADEVGAYLMVDMAHIAGLVAGGQHPSPFPHCHVATTTTHKSLRGPRGGMILTNDEDLAKKFNSAVFPGLQGGPLMHVIAAKAVAFGEALQPEFKDYAAQVVKNAKALAETLIEGGLDVVSGGTDNHLMLVDLRKKNATGKRAEAALGRAYITCNKNGIPFDPEKPFVTSGVRLGTPAGTTRGFKEAEFREIGKLIVEVLDGLKVANSDEGNASVEAAVREKVVGLTDRFPMYPYM

SEQ ID NO: 9267 - DNA, 1248 bp, Burkholderia mallei
  CDS (1)..(1248): transl_table=11
atgtttgacagagcccaaagcaccattgcgaacgtcgatcccgagatctggcaagcgattcagcaggaaaacgtccgtcaggaagagcacatcgagctgatcgcgtcggagaattacacgagcccggccgtgatggcggcgcaaggctcgcaactgacgaacaagtacgcggaaggctatccgggcaagcgctattacggcggctgcgaatacgtggacatcgtcgagcagctcgcgatcgatcgcgtgaaggcgctgttcggcgccgaagcggcgaacgtgcagccgaactcgggctcgcaggcgaaccagggcgtgttcttcgcgatgctcaagccgggcgacacgatcatgggcatgagcctcgcgcacggcggccacctcacgcacggctcgccggtgaacatgtcgggcaagtggttcaacgtcgtgagctacgggctgaacgaggctgaagacatcgattacgaagcggccgagcagctcgcgcacgagcacaagccgaagctgatcgtcgcgggcgcgtcggcgttcgcgctgaagatcgatttcgagcgcctcgcgaagatcgccaaggcagtgggcgcgtacctgatggtcgacatggcgcactacgcgggcctgatcgcggcgggtgtctatccgaacccggtgccgcacgcggatttcgtcacgacgacgacgcacaagagcctgcgcggcccgcgcggcggcgtgatcctgatgaaggccgagtacgagaagcagatcaactcggcgatcttcccgggcatccagggcggaccgctgatgcacgtgatcgccgcgaaggccgtcgcgttcaaggaagcgctgtcgccggaattcaaggaataccagcagaaggtggtcgagaacgcccgcgtgctggcgcaaacgctcgtcaagcgcggcctgcgcatcgtgtcgggccgcaccgagagccatgtgatgctggtcgacctgcgcgcgaagaacatcacgggcaaggcggcggaagcggcgctcggcaatgcgcacatcacggtcaacaagaacgcgatcccgaacgatccggagaagcccttcgtgacgagcggcgtgcgcctgggctcgccggcgatgacgacgcgcggcttcggcccgcaggaagcggagctcgtcggcaacctgatcgccgacgtgctcgagcatcccgaagacgcggcgacgatcgagcgcgtgcgtgcgcaggtcgccgagctgacgaagcgtttcccggtctatcgctga

SEQ ID NO: 9268 - protein, 415 aa, Burkholderia mallei
MFDRAQSTIANVDPEIWQAIQQENVRQEEHIELIASENYTSPAVMAAQGSQLTNKYAEGYPGKRYYGGCEYVDIVEQLAIDRVKALFGAEAANVQPNSGSQANQGVFFAMLKPGDTIMGMSLAHGGHLTHGSPVNMSGKWFNVVSYGLNEAEDIDYEAAEQLAHEHKPKLIVAGASAFALKIDFERLAKIAKAVGAYLMVDMAHYAGLIAAGVYPNPVPHADFVTTTTHKSLRGPRGGVILMKAEYEKQINSAIFPGIQGGPLMHVIAAKAVAFKEALSPEFKEYQQKVVENARVLAQTLVKRGLRIVSGRTESHVMLVDLRAKNITGKAAEAALGNAHITVNKNAIPNDPEKPFVTSGVRLGSPAMTTRGFGPQEAELVGNLIADVLEHPEDAATIERVRAQVAELTKRFPVYR

SEQ ID NO: 9269 - DNA, 1248 bp, Burkholderia thailandensis
  CDS (1)..(1248): transl_table=11
atgtttgacagagcccaaagcaccattgcgaacgtcgatcccgagatctggcaagcgatccagcaggaaaacgtccgccaggaagagcacatcgagctgatcgcgtcggagaactacacgagcccggccgtgatggcggcgcaaggctcgcagctcacgaacaagtacgcggaaggctacccgggcaagcgctattacggcggctgcgaatacgtcgacatcgtcgagcagcttgcgatcgaccgcgtgaaggcgctgttcggctccgaagccgcgaacgtgcagccgaactccggctcgcaggcgaaccagggcgtgttcttcgcgatgctcaagccgggcgatacgatcatgggcatgagcctcgcgcatggcggccacctgacgcacggctcgcccgtcaacatgtcgggcaaatggttcaacgtcgtgagctacggcttgaacgagaacgaagacatcgactacgaagccgccgataagcttgcgcacgagcacaagccgaagctgatcgtcgccggcgcttcggcgtttgcgctgaagatcgatttcgagcgtctcgcgaagatcgcgaaggcggtcggcgcgtacctgatggtcgacatggcgcactacgcgggcctcatcgccgctggcgtctacccgaacccggtgccgcacgccgatttcgtcacgacgacgacgcacaagagcctgcgcggcccgcgcggcggcgtgatcctgatgaaggccgagtacgagaagcagatcaactcggcgatcttcccgggcatccagggcggtccgctgatgcacgtgattgcggcgaaggccgtcgcgttcaaggaagcgctgtcgccggaattcaaggaataccagcagaaggtgatcgagaacgcgcgcgtgctggccgagacgctcgtcaagcgcggcctgcgcatcgtgtcgggccgcaccgaaagccacgtgatgctcgttgacctgcgcgcgaagaacattaccggcaaggccgcggaagcggcgctcggcaatgcgcacatcacggtcaacaagaacgcgatcccgaacgatccggagaagccgttcgtgacgagcggcgtgcgtctcggctcgcccgcgatgacgacgcgcggcttcggtccgcaggaagccgaactggtcggcaacctgatcgccgacgtgctcgagcatccggaagacgcggcgacgatcgagcgcgtgcgcgcgcaggtcgccgacctgaccaagcgtttcccggtctatcgctga

SEQ ID NO: 9270 - protein, 415 aa, Burkholderia thailandensis
MFDRAQSTIANVDPEIWQAIQQENVRQEEHIELIASENYTSPAVMAAQGSQLTNKYAEGYPGKRYYGGCEYVDIVEQLAIDRVKALFGSEAANVQPNSGSQANQGVFFAMLKPGDTIMGMSLAHGGHLTHGSPVNMSGKWFNVVSYGLNENEDIDYEAADKLAHEHKPKLIVAGASAFALKIDFERLAKIAKAVGAYLMVDMAHYAGLIAAGVYPNPVPHADFVTTTTHKSLRGPRGGVILMKAEYEKQINSAIFPGIQGGPLMHVIAAKAVAFKEALSPEFKEYQQKVIENARVLAETLVKRGLRIVSGRTESHVMLVDLRAKNITGKAAEAALGNAHITVNKNAIPNDPEKPFVTSGVRLGSPAMTTRGFGPQEAELVGNLIADVLEHPEDAATIERVRAQVADLTKRFPVYR

SEQ ID NO: 9271 - DNA, 1260 bp, Colwellia psychrerythraea
  CDS (1)..(1260): transl_table=11
atgtttactcgtgatatgaatattgctacttttgatccagaactttttgaagcaatgagcaatgaagttgttcgccaagaagagcacattgaattaattgcatctgaaaactactgtagcccgcgcgttcttgaagcacaaggctcacaacttactaacaaatacgctgaaggttaccctggcaagcgttactacggtggttgtgaatatgttgatatcgctgagcaattagcgattgatcgtgctaaagaattatttggtgctacttatgccaacgttcagcctcatgctggttcacaagctaacgcagctgtttttcaagctttagttacaccaggcggtaaagtattaggcatgagcttagctcatggcggtcacttaactcatggttcacatgtaagcttctctggtaagtcttacgaagcgttccaatatggtcttcaccctgaaacaggcgatattgactatgaagaattagaacgtttagctgtagagcacaaaccagaaatgattatcggtggtttctcagcattctcaggtgttgttgactgggcacgtatgcgtacaattgctgataaagttggcgcttacttcttcgtagatatggctcacgttgcgggtttaattgctgcaggtctttaccctaacccagttccacatgcgcatgttgttactacaactacgcataaaacattagctggcccacgtggcggtttaattatctctggttgtgatgacgaagctatttacaaaaagttaaacagcgctgttttcccaggtggtcaaggtggcccattaatgcacattattgcagcgaaagccgttgcatttaaagaagcattatcgccagagtttaaagtttaccaacaaaatgttttagctaacgctttagcaatggtagatgtattacaagaccgtggttataaagtagtatctaacggtacgcaaaaccacttattgttacttgatttaatcgataaagatattactggtaaagatgctgatgccgctttaggtaaagcacacatcacagtaaacaaaaactcagtgccaaacgatcctcgttctccgtttgttacatcaggtctacgtttaggtactccagcgattactcgtcgtggttttggtatcgaagaaactaaggcattaactggctggatttgtgacattcttgatgatattgaaaatgaagacgttagcaaacgtgttcaagaccaagttaaagagttatgtgctcgtttccctgtttaccaaaagtag

SEQ ID NO: 9272 - protein, 419 aa, Colwellia psychrerythraea
MFTRDMNIATFDPELFEAMSNEVVRQEEHIELIASENYCSPRVLEAQGSQLTNKYAEGYPGKRYYGGCEYVDIAEQLAIDRAKELFGATYANVQPHAGSQANAAVFQALVTPGGKVLGMSLAHGGHLTHGSHVSFSGKSYEAFQYGLHPETGDIDYEELERLAVEHKPEMIIGGFSAFSGVVDWARMRTIADKVGAYFFVDMAHVAGLIAAGLYPNPVPHAHVVTTTTHKTLAGPRGGLIISGCDDEAIYKKLNSAVFPGGQGGPLMHIIAAKAVAFKEALSPEFKVYQQNVLANALAMVDVLQDRGYKVVSNGTQNHLLLLDLIDKDITGKDADAALGKAHITVNKNSVPNDPRSPFVTSGLRLGTPAITRRGFGIEETKALTGWICDILDDIENEDVSKRVQDQVKELCARFPVYQK

SEQ ID NO: 9273 - DNA, 1251 bp, Photobacterium profundum
  CDS (1)..(1251): transl_table=11
atgctaaagcgcgatatgaatattgccgactatgatgcggaactttttgcagccattcaggaagaaacagcacgtcaagaagagcacatcgagttgatcgcttctgaaaactacacaagcccacgtgtaatggaagctcaaggatctcagctgactaacaaatatgctgaaggttacccaggtaagcgttattacggtggttgtgagtttgttgataaagcagaacaactagcgattgatcgtgcatgtcagctttttggtgctgaatacgcgaacgtacagcctcattctggttctcaagctaacaacgccgtttacatggcactactaaatccaggcgacactgtattaggtatgagccttgctcacggtggtcacttgactcacggttctccagtaaacttttctggtaagttatacaacatcatcccttacggcatcgatgaaactggtcagatcgattacgaagaaatggaagcattggcgttagagcacaaacctaagatgattatcggtggtttctctgcgtactctcaggttgttgactggaaacgcatgcgtgaaatcgctgataaagtgggcgcatacttcttcgttgatatggctcacgttgcgggtcttattgcggcaggtgtttaccctaacccagttccccacgcccatgttgtcacaacaacaacgcataaaacattagccggtcctcgtggcggtctaattttgtctaatgacggcgaagctctttataagaagttgaattcagcggtattccctggtggtcagggtggtcctctaatgcatgttatcgcagcaaaagcggtagccttcaaagaagcaatggaacctgaattcaaagtttatcaagcttgtgttgttgaaaatgcgaaagcaatggttggcgagttcttagaacgcggttacaagattgtatctggtagcactgagaatcacttgttccttgttgatttaatcgacaaaggcatcacaggtaaagaagcggatgccgcactgggtgctgctaacattaccgttaacaaaaacagcgttccaaacgatccacgtagcccgtttgtaacgtctggtattcgtattggtacaccatcaatcactcgccgcggtttcacggttgaagatacaaagcagcttgctggttggatttgtgatgtacttgataacacagataaacctgaagttatcgaagcaacgaaagcgaaagtattagaaatttgtaagcgcttacctgtatacgcttaa

SEQ ID NO: 9274 - protein, 416 aa, Photobacterium profundum
MLKRDMNIADYDAELFAAIQEETARQEEHIELIASENYTSPRVMEAQGSQLTNKYAEGYPGKRYYGGCEFVDKAEQLAIDRACQLFGAEYANVQPHSGSQANNAVYMALLNPGDTVLGMSLAHGGHLTHGSPVNFSGKLYNIIPYGIDETGQIDYEEMEALALEHKPKMIIGGFSAYSQVVDWKRMREIADKVGAYFFVDMAHVAGLIAAGVYPNPVPHAHVVTTTTHKTLAGPRGGLILSNDGEALYKKLNSAVFPGGQGGPLMHVIAAKAVAFKEAMEPEFKVYQACVVENAKAMVGEFLERGYKIVSGSTENHLFLVDLIDKGITGKEADAALGAANITVNKNSVPNDPRSPFVTSGIRIGTPSITRRGFTVEDTKQLAGWICDVLDNTDKPEVIEATKAKVLEICKRLPVYA

SEQ ID NO: 9275 - DNA, 1254 bp, Pseudomonas aeruginosa
  CDS (1)..(1254): transl_table=11
atgttcagcaagcatgaccagatccgcggctacgacgacgaactgctcgccgcgatggacgccgaagaggcccgccaggaagaccatctcgaactgatcgcctcggagaactacaccagcaagcgggtcatgcaggcgcagggcagcggcctgaccaacaagtatgccgagggctatccgggcaagcgctactacggcggctgcgaacacgtcgacaaggtcgagcggctggccatcgaccgcgccaggcaactgttcggcgccgactacgccaacgtccagccgcactccggttcctcggccaacgctgcggtgtacctggcgctgctcaacgccggcgacaccatcctcggcatgagcctggcccacggcggccatctcacccacggcgccaaggtgtcctcctccggcaagctttacaacgccgtgcagtacggcctggacaccgctaccgggctgatcgactacgacgaagtcgagcgcctggccgtggagcataagccgaagatgatcgtcgccggcttctccgcctactccaagaccctcgacttcccgcgcttccgcgccatcgccgacaaggtcggcgcgctgctgttcgtcgacatggcccacgtcgccgggctggtcgccgccggcctctacccgaacccgatccccttcgccgacgtggtcaccaccaccacccacaagaccctgcgcggcccgcgcggcggcctgatcctggcgcgcgccaacgaggagatcgagaagaagctcaactccgcggtatttcccggcgcccagggcggcccgctgatgcacgtgatcgcggccaaggcggtgtgcttcaaggaagcgctggagccgggcttcaaggactaccaggcgcaggtgatccgcaacgccaaggcgatggccgaggtgttcatcgggcgcggctacgacgtggtttccggtggcaccgacaaccacctgatgctgatcagcctggtgcgccagggcctgaccggcaaggaagccgacgccgccctcggccgggtcggcatcacggtgaacaagaacgccgtgccgaacgatccgcagagcccgttcgtcacctccggcatccgcatcggcaccccggccatcaccacccgcgggctgcaggaagcgcagagccgcgaactggccggctggatctgcgacatcctcgaccacctcggcgatgccgacgtggaggccaaggtcgccacccaggtcgccggtctctgcgcggacttcccggtctatcgctga

SEQ ID NO: 9276 - protein, 417 aa, Pseudomonas aeruginosa
MFSKHDQIRGYDDELLAAMDAEEARQEDHLELIASENYTSKRVMQAQGSGLTNKYAEGYPGKRYYGGCEHVDKVERLAIDRARQLFGADYANVQPHSGSSANAAVYLALLNAGDTILGMSLAHGGHLTHGAKVSSSGKLYNAVQYGLDTATGLIDYDEVERLAVEHKPKMIVAGFSAYSKTLDFPRFRAIADKVGALLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVRQGLTGKEADAALGRVGITVNKNAVPNDPQSPFVTSGIRIGTPAITTRGLQEAQSRELAGWICDILDHLGDADVEAKVATQVAGLCADFPVYR

SEQ ID NO: 9277 - DNA, 1239 bp, Pseudomonas fluorescens
  CDS (1)..(1239): transl_table=11
atgagcctgcaaaatttcgaccccgccattgcccgcctgatcgaccgcgaacgcaatcgccaggaaactcacctggaactgatcgcctcggaaaactacgtcagtgaagaagtgctccaggcccagggctcgctgctcaccaacaagtacgccgaaggctatccgggccggcgctattacggcggctgcaaggtcgtcgacgagatcgagaacctggccatcgaacgcgcccgcaaactgttcggttgcgagtacgtcaacgtccagccgcactctggttcacaggccaatcaggcggtgttcctggcggtgcttgagcccggcgacaggatactgggcatgtccctggcccacggcgggcacctgacccacggtgcctcggtgaatttctccgggaagtttttccaggccttcacctatgggctggagaaggacagcgaaaccctcgactacgatcagatggaagacctggcccgcgaacaccggccgaagatgatcatcgccggcgcttcagcctattcgcgcgtcatcgacttcccgcgctttcgcaaaatctgcgatgaaatcggcgcttacctgatggtcgacatggcccactacgccggtctcatcgcggcgggcgtgtacccttcgccggtgggcatcgccgacttcatcacctcgaccacgcacaagaccctgcgcggcccgcgcggcggcctgattctggccaaggccgaatacgctgccgtgctcgacaagacgatcttcccggtttatcagggcggcccgctgatgcacgtgatcgccgccaaggctgtggcgttcaacgaagctctgggcgacgagttcaagcattaccagcaacgggtgatcaacaacgcccggaccatggccgacgtgctgacccgacgcggattgcgcgtggtgtccggcggcaccgactgccacatgttcctgctcgacctgcgcgcgatgaacatcaccggcaaggacgccgaagccctgctggaaagcgctcacatcacgctgaacaagaacgcgatccccgatgacccgcagaaaccggcgatcaccagcggcatccgcatcggcacgccggcactgaccactcgcggtttcggtgaggccgaatgcgccgaagtggccaacctgatcgccgacctgctggagcaaccggacaacaccgcgcgggtggaaaacatccgccgtcgagtgatgcacctgtgcgaatgctttccggtgtacctgctgacgtga

SEQ ID NO: 9278 - protein, 412 aa, Pseudomonas fluorescens
MSLQNFDPAIARLIDRERNRQETHLELIASENYVSEEVLQAQGSLLTNKYAEGYPGRRYYGGCKVVDEIENLAIERARKLFGCEYVNVQPHSGSQANQAVFLAVLEPGDRILGMSLAHGGHLTHGASVNFSGKFFQAFTYGLEKDSETLDYDQMEDLAREHRPKMIIAGASAYSRVIDFPRFRKICDEIGAYLMVDMAHYAGLIAAGVYPSPVGIADFITSTTHKTLRGPRGGLILAKAEYAAVLDKTIFPVYQGGPLMHVIAAKAVAFNEALGDEFKHYQQRVINNARTMADVLTRRGLRVVSGGTDCHMFLLDLRAMNITGKDAEALLESAHITLNKNAIPDDPQKPAITSGIRIGTPALTTRGFGEAECAEVANLIADLLEQPDNTARVENIRRRVMHLCECFPVYLLT

SEQ ID NO: 9279 - DNA, 1254 bp, Pseudomonas putida
  CDS (1)..(1254): transl_table=11
atgttcagcaagcaagaccagatccagggttacgacgacgcactgctggcggcgatgaatgccgaagaacagcgccaggaagatcacatcgagctgatcgcctcggagaactacaccagcaagcgcgtcatgcaggcccaaggcagcggcctcaccaacaaatacgccgaaggctacccgggcaagcgctactacggtggctgcgagcacgtggacaaggtagaagccctggccatcgagcgcgccaagcagctgttcggtgccgactacgccaacgtccagccgcactccggctcgtcggccaacggcgcggtctacctggccctgctgcaggccggtgacaccatcctcggcatgagcctggcccacggcggccacctgacccacggcgccaaagtgtcgtcctcgggcaagctgtacaacgctgtgcaatacggcatcgacaccaacaccggcctgatcgactacgacgaagtcgagcgcctggcggtcgagcacaagccgaaaatgatcgttgccggtttctcggcttactccaagaccctcgacttccctcgcttccgcgccatcgccgacaaggtcggtgcgctgctgttcgtcgacatggcccacgttgccggcctggttgccgctggcctgtacccgaacccgatcccgttcgccgacgtggtcaccaccaccacccacaagaccctacgtggcccgcgtggtggcctgatcctggcgaagtccaacgaagagatcgagaagaagctcaacgccgctgtattcccaggcgcccagggcggcccgttgatgcacgtcatcgccgccaaggccgtgtgcttcaaggaagcgctggagccaggcttcaaggcctaccagcagcaagtgatcgaaaacgcccaggccatggcccaggtgttcatcgaccgtggctacgacgtggtgtctggtggcaccgacaaccacctgttcctggtcagcctgatccgtcagggccttaccggtaaagatgccgacgccgccctgggccgcgcgcacatcaccgtcaacaagaacgccgtgccgaacgacccgcagtcgccgttcgtcacctcgggcctgcgcatcggcaccccggccgtcaccacccgtggcttcaaggtcgcccagtgcgtggccctggccggctggatctgcgacatcctcgacaacctcggtgacgcagacgtcgaagccgatgtggcgaagaacgtcgcggcgctgtgcgcagatttccctgtttaccgctga

SEQ ID NO: 9280 - protein, 417 aa, Pseudomonas putida
MFSKQDQIQGYDDALLAAMNAEEQRQEDHIELIASENYTSKRVMQAQGSGLTNKYAEGYPGKRYYGGCEHVDKVEALAIERAKQLFGADYANVQPHSGSSANGAVYLALLQAGDTILGMSLAHGGHLTHGAKVSSSGKLYNAVQYGIDTNTGLIDYDEVERLAVEHKPKMIVAGFSAYSKTLDFPRFRAIADKVGALLFVDMAHVAGLVAAGLYPNPIPFADVVTTTTHKTLRGPRGGLILAKSNEEIEKKLNAAVFPGAQGGPLMHVIAAKAVCFKEALEPGFKAYQQQVIENAQAMAQVFIDRGYDVVSGGTDNHLFLVSLIRQGLTGKDADAALGRAHITVNKNAVPNDPQSPFVTSGLRIGTPAVTTRGFKVAQCVALAGWICDILDNLGDADVEADVAKNVAALCADFPVYR

SEQ ID NO: 9281 - DNA, 1248 bp, Ralstonia eutropha
  CDS (1)..(1248): transl_table=11
atgttcgaacgcagccgctatacgatcgaccagatcgaccccgaggtctttgccgctatccagaaggaaaaccagcgccaggaagaccacatcgagctgatcgcctccgaaaactacacctcgccggccgtgatggctgcgcaaggctcgcaactgaccaacaagtacgccgagggctatcccggcaagcgctactacggtggctgcgagtacgtcgacatcgtcgaacagctggccatcgaccgcgtcaagcagctgttcggcgccgaagccgccaacgtgcagccgaactcgggctcgcaggccaaccagggcgtgtacttcgccgtgctgaagccgggcgacaccatcatgggcatgagcctggccgaaggcggtcacctgacccacggcatggcgctgaacatgagcggcaagtggttcaacgtggtcagctacggcctgaacgcgcaggaagacatcgactacgacgcgctggaaaagctggcacaagagaagaagccgaagctgatcatcgccggcgcatcggccttcgcgctgcgcatcgacttcgagcgcatcggcaaggtcgccaagtcgatcggtgcctacttcatggtcgacatggcccactacgccggcctgatcgccgcgggcgtgtacccgaacccggtgccgcacgccgacttcgtcaccaccaccacgcacaagagcctgcgcggcccgcgcggcggcgtgatcctgatgaaggccgagcatgagaaggccatcaactcgtcgatcttcccgggcatccagggcggtccgctgatgcacgtgatcgctggcaaggccgtcgcgttcaaggaagcgctgacgccggaattcaaggcttaccaggaacaagtggtcaagaacgccgccgtgctggccgaaacgctgatcgcgcgcggcctgcgcattgtctcgggccgcaccgaaagccacgtgatgctggtcgacctgcgcgccaagaacatcaccggcaaggaagccgagcgcatcctgggcgaagcgcacctgaccgtgaacaagaacgcgatcccgaacgatccggaaaagccgttcgtgacctcgggcattcgcgtcggctcgccggccatgaccacgcgcggcttcaaggaagaagaagcgcgtatcgtcggcaacctgatcgccgacgtgctggacaacccgcacgacgcgggcaacatcgccagcgtgcgcgagcaggtttccgccctgaccaagcgttttccggtctacggctga

SEQ ID NO: 9282 - protein, 415 aa, Ralstonia eutropha
MFERSRYTIDQIDPEVFAAIQKENQRQEDHIELIASENYTSPAVMAAQGSQLTNKYAEGYPGKRYYGGCEYVDIVEQLAIDRVKQLFGAEAANVQPNSGSQANQGVYFAVLKPGDTIMGMSLAEGGHLTHGMALNMSGKWFNVVSYGLNAQEDIDYDALEKLAQEKKPKLIIAGASAFALRIDFERIGKVAKSIGAYFMVDMAHYAGLIAAGVYPNPVPHADFVTTTTHKSLRGPRGGVILMKAEHEKAINSSIFPGIQGGPLMHVIAGKAVAFKEALTPEFKAYQEQVVKNAAVLAETLIARGLRIVSGRTESHVMLVDLRAKNITGKEAERILGEAHLTVNKNAIPNDPEKPFVTSGIRVGSPAMTTRGFKEEEARIVGNLIADVLDNPHDAGNIASVREQVSALTKRFPVYG

SEQ ID NO: 9283 - DNA, 1248 bp, Ralstonia solanacearum
  CDS (1)..(1248): transl_table=11
atgttcgaacgcaaccgctatacgatcgaccagatcgacccagaagtcttcgccgccatccagcaggaaaaccagcgccaggaagaccacatcgagctgatcgcctccgagaactacacctcgccggccgtgatggccgcccagggctcgcagctgaccaacaagtatgccgagggctatcccggcaagcgctactacggtggctgcgaatacgtggacgtggtcgagcagctcgccatcgaccgcgtgaagcaactgttcggcgccgaggccgccaacgtgcagccgaactccggctcgcaggccaaccagggcgtgttcttcgccatgctcaagccgggcgacaccatcatgggcatgagcctggccgaaggcggccacctgacgcacggcatggcgctcaacatgagcggcaagtggttcaacgtcgtcagctacggcctgaacgcgcaggaagacatcgactacgatgccctcgaagcgctggcacaagagaagaagcccaagctgatcatcgccggcgcctccgcgtttgcgctgcgcatcgacttcgagcgcatcgccaaggtggccaaggccgtcggcgcgtacttcatggttgacatggcccactacgccggcctgatcgccgcgggcgtctacccgaacccggtgccgcacgccgatttcgtgaccaccaccacccacaagagcctgcgcggcccgcgcggcggcgtgatcctgatgaaggccgagcacgagaaggccatcaactcggcgatcttccccggcatccagggcggcccgctgatgcacgtgatcgccggcaaggcggtggcgttcaaggaagcccagtcgcccacgttcaaggcctaccaggaacaggtggtgaaaaacgcccgcgccatggccgaaacgctgatggcccgcggcctgcgcatcgtctccggccgcaccgaaagccacgtgatgctggtcgacctgcgcgcgaagagcattaccggcaaggaagccgagaaggtgctgggcgacgcgcatatcaccgtcaacaaaaacgccatcccgaacgatccggagaagcccttcgtgacctcgggcatccgcctgggctcgccggccatgaccacgcgaggcttcaaggagggtgaggccgtgaaggtagcccacctgatcgccgatgtgcttgataatccgcatgacgaagccaacatcgcggccgtgcgcgccaaggtggccgagctgaccaagcagttcccggtctacgcatga

SEQ ID NO: 9284 - protein, 415 aa, Ralstonia solanacearum
MFERNRYTIDQIDPEVFAAIQQENQRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAEGGHLTHGMALNMSGKWFNVVSYGLNAQEDIDYDALEALAQEKKPKLIIAGASAFALRIDFERIAKVAKAVGAYFMVDMAHYAGLIAAGVYPNPVPHADFVTTTTHKSLRGPRGGVILMKAEHEKAINSAIFPGIQGGPLMHVIAGKAVAFKEAQSPTFKAYQEQVVKNARAMAETLMARGLRIVSGRTESHVMLVDLRAKSITGKEAEKVLGDAHITVNKNAIPNDPEKPFVTSGIRLGSPAMTTRGFKEGEAVKVAHLIADVLDNPHDEANIAAVRAKVAELTKQFPVYA

SEQ ID NO: 9285 - DNA, 1314 bp, Rhizobium loti
  CDS (1)..(1314): transl_table=11
atggcaacagcagcggcagcgtcgaacaaattcgagtccttcttcgaaaccacgctggaagacgccgatccggagattttcggcgccatccgcaacgagcttggccgccagcgccatgagatcgagctgatcgcctcggaaaacatcgtttcccgcgcggtgctcgaggcgcaggggtcgatcatgaccaacaaatacgccgagggctatccgggcaagcgctactatggcggctgccagttcgtcgacgtggccgaggaactggccatcgagcgggcgaagaagctgttcggatgcaatttcgccaacgtccagccgaactccggcagccagatgaaccaggcggtgttcctggcgctgctgcagcccggcgacacctttatgggcctcgacctcaattccggtggccatctcacccacggctcgccggtcaacatgagcggcaagtggttcaaggtcgtctcctacggcgtgcgcaaggaagaccatctgctcgacatggatgccatcgaaaagaccgcgcatgagaccaagccgaagctgatcctggccggcggcaccgcctattcccgcatctgggactggaagcgctttcgcgagatcgcggatgcagtcggcgcctatctgatggtcgacatggcgcatattgctggcctcgtcgccggcggcgtgcatccctcgccattgccgcacgcccatgtggtgacgaccaccacgcacaagtcgctgcgcggcccgcgcggaggcatgatcctgtgcaacgacgaagacattgccaagaagatgaactcggcagtgttccccggcctgcagggcggcccgctgatgcatgtcatcgccgccaaggcggtggcctttggcgaggcgcttaagccgagcttcaaggtctatgccgagagcgtggccgccaacgccaaggcgctggcttcgagcctcaaggagacgggcctcgacatcgtctccggcggtaccgataaccatttgatgctggtcgatttgcgccccaagaacgccaccggcaagcgcgccgaggcggcccttggccgcgccaacatcacttgcaacaagaacggcattcccttcgacccggaaaagcccttcgtcacctctggcgtgcgtctcggcacgccggccggtaccacgcgcggcttcggccaggccgaattccgcgagatcggcaagctgatcgccgaagtgctggatggtctcaagatcgccaattcggacgagggcaatgccgcggtcgaggcggcggtcaaggccaaggtcgtggcgctgaccgatcgttttccgctctatccttatctcggctga

SEQ ID NO: 9286 - protein, 437 aa, Rhizobium loti
MATAAAASNKFESFFETTLEDADPEIFGAIRNELGRQRHEIELIASENIVSRAVLEAQGSIMTNKYAEGYPGKRYYGGCQFVDVAEELAIERAKKLFGCNFANVQPNSGSQMNQAVFLALLQPGDTFMGLDLNSGGHLTHGSPVNMSGKWFKVVSYGVRKEDHLLDMDAIEKTAHETKPKLILAGGTAYSRIWDWKRFREIADAVGAYLMVDMAHIAGLVAGGVHPSPLPHAHVVTTTTHKSLRGPRGGMILCNDEDIAKKMNSAVFPGLQGGPLMHVIAAKAVAFGEALKPSFKVYAESVAANAKALASSLKETGLDIVSGGTDNHLMLVDLRPKNATGKRAEAALGRANITCNKNGIPFDPEKPFVTSGVRLGTPAGTTRGFGQAEFREIGKLIAEVLDGLKIANSDEGNAAVEAAVKAKVVALTDRFPLYPYLG

SEQ ID NO: 9287 - DNA, 1296 bp, Rhizobium meliloti
  CDS (1)..(1296): transl_table=11
atgctttcacagaccaacgacgctttcttcacccgctctctcgccgacagcgatccggaaatcttcggtgcgatcgagaaggagctgggccgccagcgccatgagatcgagctgatcgcctccgagaacatcgtttcacgggccgtgctcgaggcgcagggctcgatcatgaccaacaaatacgccgagggttacccgggcaagcgctattacggcggctgccaatatgtcgatatcgccgaggcactcgcgatcgagcgcgccaagaagctcttcggcgtcaacttcgcgaacgtgcaaccgaattcgggctcccagatgaaccaggcggtcttcctggcgctgctgcagccgggcgacaccttcatgggcctcgacctcaattccggcggccacctgacccatgggtccccggtgaacatgtcgggcaaatggttcaacgtcgtttcctacggcgtgcgcgaagacgatcaccttctcgacatggacgaagtcgccaggaaggcgcgcgagcagaagccgaaactgatcatcgccggcggaacggcctattcccgcatctgggactggaagcgcttccgcgagatcgccgacgaggtgggcgcgtggctgatggtcgacatggcccacatcgccggtctcgtggccggtggccagcatccgtcgccgttcccgcactgccacgttgcgacgacgaccacgcacaagtccctgcgcggcccccgcggcggcatgatcctcaccaatgacgaggaaatcgccaagaagatcaactccgccgtattccccggtctccagggtgggccgctgatgcacgtgattgccgccaaggccgtcgcgcttggcgaggcgctgcagccctccttcaaggattatgcggcccaggtcgtcaagaacgcccgcacccttgccgaaaccttgaaggccaacggcctggacatcgtctcgggcggtaccgacaaccacctgatgctggtcgacctgcgcaagaagaatgcgaccggcaagcgtgccgaagctgctctcggccgtgcctacgtcacctgcaacaagaacggcattcccttcgaccccgaaaagcccttcgtcacctccggcgtgcgcctcggtgcaccggccggtacgacgcgcggcttcaaggaggcggagttcaaggaggtcggcgaactgatcgtcgaggtgctcgacggtctcaaggccgccaattccgacgagggcaatgccgctgtcgaggctggcgtgcgcgagaaggtgatcaagctcaccgaccgcttcccgatgtacggctatatgtga

SEQ ID NO: 9288 - protein, 431 aa, Rhizobium meliloti
MLSQTNDAFFTRSLADSDPEIFGAIEKELGRQRHEIELIASENIVSRAVLEAQGSIMTNKYAEGYPGKRYYGGCQYVDIAEALAIERAKKLFGVNFANVQPNSGSQMNQAVFLALLQPGDTFMGLDLNSGGHLTHGSPVNMSGKWFNVVSYGVREDDHLLDMDEVARKAREQKPKLIIAGGTAYSRIWDWKRFREIADEVGAWLMVDMAHIAGLVAGGQHPSPFPHCHVATTTTHKSLRGPRGGMILTNDEEIAKKINSAVFPGLQGGPLMHVIAAKAVALGEALQPSFKDYAAQVVKNARTLAETLKANGLDIVSGGTDNHLMLVDLRKKNATGKRAEAALGRAYVTCNKNGIPFDPEKPFVTSGVRLGAPAGTTRGFKEAEFKEVGELIVEVLDGLKAANSDEGNAAVEAGVREKVIKLTDRFPMYGYM

SEQ ID NO: 9289 - DNA, 1299 bp, Rhodopseudomonas palustris
  CDS (1)..(1299): transl_table=11
atgagcacagccaatcccgcgtccgcgcccgacagcttcttctccgcctcgctggagcaggccgatcccgagatcgccgctgcgatccgcggcgaactcggccgccagcgccacgaggtcgagctgatcgcctccgagaacatcgtcagccgcgcggtgctggaagcgcagggctcggtgatgaccaacaagtatgcggaaggctatccgggcaaccgctattacggcggctgcgaattcgtcgacgttgccgagaatctggcgatcgaccgagccaagaagctgttcggcgccaatttcgccaacgtccagccgaactccggcagccagatgaaccaggcggtgttcctggcgctgctgcagcccggcgataccttcatgggcctcgatctcgccgccggcggccatctcacccacggcgcccccgtcaacatgagcggcaagtggttcaagccggtgcactacacggtgcgccgcgaagaccagatgatcgatatggatgcggtcgccaagctcgccgaggaagccaagccgaagctgatcatcgccggcggctcggcctatccgcgcgcctgggacttcaagcgcttccgcgagatcgccgacagcgtcggggcgtatttcatggtcgacatggcgcacttcgccggcctcgtggcgggcggcgtccatgcttcgccggtgccgcatgcccacgtcaccacgacgacgactcacaagtcgctgcgtggcccgcgcggcggcctgatcctcaccaacgatgaagcgctggccaagaagttcaattcggcgatcttccccggcctgcagggtggcccgctgatgcacgtgatcgccgccaaggcggtggcgttcaaggaagcgctgcagcccgacttcaaggtttacacgaagaatgtcgtcgaaaacgccaaggcgcttgcggaaacgctgcgctcggccggcttcgatctggtttcgggcggcaccgacaaccatctgatgctggtcgacctgcggccgaaggggctgaagggcaacgtctcggagaaggcgctggtccgcgccggcatcacctgcaacaagaacggtatcccgttcgacccggagaaaccgttcgtgacttcgggcctgcgcctcggcaccccggcggcgacgacccgcggtttcggcgttgccgagttccagcaggttggtcacttgatcgccgaagtgctgaacgcgattgcacaatcgtccgacggcgcggcgccgctggtggaagcctcggtgaagcagcgggtgaaggagttgaccgaccgcttcccgatttatcagtaa

SEQ ID NO: 9290 - protein, 432 aa, Rhodopseudomonas palustris
MSTANPASAPDSFFSASLEQADPEIAAAIRGELGRQRHEVELIASENIVSRAVLEAQGSVMTNKYAEGYPGNRYYGGCEFVDVAENLAIDRAKKLFGANFANVQPNSGSQMNQAVFLALLQPGDTFMGLDLAAGGHLTHGAPVNMSGKWFKPVHYTVRREDQMIDMDAVAKLAEEAKPKLIIAGGSAYPRAWDFKRFREIADSVGAYFMVDMAHFAGLVAGGVHASPVPHAHVTTTTTHKSLRGPRGGLILTNDEALAKKFNSAIFPGLQGGPLMHVIAAKAVAFKEALQPDFKVYTKNVVENAKALAETLRSAGFDLVSGGTDNHLMLVDLRPKGLKGNVSEKALVRAGITCNKNGIPFDPEKPFVTSGLRLGTPAATTRGFGVAEFQQVGHLIAEVLNAIAQSSDGAAPLVEASVKQRVKELTDRFPIYQ

SEQ ID NO: 9291 - DNA, 1251 bp, Vibrio cholerae
  CDS (1)..(1251): transl_table=11
atgcttaagcgtgatatgaacatcgctgattacgatccggagctatacgctgccattcaggaagagacgcttcgtcaagaagaacatattgaacttattgcttcagaaaactacaccagcccgcgtgtaatgcaagcacaaggttctcaactgaccaacaagtacgccgaaggttatcctggtaagcgttactatggtggttgtgagtacgtggacaaagcagaagctttagcgattgatcgtgcttgccaactgtttggctgtgaatacgcgaacgttcagccgcactctggatctcaagcgaacagtgctgtgtacatggcgctgctcaacccaggtgacaccgtgctaggtatgagccttgctcacggtggtcatttgactcacggttcaccagttaacttctcgggtaagcactacaatgtgatcccttacggtatcgatgaagcgggtcaaattaactacgatgaaatggaagccttagcactggagcataagccaaagatgatcatcggtggcttctcggcttactcacaaatcgtggattggaaacgcatgcgtgaaatcgccgataaagtgggtgcttacctgtttgttgacatggcgcacgttgcgggtctgattgcggcgggtgtttacccaagcccagtgccttttgcacacgttgtcacgaccaccacgcataaaacactggcaggtccacgcggtggcttgatcttgtcaaatgccggtgaggagatgtacaagaagctgaactctgcagtattccctggcggccaaggcggtcctttgatgcacgtgattgcggctaaagcggtggcgttcaaagaagcgatggagcctgagtttaaagagtatcaagcgcgtgtggtgaaaaacgccaaagccatggtggcgcagttccaagaacgtggttacaagatcgtctctaacagcacggaaaaccatttgttccttgttgatctgattgataaaaacatcacaggtaaagaagctgatgccgctctgggcgctgccaatatcacggttaacaagaactcggtaccaaatgacccacgcagcccgtttgtgacttcaggtatccgtgtcggtacacctgcaatcactcgccgtggttttactgagcaagacgcaaaagatctcgccaactggatgtgtgatgttctagacaacatcaatgatcaaggtgtgattgaagcgacgaaacaaaaagtattggcgatctgtcaacgtctgcctgtttacgcttaa

SEQ ID NO: 9292 - protein, 416 aa, Vibrio cholerae
MLKRDMNIADYDPELYAAIQEETLRQEEHIELIASENYTSPRVMQAQGSQLTNKYAEGYPGKRYYGGCEYVDKAEALAIDRACQLFGCEYANVQPHSGSQANSAVYMALLNPGDTVLGMSLAHGGHLTHGSPVNFSGKHYNVIPYGIDEAGQINYDEMEALALEHKPKMIIGGFSAYSQIVDWKRMREIADKVGAYLFVDMAHVAGLIAAGVYPSPVPFAHVVTTTTHKTLAGPRGGLILSNAGEEMYKKLNSAVFPGGQGGPLMHVIAAKAVAFKEAMEPEFKEYQARVVKNAKAMVAQFQERGYKIVSNSTENHLFLVDLIDKNITGKEADAALGAANITVNKNSVPNDPRSPFVTSGIRVGTPAITRRGFTEQDAKDLANWMCDVLDNINDQGVIEATKQKVLAICQRLPVYA

SEQ ID NO: 9293 - DNA, 1251 bp, Vibrio parahaemolyticus
  CDS (1)..(1251): transl_table=11
atgcttaagcgtgatatgaacatcgcagattacgatgcggaactgttcgcagctatccaggaagaaacccttcgccaggaagaacacattgaacttatcgcttctgaaaactacacaagcccacgtgtaatggaagcgcaaggttctcagctaacgaacaaatacgctgaaggctacccaggcaagcgttactacggcggttgtgagtacgtagataaagcagaacagcttgctatcgatcgtgcatgcaaactattcggttgtgagtacgcgaacgtacaacctcactcaggttctcaagcaaacagcgcagtttacatggcgcttcttaacccaggagatacagtactaggtatgagcctagcgcacggtggtcacctgactcacggttctccagtaaacttctctggtaagcattacaacgttatcccttacggtatcgatgaagcgggtcaaatcaattacgacgagatggaacagctagcgcttgagcacaagcctaagatgatcatcggtggtttttctgcttactcgcaaatcgttgattggaagcgcatgcgtgaaatcgcggacaaagtagatgcttaccttttcgttgatatggcacacgtagctggtcttatcgcagcaggcgaatacccaacacctgttccacacgctcacgtagtaacaacaacgacgcacaaaacactagcaggccctcgcggtggtcttatcttgtctaatgctggcgaagatatgtacaagaagctgaactcagctgtgttccctggtggtcaaggtggccctctaatgcacgttatcgctggtaaagcagtagcgttcaaagaagcgatggagccagagttcaaagcttaccaagctcgcgtagtgaaaaacgcaaaagcaatggttggtcagttccaagagcgtggctacaaaatcgtatctaacggcacagaaaaccacttgttccttgtggatctaatcgacaaagacatcactggtaaagatgcagacgcggcactaggtgcagcaaacatcacagtaaacaagaactcagtaccaaatgacccacgcagcccattcgtaacgtctggtattcgtgtaggtacaccagcgatcactcgtcgtggctttactgaagaagacgcaaaagatctagcaaactggatgtgtgacgttctagataacatcggcaacgaagaagttatcgaagcgactaaacagaaagtattagaaatctgtaagcgtctaccggtttacgcctaa

SEQ ID NO: 9294 - protein, 416 aa, Vibrio parahaemolyticus
MLKRDMNIADYDAELFAAIQEETLRQEEHIELIASENYTSPRVMEAQGSQLTNKYAEGYPGKRYYGGCEYVDKAEQLAIDRACKLFGCEYANVQPHSGSQANSAVYMALLNPGDTVLGMSLAHGGHLTHGSPVNFSGKHYNVIPYGIDEAGQINYDEMEQLALEHKPKMIIGGFSAYSQIVDWKRMREIADKVDAYLFVDMAHVAGLIAAGEYPTPVPHAHVVTTTTHKTLAGPRGGLILSNAGEDMYKKLNSAVFPGGQGGPLMHVIAGKAVAFKEAMEPEFKAYQARVVKNAKAMVGQFQERGYKIVSNGTENHLFLVDLIDKDITGKDADAALGAANITVNKNSVPNDPRSPFVTSGIRVGTPAITRRGFTEEDAKDLANWMCDVLDNIGNEEVIEATKQKVLEICKRLPVYA

SEQ ID NO: 9295 - DNA, 1251 bp, Vibrio vulnificus
  CDS (1)..(1251): transl_table=11
atgcttaagcgtgatatgaatatcgctgattacgatgcggagctattcgcagctatccaggaagaaactcttcgccaggaagaacacatcgagctgatcgcttcagaaaactacacaagcccacgtgtaatggaagctcaaggctctcagctaaccaataagtacgctgaaggctacccaggcaagcgttactacggtggctgtgaatatgttgataaagcggaagcactcgcaattgatcgcgcatgccagttgttcggttgtgaatatgcaaacgtacagcctcactcaggttctcaagcaaacagtgcagtgtatatggcgctgcttaacccaggcgacactgtattaggtatgagccttgcgcacggtggccacttgacgcacggctcaccagttaacttctctggtaagcactacaacgttatcccttacggtatcgatgaagcgggtcaaattaactacgacgagatggaaacgctagcgcttgagcacaaacctaagatgatcatcggtggtttctcagcgtactctcaaatcgttgattggaagcgtatgcgtgaaatcgcggacaaagttgacgcttacctattcgtcgatatggcgcacgttgcgggtcttatcgcagcaggtgaatatccaacaccagttcctcacgcacacgtagtgacgacgacaacgcacaaaacgctagcaggtccacgtggtggtcttatcctgtctaacgctggcgaagacatgtacaagaaactgaactcagccgttttccctggtggtcagggtggccctctgatgcacgttatcgctggtaaagcagtagcgttcaaagaagcgatggaacctgagtttaaagcttaccaagcgcgcgtagtgaaaaatgcaaaagcgatggtggctcagttccaagagcgcggttacaaaatcgtatctaacggtacagaaaaccacctgttccttgttgaccttatcgacaaagacatcacgggtaaagatgcggatgcggcactaggcgcagcaaacatcacggtaaacaagaactcagtaccaaacgaccctcgtagcccatttgtcacttcgggtattcgtgttggtacgcctgcgattactcgccgtggctttacggaagcggacgcgaaagagctagcaaactggatgtgtgacgtattagataacatcggcaatgaagcggttatcgaagcaacgaaacagaaagtactagaaatctgtaagcgtctacctgtttacgcataa

SEQ ID NO: 9296 - protein, 416 aa, Vibrio vulnificus
MLKRDMNIADYDAELFAAIQEETLRQEEHIELIASENYTSPRVMEAQGSQLTNKYAEGYPGKRYYGGCEYVDKAEALAIDRACQLFGCEYANVQPHSGSQANSAVYMALLNPGDTVLGMSLAHGGHLTHGSPVNFSGKHYNVIPYGIDEAGQINYDEMETLALEHKPKMIIGGFSAYSQIVDWKRMREIADKVDAYLFVDMAHVAGLIAAGEYPTPVPHAHVVTTTTHKTLAGPRGGLILSNAGEDMYKKLNSAVFPGGQGGPLMHVIAGKAVAFKEAMEPEFKAYQARVVKNAKAMVAQFQERGYKIVSNGTENHLFLVDLIDKDITGKDADAALGAANITVNKNSVPNDPRSPFVTSGIRVGTPAITRRGFTEADAKELANWMCDVLDNIGNEAVIEATKQKVLEICKRLPVYA

SEQ ID NO: 9297 - DNA, 1269 bp, Agrobacterium tumefaciens
  CDS (1)..(1269): transl_table=11
atgctcaaccgcctgtcacacaataccgtttccgacacggtgatcgctgatgccatcgccgaggaactcgaccgccagaagacgcagatcgagctgatcgcctcggaaaacattgtgtccgccgatgttctggcggcacagggctcggtgctgaccaacaaatatgccgagggttatcccggcaagcgttattacggcggttgcgaattcgtcgacaaggtcgaacaggtcgccatcgaccggttgaagcaactcttcggcgcggaatttgccaatgtgcagccgcattccggcgcgcaggccaaccaagccgtgttcctggcgctgctgcagccgggcgaccgcatcatggggctttcgctcgcccatggcggccacctgacccacggttcgccggtgacgatgtccggcaagtggttcgatgtcgtctcctacgaggttgaccccgaaacccacctgatcgacatggagaaggtgcgcgagaaagcgttggaaacgaagccgaagctgatcgtcgccggggcctcggcctatccgcgccagatcgattttgccggcttccgtgagatcgccgatgaagtgggcgcatatctaatggtcgacatggcccattatgccgggctgatcgccggcggtcactatcccaacgccgtgccccatgcgcacgtcaccacctcgaccacccacaagaccctgcgcggcccgcgcggcggcgtaatcctgaccaatgatgccgatctcgccaagaagctgaactcggcggtcttccccggcaatcagggcggcccgctgatgcatgtcatcgccgccaaggccgtggctttcggcgaggccctgcggccagaattttccgactatgccggtcaggtgatcgccaatgcacaggcgctggccaaggtgctgatacagggtggtctcggcatcgtctcgggcggaaccgacagtcatatggtgctggtcgatttgcgcccgaagggcgtcaccggcaagattgccgaaatcgcgctcgaacgggcgggacttacctgcaacaagaactccattcccaatgacccggaaaagccgttcgtcacttcgggcatccgtcttggcagctcggccggcaccacccgcggtttcggcgtgctcgagttcgaaaagatcggtgcgctgatcctgcgtgtcatcgatgcgctggccacgaatgccgagggtgacagcgcggtcgaggccgaggtgcgggaagaggttgccgcactctgtgaggcgttcccgatctacgtctcgtaa

SEQ ID NO: 9298 - protein, 422 aa, Agrobacterium tumefaciens
MLNRLSHNTVSDTVIADAIAEELDRQKTQIELIASENIVSADVLAAQGSVLTNKYAEGYPGKRYYGGCEFVDKVEQVAIDRLKQLFGAEFANVQPHSGAQANQAVFLALLQPGDRIMGLSLAHGGHLTHGSPVTMSGKWFDVVSYEVDPETHLIDMEKVREKALETKPKLIVAGASAYPRQIDFAGFREIADEVGAYLMVDMAHYAGLIAGGHYPNAVPHAHVTTSTTHKTLRGPRGGVILTNDADLAKKLNSAVFPGNQGGPLMHVIAAKAVAFGEALRPEFSDYAGQVIANAQALAKVLIQGGLGIVSGGTDSHMVLVDLRPKGVTGKIAEIALERAGLTCNKNSIPNDPEKPFVTSGIRLGSSAGTTRGFGVLEFEKIGALILRVIDALATNAEGDSAVEAEVREEVAALCEAFPIYVS

SEQ ID NO: 9299 - DNA, 1248 bp, Bordetella bronchiseptica
  CDS (1)..(1248): transl_table=11
atgttcaaccgcaacctgaccctcgaccaggtggatcccgacgtctgggccgccatccagaaagaagacgtacgccaggaacagcacatcgagctgatcgcgtccgagaactacgccagcccggccgtgatgcaggcccagggcacgcaactgaccaacaagtatgcggaaggctacccgggcaagcgctactacggcggctgcgagtacgtcgacgtggtcgagcagctggccatcgaccgcctgaagcagattttcggcgccgaggccgccaacgtgcagccgaactccggctcgcaggccaaccagggcgtgtacatggcggtgctcaagccgggcgataccgtgctgggcatgagcctggccgaaggcggccacctgacgcacggcgcgtcggtcaacgcctcgggcaagctgtacaacttcgtgccctacggcctggacgccgacgaggtgctggattacgcccaggtcgagcggctgaccaaggaacacaagcccaagctgatcgtggccggcgcctccgcgtacgcgctgcacatcgacttcgagcgcatggcgcgcatcgcccacgacaacggcgcgctgttcatggtggacatcgcccactatgccggcctggtggccggcggcgcctatcccaacccggtgccgcacgccgatttcgtcacctccaccacgcacaagtcgctgcgcggcccgcgcggcggcgtcatcatgatgaaggccgagttcgagaaggccgtcaattcggccatcttcccgggcatccagggcggcccgctgatgcacgtcatcgcggccaaggccgtggccttcaaggaagcgctgtcgcccgagttccaggattacgcccagcaggtcgtcaagaacgccaaggtgctggccgatacgctggtcaagcgcggcctgcgcatcgtgtcgggcaggaccgaaagccacgtcatgctggtggacctgcgtcccaagggcatcaccggcaaggaagcggaagcggtgctgggccaggcccacatcacggtcaacaagaacgccatccccaacgacccggaaaagcccttcgtgaccagcggcatccgcctgggcaccccggccatgaccacccgcggcttcaaggaggccgaggccgagctgaccgccaacctgatcgccgacgtgctggacaatccccgcgacgaggcgaacatcgccgcggtgcgcgcgcgggtcaatgaactgaccgcccgcctgcccgtctacggcaactga

SEQ ID NO: 9300 - protein, 415 aa, Bordetella bronchiseptica
MFNRNLTLDQVDPDVWAAIQKEDVRQEQHIELIASENYASPAVMQAQGTQLTNKYAEGYPGKRYYGGCEYVDVVEQLAIDRLKQIFGAEAANVQPNSGSQANQGVYMAVLKPGDTVLGMSLAEGGHLTHGASVNASGKLYNFVPYGLDADEVLDYAQVERLTKEHKPKLIVAGASAYALHIDFERMARIAHDNGALFMVDIAHYAGLVAGGAYPNPVPHADFVTSTTHKSLRGPRGGVIMMKAEFEKAVNSAIFPGIQGGPLMHVIAAKAVAFKEALSPEFQDYAQQVVKNAKVLADTLVKRGLRIVSGRTESHVMLVDLRPKGITGKEAEAVLGQAHITVNKNAIPNDPEKPFVTSGIRLGTPAMTTRGFKEAEAELTANLIADVLDNPRDEANIAAVRARVNELTARLPVYGN

SEQ ID NO: 9301 - DNA, 1248 bp, Bordetella parapertussis
  CDS (1)..(1248): transl_table=11
atgttcaaccgcaacctgaccctcgaccaggtggatcccgacgtctgggccgccatccagaaagaagacgtacgccaggaacagcacatcgagctgatcgcgtccgagaactacgccagcccggccgtgatgcaggcccagggcacgcaactgaccaacaagtatgcggaaggctacccgggcaagcgctactacggcggctgcgagtacgtcgacgtggtcgagcagctggccatcgaccgcctgaagcagattttcggcgccgaggccgccaacgtgcagccgaactccggctcgcaggccaaccagggcgtgtacatggcggtgctcaagccgggcgataccgtgctgggcatgagcctggccgaaggcggccacctgacgcacggcgcgtcggtcaacgcctcgggcaagctgtacaacttcgtgccctacggcctggacgccgacgaggtgctggattacgcccaggtcgagcggctgaccaaggaacacaagcccaagctgatcgtggccggcgcctccgcgtacgcgctgcacatcgacttcgagcgcatggcgcgcatcgcccacgacaacggcgcgctgttcatggtggacatcgcccactatgccggcctggtggccggcggcgcctatcccaacccggtgccgcacgccgatttcgtcacctccaccacgcacaagtcgctgcgcggcccgcgcggcggcgtcatcatgatgaaggccgaggtcgagaaggccgtcaattcggccatcttcccgggcatccagggcggcccgctgatgcacgtcatcgcggccaaggccgtggccttcaaggaagcgctgtcgcccgagttccaggattacgcccagcaggtcgtcaagaacgccaaggtgctggccgatacgctggtcaagcgcggcctgcgcatcgtgtcgggcaggaccgaaagccacgtcatgctggtggacctgcgtcccaagggcatcaccggcaaggaagcggaagcagtgctgggccaggcccacatcacggtcaacaagaacgccatccccaacgacccggaaaagcccttcgtgaccagcggcatccgcctgggcaccccggccatgaccacccgcggcttcaaggaggccgaggccgagctgaccgccaacctgatcgccgacgtgctggacaatccccgcgacgaggcgaacatcgccgcggtgcgcgcgcgggtcaatgaactgaccgcccgcctgcccgtctacggcaactga

SEQ ID NO: 9302 - protein, 415 aa, Bordetella parapertussis
MFNRNLTLDQVDPDVWAAIQKEDVRQEQHIELIASENYASPAVMQAQGTQLTNKYAEGYPGKRYYGGCEYVDVVEQLAIDRLKQIFGAEAANVQPNSGSQANQGVYMAVLKPGDTVLGMSLAEGGHLTHGASVNASGKLYNFVPYGLDADEVLDYAQVERLTKEHKPKLIVAGASAYALHIDFERMARIAHDNGALFMVDIAHYAGLVAGGAYPNPVPHADFVTSTTHKSLRGPRGGVIMMKAEVEKAVNSAIFPGIQGGPLMHVIAAKAVAFKEALSPEFQDYAQQVVKNAKVLADTLVKRGLRIVSGRTESHVMLVDLRPKGITGKEAEAVLGQAHITVNKNAIPNDPEKPFVTSGIRLGTPAMTTRGFKEAEAELTANLIADVLDNPRDEANIAAVRARVNELTARLPVYGN

SEQ ID NO: 9303 - DNA, 1275 bp, Burkholderia mallei
  CDS (1)..(1275): transl_table=11
atgtcgaacgccaatcccttcttctcgcaatcgctcgccgagcgcgacgcgtccgtgcgcggcgcgatcctcaaggaactcgaacgccagcagtcgcaagtcgagctgatcgcgtcggagaacatcgtgtcgcgcgcggtgctcgacgcgcagggctcggtgctgaccaacaagtatgcggaaggctatccgggcaagcgctattacggcggttgcgaattcgccgacgaagtcgaggcgctcgcgatcgagcgcgtgaagcggctcttcaacgccggccatgcgaacgtgcagccgcactcgggcgcccaggcgaacggcgcggtgatgctcgcgctcgcgaagccgggcgacacggtgctcggaatgtcgctcgacgcgggcggacacctcacgcacggcgcgaagccggcgctgtccggcaagtggttcaacgcgctccagtacggcgtgagccgcgacacgatgctgctcgattacgaccaggtcgaggcgctcgcgcagcagcacaagccgagcctcatcatcgccggcttctccgcctatccgcgcaagctcgacttcgcgcggtttcgcgcgatcgccgattcggtcggcgcgaagctgatggtcgacatggcgcatatcgccggcgtgatcgccgcgggccgccatgcgaacccggtcgaacacgcgcacgtcgtcacgtcgacgacgcacaagacgctgcgcggcccgcgcggcggcttcgtgctgaccaacgacgaggagatcgcgaagaagatcaactcggccgtgttccccggcctgcagggcggcccgctgatgcacgtgatcgccggcaaggcggtggcgttcggcgaggcgctgacagacgatttcaagacctacatcgatcacgtgctcgcgaacgcgcaggcgctcggcgacgtgctgaaggcgggcggcgtcgatctcgtgacgggcggcaccgacaaccatctgctgctcgtcgatctgcgcccgaagggcctgaagggcgcgcaggtcgagcaggcgctcgagcgcgcgggcatcacgtgcaacaagaacggcattccgttcgatccggagaagccgacgatcacgtcgggcatccgcctcggcacgccggcgggcacgacgcgcggcttcggcgcagcggagttccgcgaggtcggccggctgattctcgaggtgttcgaggccctgcgcacgaacccggaaggcgatcacgcgaccgaacagcgcgtgcggcgcgagatcttcgcgctttgcgaacgcttcccgatctactga

SEQ ID NO: 9304 - protein, 424 aa, Burkholderia mallei
MSNANPFFSQSLAERDASVRGAILKELERQQSQVELIASENIVSRAVLDAQGSVLTNKYAEGYPGKRYYGGCEFADEVEALAIERVKRLFNAGHANVQPHSGAQANGAVMLALAKPGDTVLGMSLDAGGHLTHGAKPALSGKWFNALQYGVSRDTMLLDYDQVEALAQQHKPSLIIAGFSAYPRKLDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEALTDDFKTYIDHVLANAQALGDVLKAGGVDLVTGGTDNHLLLVDLRPKGLKGAQVEQALERAGITCNKNGIPFDPEKPTITSGIRLGTPAGTTRGFGAAEFREVGRLILEVFEALRTNPEGDHATEQRVRREIFALCERFPIY

SEQ ID NO: 9305 - DNA, 1275 bp, Burkholderia thailandensis
  CDS (1)..(1275): transl_table=11
atgtcgaacgccaaccccttcttttcgcaatcgctcgccgagcgcgacgcgtccgtgcgcggcgcgatcctcaaggaactcgaacgccagcagtcgcaagtcgagctgatcgcgtcggagaacatcgtgtcgcgcgcggtgctcgacgcgcagggctcggtgctgacgaacaagtatgcggaaggctatccgggcaagcgctattacggcggctgcgagtttgccgacgaagtcgaggcgctcgcgatcgatcgcgtgaagcaaatcttcaacgccggccacgcgaacgtgcagccgcactccggcgcgcaggcgaacggcgcggtgatgcttgcgctcgcgaagccgggcgacacggtgctcgggatgtcgctcgacgcgggcgggcacctcacgcacggcgcgaagcccgcgctgtccggcaagtggttcaacgccgtccagtacggcgtgagccgcgacacgatgctgatcgattacgaccaggtcgaggaactcgcgcagcagcacaagccgagcctcatcatcgccggcttctccgcgtatccgcgcaagctcgacttcgcgcggtttcgcgcgatcgccgattcggtgggggcgaagctgatggtcgacatggcgcacatcgcgggcgtgatcgccgcgggccgccacgcgaacccggtcgagcacgcgcacgtcgtcacgtcgacgacgcacaagacgctgcgcggcccgcgcggcggcttcgtgctgaccaacgacgaggaaatcgcgaagaagatcaattcggcggtgttccccgggctgcagggcggcccgctgatgcacgtgatcgccggcaaggcggtcgcgttcggcgaggcgctcacggacgacttcaagacctatatcgaccgcgtgctcgcgaacgcgcaggcgctcggcgacgtgctgaaggcgggcggcgtcgatctcgtgacgggcggcaccgacaaccatctgctgctcgtcgacctgcgcccgaagggcctgaagggcgcgcaggtcgagcaggcgctcgagcgctcgggcatcacgtgcaacaagaacggcatcccgttcgacgccgagaagccgacgatcacgtcgggcatccgcctcggcacgccggcgggcacgacgcgcggcttcggcgcggcggagttccgcgaggtcggccggctgattctcgaggtgttcgacgcgctgcgcacgaacccggcaggcgatcacgcgaccgaacagcgcgtgcgccgcgagatcttcgcgctctgcgagcgcttcccgatctactga

SEQ ID NO: 9306 - protein, 424 aa, Burkholderia thailandensis
MSNANPFFSQSLAERDASVRGAILKELERQQSQVELIASENIVSRAVLDAQGSVLTNKYAEGYPGKRYYGGCEFADEVEALAIDRVKQIFNAGHANVQPHSGAQANGAVMLALAKPGDTVLGMSLDAGGHLTHGAKPALSGKWFNAVQYGVSRDTMLIDYDQVEELAQQHKPSLIIAGFSAYPRKLDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEALTDDFKTYIDRVLANAQALGDVLKAGGVDLVTGGTDNHLLLVDLRPKGLKGAQVEQALERSGITCNKNGIPFDAEKPTITSGIRLGTPAGTTRGFGAAEFREVGRLILEVFDALRTNPAGDHATEQRVRREIFALCERFPIY

SEQ ID NO: 9307 - DNA, 1296 bp, Photobacterium profundum
  CDS (1)..(1296): transl_table=11
atgaaagcttcgtatcaaaatcatgatttagaaatgttcttttcaaccaaccttgcacaggttgacggtgccgttaacgcaggtatcgaagctgagcttaaccgccagaatcagcaaattgagctgatagcctctgaaaacatcgtttctaaagcagtaatgcaagcacaaggtacttgtttaaccaataagtatgctgaaggttatgcgggccaccgttactacggtggttgtgaacatgttgatgaagtagaaaagatcgctatcgctcgtgccaagcaattattccaatgtgaatacgttaatgttcagcctcactctggcgctcaagcaaacggtgcagttatgcttgcactgcttcaaccgggtgacactatcttgggtatgtctttggatgctggcggccacttaacacacggtgcacgccctgctctttctggtaagtggtttgatgctgttcaatacggtgtgaacaaagacaccctagaaattgattacaaccaagtacgtgaactggctatcgagcacaaaccaaaaatgattattgcaggtggttcagctattcctcgtataatcaattttgcaaaattccgcgaaatcgctgatgaagttggcgctttcctaatggttgatatggcacacatcgcaggtcttattgctgcgggcgaacaccctagccctatcccacatgcgcatgttattactacaacaacacacaaaacattacgtggtccacgtggtggcatgattctaacaaacctagaagacatcaataaaaagattaactctgcggtattccctggtcttcagggtggtccgttgatgcacgttattgcgggtaaagctgtcgcatttggtgaagcattagaacctgatttcaaaatttatatcaaaaatgtgattagcaacgccaaagtattagcagaagtactacaaaatcgtggctgcgatattgtaactaacggcaccgatacccatttgatgttggttgaccttcgccctaaaggcttgaaaggtaatgctgctgaaaatgcactagagcgtgcaggcatcacttgtaataaaaatggcatcccgtttgatactgaaaaaccaatggtaacctcgggtattcgtttaggcacaccagcaggtacaagccgtggcttcggcaatgacgaattcaagcaaattggtgaatggattggcgatgtactagacggtctagcggctaacccagaagacaacagtgaagtggaaaaacatgttaagcagcaagttcagaagctgtgcagccgtttcccgctttaccagtaa

SEQ ID NO: 9308 - protein, 431 aa, Photobacterium profundum
MKASYQNHDLEMFFSTNLAQVDGAVNAGIEAELNRQNQQIELIASENIVSKAVMQAQGTCLTNKYAEGYAGHRYYGGCEHVDEVEKIAIARAKQLFQCEYVNVQPHSGAQANGAVMLALLQPGDTILGMSLDAGGHLTHGARPALSGKWFDAVQYGVNKDTLEIDYNQVRELAIEHKPKMIIAGGSAIPRIINFAKFREIADEVGAFLMVDMAHIAGLIAAGEHPSPIPHAHVITTTTHKTLRGPRGGMILTNLEDINKKINSAVFPGLQGGPLMHVIAGKAVAFGEALEPDFKIYIKNVISNAKVLAEVLQNRGCDIVTNGTDTHLMLVDLRPKGLKGNAAENALERAGITCNKNGIPFDTEKPMVTSGIRLGTPAGTSRGFGNDEFKQIGEWIGDVLDGLAANPEDNSEVEKHVKQQVQKLCSRFPLYQ

SEQ ID NO: 9309 - DNA, 1254 bp, Pseudomonas fluorescens
  CDS (1)..(1254): transl_table=11
atgttcagcaagcaagaccagatccagggttacgacgatgcactgctggcggccatcaatgccgaggaacaacgccaggaagatcacatcgagctgatcgcgtcggaaaactacaccagcaagcgggtgatgcaggcgcaaggcagcgggctgaccaacaagtacgccgaaggctatccgggcaagcgctactacggtggctgcgagcacgtggacaaggtcgaggccctggccatcgagcgcgccaagcaactgttcggtgccgactacgccaacgtccagccgcactccggttcttcggccaacagcgaggtgtacctggccctgctgcaggccggcgataccatcctcggcatgagcctggcccatggcggccacctgacccacggggccaaggtgtcgtcctcgggcaagctgtacaacgcggtgcagtacggcatcgacacccgcaccgggttgatcgactacgacgaagtcgagcgcctggccgtggaacacaagccgaagatgatcgtcgccggcttctcggcctactccaagaccctggacttcccgcgcttccggcagatcgccgacaaggtcggggcgctgctgttcgtcgacatggcccacgtcgccgggctggtggccgccggtctgtatcccaacccgctgccctatgccgacgtggtcactaccaccacccacaagaccctgcgcggtccccgtggcgggctgatcctggccaaggccaacgaagagatcgagaagaaactcaacgccgcggtattccccggcgcccagggcggtccgctgatgcatgtgattgcggccaaggcggtgtgcttcaaggaagcgctggaacctggcttcaaggcttatcagcagcaagtgatcgacaacgcccaggccatggccggcgtgtttatcaaacgcggctacgatgtagtgtccggcggcaccgacaaccacctgttcctggtcagcctgattcgccagggcctgaccggcaaggatgccgatgccgccctgggccgcgcccacatcaccgtgaacaagaacgccgtgcccaacgacccgcagtcgccgtttgtcacgtccggcctgcgcatcggcaccccggcggtcaccacccgcggtttcaaggtcacccagtgcaccgaactggcgggctggatctgcgacattctcgaccacctcggcgatgccgacgtcgaggccaatgtcgcccgtcaggtggcggccctgtgtgctgatttcccggtttaccgctga

SEQ ID NO: 9310 - protein, 417 aa, Pseudomonas fluorescens
MFSKQDQIQGYDDALLAAINAEEQRQEDHIELIASENYTSKRVMQAQGSGLTNKYAEGYPGKRYYGGCEHVDKVEALAIERAKQLFGADYANVQPHSGSSANSEVYLALLQAGDTILGMSLAHGGHLTHGAKVSSSGKLYNAVQYGIDTRTGLIDYDEVERLAVEHKPKMIVAGFSAYSKTLDFPRFRQIADKVGALLFVDMAHVAGLVAAGLYPNPLPYADVVTTTTHKTLRGPRGGLILAKANEEIEKKLNAAVFPGAQGGPLMHVIAAKAVCFKEALEPGFKAYQQQVIDNAQAMAGVFIKRGYDVVSGGTDNHLFLVSLIRQGLTGKDADAALGRAHITVNKNAVPNDPQSPFVTSGLRIGTPAVTTRGFKVTQCTELAGWICDILDHLGDADVEANVARQVAALCADFPVYR

SEQ ID NO: 9311 - DNA, 1254 bp, Pseudomonas fluorescens
  CDS (1)..(1254): transl_table=11
atgttcagccgtgatttgactattgccaagtacgacgccgatctttttgccgccatggagcaagaagcccagcgccaggaagaacacatcgagctgatcgcttcggagaactacaccagcccagcggtgatggaagctcaaggctcggtactgaccaacaagtacgccgaaggctacccgggcaagcgctactacggtggttgcgagtacgtcgacgttgtcgagcaactggccatcgaccgcgccaaggaactgttcggcgccgactacgccaacgttcagccgcacgctggctcccaagccaacgccgctgtctacctggccctgctgtcggccggtgacaccatcctgggcatgagcctggctcacggcggtcacctgacccacggcgccagcgtttcctcctccggcaagctgtacaacgccatccagtacggcatcgatgccaacggcctgatcgactacgacgaagtcgagcgcctggcggtcgagcacaagccgaaaatgatcgtggccggtttctctgcctactcgcagatcctcgacttcccgcgcttccgtgccatcgccgacaaggttggcgcctacctgttcgtcgacatggctcacgtggccggtctggtcgccgctggcgtctacccgaacccggttccgttcgctgacgtcgtgaccaccaccacccacaagaccctgcgcggtccacgtggtggcctgatcctggccaaggccaacgccgacatcgagaagaagctgaactccgccgtattcccgggcgcccaaggtggcccgctggagcacgtgatcgccgccaaagcgatctgcttcaaggaagcactgcagcctgagttcaaggcttaccagcaacaagtggtgaaaaacgcccaggccatggccggcgtgttcatcgagcgcggtttcgacgtggtttccggcggtactgaaaaccacctgttcctgctgtcgctgatcaagcaggaaatctccggtaaagacgccgacgccgctctgggcaaagcgttcatcactgtgaacaagaactccgtgccaaacgacccacgctccccgttcgtcacctccggcctgcgcttcggtactccggcagtgaccactcgcggcttcaaagaggcggagtgcaaagagctggcgggctggatctgcgacatcctggctgacctgaacaacgaagcggtgatcgacgccgttcgtgagaaagtcaaagccatctgcaagaaactgccggtatacggcgcttga

SEQ ID NO: 9312 - protein, 417 aa, Pseudomonas fluorescens
MFSRDLTIAKYDADLFAAMEQEAQRQEEHIELIASENYTSPAVMEAQGSVLTNKYAEGYPGKRYYGGCEYVDVVEQLAIDRAKELFGADYANVQPHAGSQANAAVYLALLSAGDTILGMSLAHGGHLTHGASVSSSGKLYNAIQYGIDANGLIDYDEVERLAVEHKPKMIVAGFSAYSQILDFPRFRAIADKVGAYLFVDMAHVAGLVAAGVYPNPVPFADVVTTTTHKTLRGPRGGLILAKANADIEKKLNSAVFPGAQGGPLEHVIAAKAICFKEALQPEFKAYQQQVVKNAQAMAGVFIERGFDVVSGGTENHLFLLSLIKQEISGKDADAALGKAFITVNKNSVPNDPRSPFVTSGLRFGTPAVTTRGFKEAECKELAGWICDILADLNNEAVIDAVREKVKAICKKLPVYGA

SEQ ID NO: 9313 - DNA, 1254 bp, Pseudomonas putida
  CDS (1)..(1254): transl_table=11
atgttcagccgtgatttgaccattgccaagtacgacgccgagctcttcgaagccatgcagcaagaagctctgcgccaggaagagcatatcgagctgatcgcttcggaaaactacaccagcccggcagtcatggaagcccagggctcggtcctgaccaacaagtacgccgaaggctacccaggcaagcgctactacggcggttgcgagtacgtcgacgtcgtcgagcaactggccatcgaccgtgccaaggagctgttcggcgccgactacgccaacgtacagccgcacgctggctcccaggccaacgctgccgtctacctggccctgctgtcggccggtgacaccatcctgggcatgagcctggcacacggtggccacctgacccacggtgcttcggtaagctcctcgggcaagctgtacaacgccatccagtacggcatcgacggcaatggcctgatcgactacgacgaagtcgagcgcctggctgtcgagcacaagcccaagatgatcgttgccggcttctcggcctactcgcaggttctggacttcgcccgcttccgcgccatcgccgacaaggtcggtgcctacctgttcgtcgacatggcccacgttgccggcctggttgccgctggcgtgtacccgaaccctgttccgttcgccgacgtggtcaccaccaccacccacaagaccctgcgcggcccgcgcggcggcctgatcctggcccgtgccaacgccgacatcgagaagaagctgaactccgccgtcttcccgggcgcccagggcggcccgctggagcacgtcatcgcggccaaggccatctgcttcaaggaagccctgcagccagagttcaaggcttaccagcagcaggtcgtgaagaacgcccaggccatggccagcgtgttcatcgagcgcggtttcgacgtggtttccggtggcacccagaaccacctgttcctgctgtcgctgatcaagcaggaaatctccggtaaggatgctgacgccgccctgggcaaagccttcatcaccgtcaacaagaactcggtaccgaacgacccgcgttcgccgttcgttacctcgggcctgcgtttcggcaccccagccgtgaccacccgtggtttcaaggaagccgagtgcaaggaactggccggctggatctgcgacatcctggccgacctgaacaacgaagcggtgatcgacgccgtccgtgagaaggtcaaggccatctgcaagaagctgccggtttacggcaactga

SEQ ID NO: 9314 - protein, 417 aa, Pseudomonas putida
MFSRDLTIAKYDAELFEAMQQEALRQEEHIELIASENYTSPAVMEAQGSVLTNKYAEGYPGKRYYGGCEYVDVVEQLAIDRAKELFGADYANVQPHAGSQANAAVYLALLSAGDTILGMSLAHGGHLTHGASVSSSGKLYNAIQYGIDGNGLIDYDEVERLAVEHKPKMIVAGFSAYSQVLDFARFRAIADKVGAYLFVDMAHVAGLVAAGVYPNPVPFADVVTTTTHKTLRGPRGGLILARANADIEKKLNSAVFPGAQGGPLEHVIAAKAICFKEALQPEFKAYQQQVVKNAQAMASVFIERGFDVVSGGTQNHLFLLSLIKQEISGKDADAALGKAFITVNKNSVPNDPRSPFVTSGLRFGTPAVTTRGFKEAECKELAGWICDILADLNNEAVIDAVREKVKAICKKLPVYGN

SEQ ID NO: 9315 - DNA, 1275 bp, Ralstonia eutropha
  CDS (1)..(1275): transl_table=11
atgtcgaacacccagtctttcttctcgcagcccctggccgagcgcgatgcgctggttcgcggcgccctttcgaaggaactcgagcgtcagcagtcgcaagtcgagctgatcgcctcggaaaacatcgtgtcgcgcgcggtgctcgaagcccaaggttcggtactgaccaacaagtacgccgaaggttacccgggcaagcgctactacggcggctgtaaatttgcggacgaagtcgaatcgctcgcgatcgagcgcgtgaagcagctcttcaacgccggctttgccaacgtgcagccccactcgggcgcccaggcgaacggctcggtgatgctcgcgctgacgaagccgggcgacaccgtgctcggcatgtcgctggacgcgggaggccacctgacccatggcgccaagccggcgttgtcgggcaagtggttcaacgccgtgcagtatggcgtgaaccgcgagtcgatgctgatcgactatgaccaggtcgaagcgcttgcgaaggaacacaagccgagcctgatcatcgccggcttctccgcgtatccacgccagctcgatttcgcccgcttccgcgcgatcgccgacagcgtcggtgcgaagctgatggtcgacatggcgcacatcgccggtgtgattgctgcgggccgtcattcgaacccggtcgattatgctcacgtcgtcacttcgacgacgcacaagaccctccgaggcccgcgcggcggattcgtgctgaccaaccatgaagaaatcgccaagaagatcaactcggccgtgttccccgggctgcagggtggcccgttgatgcacgtgattgcagccaaggcggtggcgttcggcgaggcgatgacgtcggacttcaggacctatatcgacaacgtgctcgcgaacgccaaggccctcggcgaagtgttgaaggaaggcggcgtcgacctggtcaccggcggcaccgacaaccatctgctgctggtcgatcttcgcccgaaagggctcaagggcacgcaggtcgagcaggcgctcgaacgtgccggcatcacctgcaacaagaacggcattccattcgacaccgagaagccgaccatcacgtccggcatccggctcggcgcgccggccgccacgacgcgcggcttcggtgttgcggagttccgcgagatcggccgcctgatcctcgaggtgttcgaagcgctgcgcgcgaatccggagggcgacgctgtcaccgagcagcgcgtgcgccagcaaatcttcgcgctgtgcgatcgcttcccgatctactga

SEQ ID NO: 9316 - protein, 424 aa, Ralstonia eutropha
MSNTQSFFSQPLAERDALVRGALSKELERQQSQVELIASENIVSRAVLEAQGSVLTNKYAEGYPGKRYYGGCKFADEVESLAIERVKQLFNAGFANVQPHSGAQANGSVMLALTKPGDTVLGMSLDAGGHLTHGAKPALSGKWFNAVQYGVNRESMLIDYDQVEALAKEHKPSLIIAGFSAYPRQLDFARFRAIADSVGAKLMVDMAHIAGVIAAGRHSNPVDYAHVVTSTTHKTLRGPRGGFVLTNHEEIAKKINSAVFPGLQGGPLMHVIAAKAVAFGEAMTSDFRTYIDNVLANAKALGEVLKEGGVDLVTGGTDNHLLLVDLRPKGLKGTQVEQALERAGITCNKNGIPFDTEKPTITSGIRLGAPAATTRGFGVAEFREIGRLILEVFEALRANPEGDAVTEQRVRQQIFALCDRFPIY

SEQ ID NO: 9317 - DNA, 1275 bp, Ralstonia solanacearum
  CDS (1)..(1275): transl_table=11
atgtcgaacactcagtcattcttctcgcagtcgctggccgagcgcgacgcgcccatccgcagctcgcttctgaaagaacttgagcggcagcaatcgcaagtggagttgatcgcgtcggagaacatcgtgtcgcgcgccgtgctcgaagcacagggctcggtgttgaccaacaagtatgcggaaggctatccgggcaagcgctactacggcggctgcgaatatgcagacgaggtggaatcgctcgcgatcgaccgtgtgaagcagctctttaacgccggctttgccaacgtgcagccgcactcgggggcacaggcaaacggcgcggtcatgctggcactcaccaaaccgggcgacacggtgctgggcatgtcgctggatgcaggcggccacttgacgcacggggcaaagcctgccctgtcaggtaaatggttcaacgccatgcagtacggcgtgaatcgcgacacgatgctgatcgactacgaacaggttgaaaagctcgcgcaagagcacaaaccgagtttgatcatcgccgggttctccgcctacccgcgcaagctggatttcgcccgcttccgtgccattgccgacagcgtgggcgcaaagctgatggtcgacatggcgcacattgccggcgtgattgccgctggccgccatgacaaccccgtcgatcacgcgcacgtcgtcacgtcgaccacgcacaagacactgcgtggcccgcgcggcggtttcgtgctgaccaacgatgaagagatcgccaagaagatcaactccgccgtgtttccgggcctgcagggcggcccgctgatgcacgtgattgcgggcaaggccgttgcgtttggcgaggcgctcaagcccgagttcaagacctatatcgacagcgtgctggcgaacgcgaaggccctgggcgaagtgctgaaggcgggcggcgttgacctggtcacgggcggcaccgacaaccatctgttgcttgttgacctgcggccgaaggggctcaaggggacgcaggtggagcaggcgctggagcgtgccggtatcacctgcaacaagaacggcattccgtttgacaccgagaaaccgactatcacgtcgggcatccgccttggtacgccggcggccacgacgcgcggtttcggggtggccgagttcgagcagatcggccggctgatcctcgaggttttcgaggcgctgcgtgccaatccggatggcgacagggccaccgagcaccgcgtgcgcagcgaaatcttcgcgctgtgcgaccgcttcccgatctactga

SEQ ID NO: 9318 - protein, 424 aa, Ralstonia solanacearum
MSNTQSFFSQSLAERDAPIRSSLLKELERQQSQVELIASENIVSRAVLEAQGSVLTNKYAEGYPGKRYYGGCEYADEVESLAIDRVKQLFNAGFANVQPHSGAQANGAVMLALTKPGDTVLGMSLDAGGHLTHGAKPALSGKWFNAMQYGVNRDTMLIDYEQVEKLAQEHKPSLIIAGFSAYPRKLDFARFRAIADSVGAKLMVDMAHIAGVIAAGRHDNPVDHAHVVTSTTHKTLRGPRGGFVLTNDEEIAKKINSAVFPGLQGGPLMHVIAGKAVAFGEALKPEFKTYIDSVLANAKALGEVLKAGGVDLVTGGTDNHLLLVDLRPKGLKGTQVEQALERAGITCNKNGIPFDTEKPTITSGIRLGTPAATTRGFGVAEFEQIGRLILEVFEALRANPDGDRATEHRVRSEIFALCDRFPIY

SEQ ID NO: 9319 - DNA, 1314 bp, Rhizobium loti
  CDS (1)..(1314): transl_table=11
atggcagagcccggcacatacggacggtcttccttggtccaggtcgattgccgcgttcatgaactgcttctacgacagaggcggcaagagcggacgatgctcaaacttatcgcatctgagaactttgcctcctcagccgtactggaagcgaccggctctatcttcgcgaacaagtatgccgagggctacccgggtgcgcgctactacgcgggaaatgagatcgtcgatgagcttgagaccctcgcgatcgagcgcctgaaagcgctatttggcagtgagcacgccaacgtccagccttattcgggctcaccagccaaccaggctgtctatcgcgcgcttttgagcccccgtgacaaagtcatggggctgccgttgcccgaagggggccatctgactcatgggtggtccgtcaacttttccggcactgattatcaacgcgtcccctatgggctgcacgataagacgcagcaaattgactatgaccgcttgcgcgagaccgccaggcgggaacggccgaaactcatttgggtcggcggaacttcctacccgcgtgtctttgactacgcggcaatggcagaaatcgctctggaggcgaactcttatctcgtggccgacatcgcccacatcagcggcctgattgtcgctggagcgcatccgaatcccgtggtccattgcgacgtcgtcaccagcacatctcacaagtcgatccgcggcccccgtggaggctttattttgtcgaagaatgaagatcgttatcaggcgctctatcattccacgagcaaacacaatctcgccaaacggattgatcgcgcggtgtttcctcaactgcaaggtgggccgcacatgaataccatcgccgcgctcgctgttgctttgcaggaagccgcgaccccctctttccgcacctacggtcaccagatcgtcaagaatgccaaggcgctggccgaggcgcttctgggtcgtggttattatctggtcaccggcgggactgacaatcacatgctgatccttgatcttcgggaccggccgctatcaggcaaagcctatgccgagcgcctggcaagggcaggcatcattacgaactttgatatggtgccgggcgacccgcgcgacccgacggtcacaagcggaatccgcttggggtcgccggcagtgacgtccatgggcatgcgtgaggcggaaatggtgcagatcgccgctttcatcgactccgtctgccgccagcccgacgaccaggaagttcatgcgagcgtacgaagagacgttgccgacttctgcactgcgttcgacgtccccggcatcagcgaccggtaa

SEQ ID NO: 9320 - protein, 437 aa, Rhizobium loti
MAEPGTYGRSSLVQVDCRVHELLLRQRRQERTMLKLIASENFASSAVLEATGSIFANKYAEGYPGARYYAGNEIVDELETLAIERLKALFGSEHANVQPYSGSPANQAVYRALLSPRDKVMGLPLPEGGHLTHGWSVNFSGTDYQRVPYGLHDKTQQIDYDRLRETARRERPKLIWVGGTSYPRVFDYAAMAEIALEANSYLVADIAHISGLIVAGAHPNPVVHCDVVTSTSHKSIRGPRGGFILSKNEDRYQALYHSTSKHNLAKRIDRAVFPQLQGGPHMNTIAALAVALQEAATPSFRTYGHQIVKNAKALAEALLGRGYYLVTGGTDNHMLILDLRDRPLSGKAYAERLARAGIITNFDMVPGDPRDPTVTSGIRLGSPAVTSMGMREAEMVQIAAFIDSVCRQPDDQEVHASVRRDVADFCTAFDVPGISDR

SEQ ID NO: 9321 - DNA, 1269 bp, Rhizobium meliloti
  CDS (1)..(1269): transl_table=11
atgcctggtttattcgaaagacagctcaagcatgattcggtcattgccggagcgatcgcgcgcgagatggggcggcaacgatccgagatcgaactgatcgcgtcggagaacatagtgtcgccagctgttcttgccgcgcaaggctccgtcatgaccaacaaatatgccgagggctatccggggcaccgctattatggtggatgccaatatgtcgatctcgtcgaggccgctgcgatagaacgcgctggaatgctgtttgacgcatcgttcgtcaacgtgcagccgcactccggtgcgcaggccaacggcgccgtcatgctcgccctgttgaagccgggcgacaccttcatgggcctgtcgcttgccgccggtggccatcttacccatggggctcggcccaccatgtcagggaagtggttcaacgccgtccaatatggcgttcgcgagagcgattgcctcattgactacgacgagctcgaagtaaaggccatagcgacgcggccgaagctgatcattaccggcgggtcggcctatccgcgtctgatcgacttcaagcgaattcgggcgatcgcagattctgtcggggcggccatgatggtcgatatggcgcattttgccggtctagtcgctggaggggtgcatcctaacccggttgaaatcgccgacatcgtcaccacgacaacgcacaagacgctgcgcggccctcgcggcggtatgatcctgaccaataatcaggacgtagcgaaaaaggtgaactctgcggtgtttccgggattgcagggcggtccgctgatgcatgtcatagcggcaaaggcggtggcgttgggcgaggcgcttgaagacaacttcaggcaatacgctcgccagatggtggccaatgcccgggcccttgcctcagcgctgaccgaacgaggctacgatatcgtttcgggggggaccgatacgcatttgatcctggttgacctgcgcagcaaaggggtttccggcaaggatgcggaagaagctttggggcgtgccgggctgacctgcaacaagaacggcattcccttcgatccagcgccccccgctgtaacttccggcatccggctcggcacgccagcggccaccagccgcggtttccgcgaagcggagttcaacgaagtcggcgcgttgatcgccaacgtcctcgacgcccttggcaccgagcaaagtggcgaacaggagcgccgcgcgagaatgtcggtccacgatctttgcgcggccttcccgatctactcggcgcggcattga

SEQ ID NO: 9322 - protein, 422 aa, Rhizobium meliloti
MPGLFERQLKHDSVIAGAIAREMGRQRSEIELIASENIVSPAVLAAQGSVMTNKYAEGYPGHRYYGGCQYVDLVEAAAIERAGMLFDASFVNVQPHSGAQANGAVMLALLKPGDTFMGLSLAAGGHLTHGARPTMSGKWFNAVQYGVRESDCLIDYDELEVKAIATRPKLIITGGSAYPRLIDFKRIRAIADSVGAAMMVDMAHFAGLVAGGVHPNPVEIADIVTTTTHKTLRGPRGGMILTNNQDVAKKVNSAVFPGLQGGPLMHVIAAKAVALGEALEDNFRQYARQMVANARALASALTERGYDIVSGGTDTHLILVDLRSKGVSGKDAEEALGRAGLTCNKNGIPFDPAPPAVTSGIRLGTPAATSRGFREAEFNEVGALIANVLDALGTEQSGEQERRARMSVHDLCAAFPIYSARH

SEQ ID NO: 9323 - DNA, 1305 bp, Rhodopseudomonas palustris
  CDS (1)..(1305): transl_table=11
atgggtccatccgttgcgccgcacgccgtccacacgatcgcaaacccgggcgttagcgccgccggcctagtcgcggctgatcacgctgtcgcggccgcgatcgccgatgaagaaacccgccagcgcgactcgatcgagctgatcgcctcggagaacttcgtcagccgggcggtcctcgacgcgcagggatcggtgctgaccaacaaatatgccgaaggctatccgcaccgtcgctactacggcggttgcgcgaatgtcgacgcgatcgaggatctggtgatcgcccgtgtcaatcagctgttcggcagcgcctacgccaacgtccagccgcattcgggaagccaggccaatcaggcggtgtttctcgcactgctcgcgcccggcgatacgatcctcggcctggatttgaaggccggcggccatctgacccatggggcgccggtcaacatgtccggccgctggttcaaggccgtcagctacggcgtcgaccccgagacccatcgcatcgacatggatcaggtggcggtgcaggcgcgccagcatcgcccaaggctgctgattgcaggcgggtcggcctatccgcggatcatcgatttcggccgcttccgccagatcgccgacgaggttggagcgatcctgatggtcgacatggcccacttcgccgggctcgtggccggaggcgtttatccgtcgcctgttccgtttgccgatgtcgttacctcgacgacgcacaagacgcttcgtgggccgcgcggcgggttcgttctgaccaacgatgcgaacatcgccaagaagatcaattcagcgacgttccccgggcttcagggcggcccgctgatgcatgtgatcgcggcgaaggccgtcgcttttggcgaggcgctgcaaccggagttcggagcctatgcgcaggccgtcgtcgagaattgccgcgtgctggcgcaagcgcttgcggatggcgggctgacgatcacctcgggcggcaccgattgccatctcgccgttgtcgatctgcggccattcggcgtgaccggtaatatcgccgagcaggccttggagtccgtggggatcacgctcaacaagaacgcgatcccgaacgatccggagaagccaatggtgacgtcgggcatccgtgtgggaacggctgccggcacgtcccgcggcttcggcgcggatcagtatcgcgagattgccgggcttgtcctcgaaacgctgcacgccgtccgcgccggaacgttggatgcagcggggcaagagatcaacaagagcgttcggcggctggccgcgagctttccgctcccttactga

SEQ ID NO: 9324 - protein, 434 aa, Rhodopseudomonas palustris
MGPSVAPHAVHTIANPGVSAAGLVAADHAVAAAIADEETRQRDSIELIASENFVSRAVLDAQGSVLTNKYAEGYPHRRYYGGCANVDAIEDLVIARVNQLFGSAYANVQPHSGSQANQAVFLALLAPGDTILGLDLKAGGHLTHGAPVNMSGRWFKAVSYGVDPETHRIDMDQVAVQARQHRPRLLIAGGSAYPRIIDFGRFRQIADEVGAILMVDMAHFAGLVAGGVYPSPVPFADVVTSTTHKTLRGPRGGFVLTNDANIAKKINSATFPGLQGGPLMHVIAAKAVAFGEALQPEFGAYAQAVVENCRVLAQALADGGLTITSGGTDCHLAVVDLRPFGVTGNIAEQALESVGITLNKNAIPNDPEKPMVTSGIRVGTAAGTSRGFGADQYREIAGLVLETLHAVRAGTLDAAGQEINKSVRRLAASFPLPY

SEQ ID NO: 9325 - DNA, 1293 bp, Rhodospirillum rubrum
  CDS (1)..(1293): transl_table=11
atgaccgcctacaccccttggaccggattcttttccgcctccgtcgcccaagccgatcccgagcttgaccgggtgctgcgggccgagttgtcccgccagcaggaccagatcgagctgatcgcctcggaaaacatcgtgtcccgcgccgtcctcgaggccgcgggcagcgttttgaccaataaatacgccgaaggctatcccggcaagcgctactacggcggctgcgaagaggtcgacgtggccgaggagttggccatcgagcgggccaaggcgttgttcggctgctcctacgttaacgtccagccccattccggcgcccaggccaatggcgcggtgatgatggccctggtcaagcccggcgacaccatcatgggcatgagcctggccgccggcggtcacctgacccatggcgcgccgccggcccaatcgggcaagtggttcaacgccgtgcagtacggcgtccgcctgcaagacgccagcatcgatttcgacgaggtggcgaccctggccgaaacccacaagcccaagctgatcatcgccggcggctcggcctatccccgcatcatcgatttcgccaagttccgcgagatcgccgatcgggtcggcgcgctgttcatggtcgatatggcccatttcgccggtctggtggccgccgggctccaccccagcccgctgccctatgccgatatcgtcaccaccaccacccataaaaccctgcgcggcccgcgcggcggcatggtgttgtcgaacaatcccgacatcggcaagaagatcaattcggcggtcttccccgggctgcagggcggccccttgatgcatatcatcgccgccaaggccgtggccttcggcgaggcgctgcgccccgagttcaaggtctatgcccaggcggtgatcgataacgccaaggcgctgaccgacgccctcgccgccggcgggctgaacatcgtgtcgggcggcaccgatacccacctcgccctggtcgatctgcggcccaaggctttgaccggcaatatcgtcgagaagagcctggagcgggccaatatcaccaccaacaagaacggcattcccttcgacccggaaaagccggccatcacctcgggcatccgcgtcggcaccccggcgggcaccacccggggctttggcaccgccgagttcaccgagatcggcaagctgatcgtcgaagtgctcgacgggctggcggccaatggcgaggacaattcccaggccgaggccgccgtgcgcgaaaaggtcgccgtcctttgccgtcgctttcccatatatggtgggttataa

SEQ ID NO: 9326 - protein, 430 aa, Rhodospirillum rubrum
MTAYTPWTGFFSASVAQADPELDRVLRAELSRQQDQIELIASENIVSRAVLEAAGSVLTNKYAEGYPGKRYYGGCEEVDVAEELAIERAKALFGCSYVNVQPHSGAQANGAVMMALVKPGDTIMGMSLAAGGHLTHGAPPAQSGKWFNAVQYGVRLQDASIDFDEVATLAETHKPKLIIAGGSAYPRIIDFAKFREIADRVGALFMVDMAHFAGLVAAGLHPSPLPYADIVTTTTHKTLRGPRGGMVLSNNPDIGKKINSAVFPGLQGGPLMHIIAAKAVAFGEALRPEFKVYAQAVIDNAKALTDALAAGGLNIVSGGTDTHLALVDLRPKALTGNIVEKSLERANITTNKNGIPFDPEKPAITSGIRVGTPAGTTRGFGTAEFTEIGKLIVEVLDGLAANGEDNSQAEAAVREKVAVLCRRFPIYGGL

SEQ ID NO: 9327 - DNA, 1308 bp, Vibrio cholerae
  CDS (1)..(1308): transl_table=11
atgaatgcaaatctaaacaaagcttatcccaacgttagccttgagaacttcttctctaccccactggcggcgaccaacgatgcggtatttgccgccattcaagctgaatacacccgccaaaatgaacagatcgaactgattgcctctgaaaacatcgtctctaaagccgtaatgcaggcgcaaggcacttgcctgactaacaaatacgccgaaggttatcccggccgtcgttactacggcggttgtgagcatgttgacagcgttgagcagattgctatcgaacgcgccaaaatgctttttcagtgtcaatacgcaaacgttcaaccacactcaggcgctcaagccaatggcgctgtgatgcttgctctgctgcaaccgggcgacactattatgggtatgtcgctagatgcaggcggtcatctcacgcatggtgcgcgccctgctctttcaggtaaatggttcaatgcggtgcaatacggtgtggatcgccaaaccctcgaaattaactacgattctgttcgtgcactggcgttagagcacaaacccaaaatgatcatcgcaggcggcagtgccattccccgcactatcgattttgctcaatttcgctcaattgtggacgaagttggcgcgctgttgatggtcgatatggcgcacattgccggattggtagcaactggcgcacatccaagcccattgccgcatgctcatgtcgtcaccactaccacacacaaaactctacgtggcccgcgcggcggcatgattttgaccaacagcgaagagatccacaaaaagatcaattctgcggtgttccccggtttacaaggtggcccactgatgcacgtgattgccgctaaagcagtggcatttggtgaagcgctcggccctgaattccgtacttatattgattcggtgatcgataacgcaaaagtgctggctgaagtgttgcaaactcgcgggtgtgacattgtgactggcggaacggatacgcatctcatgttggtcgaccttagacctaaaggtttgaaaggcaaccaagttgaacaagccttagagcgtgccgggatcacgtgtaacaaaaatggcatcccatttgacgaagagaagcctatgattacatcgggcattcgtttaggtacgcctgccggaaccagccgtggtttcggtcgtgaagaattcaaactcatcggtgagtggattggggacgttctggatggtttggtggccagcccagaaggcaacccagacgttgagcaacaagtgcgtaaacaagtgaaagcactgtgccaacgcttcccgctctatcaatag

SEQ ID NO: 9328 - protein, 435 aa, Vibrio cholerae
MNANLNKAYPNVSLENFFSTPLAATNDAVFAAIQAEYTRQNEQIELIASENIVSKAVMQAQGTCLTNKYAEGYPGRRYYGGCEHVDSVEQIAIERAKMLFQCQYANVQPHSGAQANGAVMLALLQPGDTIMGMSLDAGGHLTHGARPALSGKWFNAVQYGVDRQTLEINYDSVRALALEHKPKMIIAGGSAIPRTIDFAQFRSIVDEVGALLMVDMAHIAGLVATGAHPSPLPHAHVVTTTTHKTLRGPRGGMILTNSEEIHKKINSAVFPGLQGGPLMHVIAAKAVAFGEALGPEFRTYIDSVIDNAKVLAEVLQTRGCDIVTGGTDTHLMLVDLRPKGLKGNQVEQALERAGITCNKNGIPFDEEKPMITSGIRLGTPAGTSRGFGREEFKLIGEWIGDVLDGLVASPEGNPDVEQQVRKQVKALCQRFPLYQ

SEQ ID NO: 9329 - DNA, 1296 bp, Vibrio parahaemolyticus
  CDS (1)..(1296): transl_table=11
atgaataagagttaccctaaccacagcttggaaaactttttctctaccaacctctctgcgacagatgacgctgtctttgccggaattcaggcggaattcactcgccaaaacgaacaaatagaacttatcgcctctgagaacattgtgtctaaagcggtaatgcaagctcaaggcacatgcctaacaaacaaatacgctgaaggttatccaggtcgccgttactatggtggttgtgagcacgtagatacagtggaagccattgctatcgaacgcgcaaaaaaactttttaattgcgaatacgcaaacgttcaacctcactcaggcgctcaagcaaacggcgcagtgaaactggcactacttcaacctggcgacaccattcttggcatgtctttggacgcaggtggccacctaacacacggtgcacgccctgctctatctggcaagtggtttaatgcagttcaatacggcgttgatcgtgaaacactagaaatcaactacgatgatgtgcgcgctctggcgctagaacacaaaccaaagatgatcatcgcaggcggtagcgcgattccacgtactatcgatttcgcaaagttccgtgaaatcgccgacgaagtgaacgcaatcctaatggtcgatatggcgcacatcgcaggccttatcgcaacaggcgcacaccctagcccattgccacacgcacacgttgtgaccacgacaacgcacaaaacactgcgtggtccacgcggaggcatgattctgactaaccacgaagacatcattaagaagatcaattcggcggtattcccaggcctacaaggcggtccattaatgcacgttatcgccgctaaagcggtcgcatttggtgaagcacttggccctgaatttaaaacttatattgattcggtgatcaataacgcaaaagtcctagcggaagtattgcaaactcgcggttgcgacatcgtaaccggtggtacagatacgcacttaatgcttgttgaccttcgtcctaaaggcttgaaaggcaacaaagcagaagaagctctagagcgtgctgggatcacatgtaacaaaaatggcatcccattcgatacagagaagcctatgattacatcgggcatccgtttaggaacgcctgcgggtacaagccgcggctttggcgctgaagaattcaaactcatcggtaattggattggtgacgtactggacggtttggtgaacaacccagaaggtgacgcaatcgttgagaaacgcgttcgcaaagaagtaaaagagctttgcagtcgcttccctctttaccagtaa

SEQ ID NO: 9330 - protein, 431 aa, Vibrio parahaemolyticus
MNKSYPNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTILGMSLDAGGHLTHGARPALSGKWFNAVQYGVDRETLEINYDDVRALALEHKPKMIIAGGSAIPRTIDFAKFREIADEVNAILMVDMAHIAGLIATGAHPSPLPHAHVVTTTTHKTLRGPRGGMILTNHEDIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGIRLGTPAGTSRGFGAEEFKLIGNWIGDVLDGLVNNPEGDAIVEKRVRKEVKELCSRFPLYQ

SEQ ID NO: 9331 - DNA, 1296 bp, Vibrio vulnificus
  CDS (1)..(1296): transl_table=11
atgaatagtcattaccaaaatcacagcttggaaaactttttctcgactaacttgtctgcaacggatgatgccgtttttgctggtattcaagccgaatttacacgtcaaaatgaacaaatcgaattgatcgcttctgagaacatcgtgtctaaagcggtcatgcaagcgcaaggcacctgcctcaccaataaatacgcagaaggttacccaggtcgtcgttactacggtggttgtgaacacgttgataccgtggaagccatcgctatcgaacgcgcgaaaaaactttttaattgcgaatacgcaaacgttcaaccgcactctggcgctcaagccaacggcgcggtgaaactggcgctattgcaacctggcgacaccattatgggcatgtcgctcgatgcaggtggccacttaactcacggtgcacgccctgctctttcgggcaaatggtttaacgccgttcaatacggcgttgataaagagacgctcgaaatcaactacgatgatgttcgcgcactggcggtagaacacaaaccaaaaatgattattgctggtggcagcgcgattcctcgcgtgattgattttgccaagttccgtgaaatcgctgacgaagttggcgcgattttgatggtcgatatggcgcacatcgcgggtttgatcgccacaggcgcacaccctagcccactgcctcatgcacacgtggtgaccaccaccacacacaaaacgctacgcggcccacgcggcggcatgatcctcaccaatcacgaagaaatcattaagaaaatcaactctgcggtattccctggcctacaaggcggcccgctgatgcacgtgattgcagcgaaagcagtggcgtttggcgaagcactcggccctgagttcaaaacttatatcgattcggtgatcgataacgcaaaagttcttgctgaagtgttgcaaactcgcggttgtgacattgtgactggcggaacggacacgcacctaatgctggttgatcttcgtcctaagggattgaaaggtaacaaagcagaagaagcactagagcgtgcggggatcacatgtaacaaaaatggcatcccattcgacacagaaaaacctatgattacatcgggtgttcgtttgggcacgccagcgggtacaagccgaggctttggcgcagaagaattcaaattaataggtcactggattggtgatgttctcgatgggttagttgaaaacccagagggcaacgcagaagtagaacaacgcgtgcgtaaagaagtaaaagcactctgttcacgcttcccactttaccagtaa

SEQ ID NO: 9332 - protein, 431 aa, Vibrio vulnificus
MNSHYQNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTIMGMSLDAGGHLTHGARPALSGKWFNAVQYGVDKETLEINYDDVRALAVEHKPKMIIAGGSAIPRVIDFAKFREIADEVGAILMVDMAHIAGLIATGAHPSPLPHAHVVTTTTHKTLRGPRGGMILTNHEEIIKKINSAVFPGLQGGPLMHVIAAKAVAFGEALGPEFKTYIDSVIDNAKVLAEVLQTRGCDIVTGGTDTHLMLVDLRPKGLKGNKAEEALERAGITCNKNGIPFDTEKPMITSGVRLGTPAGTSRGFGAEEFKLIGHWIGDVLDGLVENPEGNAEVEQRVRKEVKALCSRFPLYQ

SEQ ID NO: 9333 - DNA, 1296 bp, Vibrio vulnificus
  CDS (1)..(1296): transl_table=11
atgaatagtcattaccaaaatcacagcttggaaaactttttctcgactaacttgtctgcaacggatgatgccgtttttgctggtattcaagccgaatttactcgtcaaaatgaacaaatcgaattgatcgcttctgagaacatcgtgtcgaaagcggtcatgcaagcgcaaggcacctgcctcaccaataaatatgcagaaggttacccaggccgtcgttactacggtggttgtgaacacgttgataccgtggaagccatcgctatcgaacgcgcgaaaaaactttttaattgcgaatacgcaaacgttcaaccgcactctggcgctcaagccaacggcgcggtgaaactggcgctattgcaacctggcgacaccattatgggcatgtcgctcgatgcaggtggccacttaactcacggtgcgcgccctgctctttcgggcaaatggtttaacgccgttcaatacggtgttgataaagagacgctcgaaatcaactacgatgatgttcgcgcactggcggtagaacacaaaccaaaaatgattattgctggtggtagcgcgattcctcgcgtgattgattttgccaagttccgtgaaatcgctgacgaagttggcgcgattttaatggttgatatggcgcacatcgcgggtttgatcgctacaggcgcacaccctagcccactgcctcatgcacacgtggtgaccaccaccacacacaaaacgctacgcggaccacgcggcggcatgatcctcaccaatcacgaagaaatcattaagaaaatcaactctgcggtattccctggcctacaaggcggcccgctgatgcacgtgattgcagcgaaagcggtggcgtttggcgaagcactcggccctgagttcaaaacttatatcgattcggtgatcaataacgcaaaagttcttgctgaagtgttgcaaactcgcggttgtgacattgtgactggcggaacggacacgcacctaatgctggttgatcttcgtcctaagggattgaaaggcaacaaagcagaagaggcactagagcgtgcggggatcacatgtaacaaaaatggcatcccattcgacacagaaaaacctatgattacatcgggtgttcgtttgggcacgccagcgggtacaagccgaggctttggcgcagaagaattcaaattaataggtcactggattggtgatgttctcgacgggttagttgaaaaccctgagggcaacgcggaagtagaacaacgcgtgcgtaaagaagtaaaagcactctgttcacgcttcccactttaccagtaa

SEQ ID NO: 9334 - protein, 431 aa, Vibrio vulnificus
MNSHYQNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTIMGMSLDAGGHLTHGARPALSGKWFNAVQYGVDKETLEINYDDVRALAVEHKPKMIIAGGSAIPRVIDFAKFREIADEVGAILMVDMAHIAGLIATGAHPSPLPHAHVVTTTTHKTLRGPRGGMILTNHEEIIKKINSAVFPGLQGGPLMHVIAAKAVAFGEALGPEFKTYIDSVINNAKVLAEVLQTRGCDIVTGGTDTHLMLVDLRPKGLKGNKAEEALERAGITCNKNGIPFDTEKPMITSGVRLGTPAGTSRGFGAEEFKLIGHWIGDVLDGLVENPEGNAEVEQRVRKEVKALCSRFPLYQ

SEQ ID NO: 9335 - DNA, 1296 bp, Colwellia psychrerythraea
  CDS (1)..(1296): transl_table=11
atgaaaaacacttacacatctggtgaactagaacaatttttttcaagcgatctatcttctactgatggcgcagttcaagtggctatagaccttgaagaagcgcgtcaaaatcaacaaatagaattaatcgcttcagagaacattgtttcaaaagcagttatggaagctcaaggcacggtattaacaaataaatacgctgaaggttaccctggccgtcgttactatggtggttgtgagcatgttgatctagttgaaacattggcgattgatagagccaaacttatttttaaagctgatttcgttaacgtacaacctcattcaggcgcacaagctaatggcgcagtaatgcttgctttagttaagccgggcgatacaattttaggcatgtcacttgatgctggcggccatttaacccatggcgctaaacctgcccaatcaggcaagtggttcaatgctattcattacggcgtgcgcaaagatgatatgcgtatcgattatgaccaagtattagccctggctatagaacatcagccaaaaatgatcattgctggtggctcagcaattcctcgtcaaatagattttgctaagttccgtgaaattgccgatcaagttggtgccatcttaatggttgatatggcccatattgctggtttagtcgctgcgggtgcacatcaaaatccactccctttcgccgatgtagttactacaacaacgcataaaacattaagaggccctcgtggcggcttaattttaaccaacaacccagatgtcgcgaagaaaattaattcggccgtattccctggtttgcaaggtggcccattaatgcacgttattgcggcaaaagcagtcgctttaggcgaagtactagagccttcttttggtgcctatattaaacaagtattaagtaacgctagagtcctagctagcacattgcaacaacgaggttgtgacatagttaccgatggtactgacacccatttaatgctggttgacttacgtcctaaaggattgaaaggaaataccacagaagaaagtttagaacgagcaggtattacctgtaacaaaaatggtatcccattcgattcagaaaaacctatggtaacttctggtattcgcttaggtacaccagcaggtactagccgtggttttggtaatgatgagtttgaattaattggacagtggattggtgatgttcttgatggtttagttgcaaatcccgaggacaatagcgtagcagaacaaaaagttttacagcaagttcaacaactgtgcttgagattccctttatatagctaa

SEQ ID NO: 9336 - protein, 431 aa, Colwellia psychrerythraea
MKNTYTSGELEQFFSSDLSSTDGAVQVAIDLEEARQNQQIELIASENIVSKAVMEAQGTVLTNKYAEGYPGRRYYGGCEHVDLVETLAIDRAKLIFKADFVNVQPHSGAQANGAVMLALVKPGDTILGMSLDAGGHLTHGAKPAQSGKWFNAIHYGVRKDDMRIDYDQVLALAIEHQPKMIIAGGSAIPRQIDFAKFREIADQVGAILMVDMAHIAGLVAAGAHQNPLPFADVVTTTTHKTLRGPRGGLILTNNPDVAKKINSAVFPGLQGGPLMHVIAAKAVALGEVLEPSFGAYIKQVLSNARVLASTLQQRGCDIVTDGTDTHLMLVDLRPKGLKGNTTEESLERAGITCNKNGIPFDSEKPMVTSGIRLGTPAGTSRGFGNDEFELIGQWIGDVLDGLVANPEDNSVAEQKVLQQVQQLCLRFPLYS

SEQ ID NO: 9337 - DNA, 1254 bp, Pseudomonas fluorescens
  CDS (1)..(1254): transl_table=11
atgttcagcaagcaagaccagatccagggttacgacgatgcactgctggcggcgatgaatgccgaggagcaacgtcaggaagatcacatcgagctgatcgcgtcggagaactacaccagcaaacgcgtcatgcaagcgcaaggcagcggcctgaccaacaaatacgccgaaggctatccgggcaagcgctactacggtggctgcgagcacgtcgacaaggtcgaagccctggccatcgaacgcgccaagcaactgttcggcgccgattacgccaacgtccagccgcactccggttcctcggccaacagcgccgtgtacctggccctgctgcaagcgggcgacaccattctcggcatgagcctggcccacggcggtcacctgacccacggcgccaaggtctcgtcctcgggcaagctgtacaacgccgtgcagtacggcatcgacaccaaaaccggcctgatcgattacgacgaagtcgagcgtctggctgtcgagtgcaagccgaagatgatcgtcgctggtttctcggcctactcgaaaaccctcgacttcccgcgcttccgtcagatcgccgacaaggttggcgcgctgctgttcgtcgatatggcccacgtcgccggtctggtggctgccggtctgtacccgaacccgctgccgtacgccgacgtggtcaccaccacgacccacaagaccctgcgcggtccacgtggcggcctgatcctggccaaggccaacgaagaaatcgagaagaagctcaacgcggcggtattccccggcgcccagggcggcccgctgatgcacgttatcgccggcaaggccgtgtgcttcaaggaagcgctggagcccggcttcaaggcctatcagcaacaagtgatcgacaacgcccaggcgatggcgagcgtctttatcaaacgtggctacgatgtagtgtccggcggcaccgacaaccacctgttcctggtcagcctgatccgtcagggccttaccggtaaggacgccgacgccgccctcggtcgcgcgcacatcaccgtcaacaagaacgccgtaccgaacgacccgcagtcgccgttcgtcacctccggcctgcgcatcggcaccccggcggtgaccacccgcggcttcaaggtgacccagtgcgtgacgctggccggctggatctgcgacatcctcgacaacctcggcgatgccgatgtcgaggccaacgtcgcccagcaggtttcggccctgtgcgctgacttcccggtttatcgctga

SEQ ID NO: 9338 - protein, 417 aa, Pseudomonas fluorescens
MFSKQDQIQGYDDALLAAMNAEEQRQEDHIELIASENYTSKRVMQAQGSGLTNKYAEGYPGKRYYGGCEHVDKVEALAIERAKQLFGADYANVQPHSGSSANSAVYLALLQAGDTILGMSLAHGGHLTHGAKVSSSGKLYNAVQYGIDTKTGLIDYDEVERLAVECKPKMIVAGFSAYSKTLDFPRFRQIADKVGALLFVDMAHVAGLVAAGLYPNPLPYADVVTTTTHKTLRGPRGGLILAKANEEIEKKLNAAVFPGAQGGPLMHVIAGKAVCFKEALEPGFKAYQQQVIDNAQAMASVFIKRGYDVVSGGTDNHLFLVSLIRQGLTGKDADAALGRAHITVNKNAVPNDPQSPFVTSGLRIGTPAVTTRGFKVTQCVTLAGWICDILDNLGDADVEANVAQQVSALCADFPVYR

SEQ ID NO: 9339 - DNA, 1254 bp, Acinetobacter radioresistens
  CDS (1)..(1254): transl_table=11
atgtttgccaatatttctattgccgaatttgatccagaattagctcaagcgatcaccaatgaagatgcgcgccaagaagctcatattgagttaattgcttctgaaaactactgctcacctgcagtaatggaagctcaaggttcaaaacttaccaataaatatgcagaaggctacccaggcaaacgctactacggcggttgcgaatacgtagatattattgaacaactggcgattgaccgtgctaaagaactctttggtgcagattatgctaacgttcaaccacacgccggttcacaagcaaactctgcagtttacttagctttacttaacccaggcgacactgtgttaggtatgagcttggcacatggtggtcacttgactcatggtgcaaaagtaagcttctcaggtaaaacatataacgctatccaatatggtttaaacccagaaactggcgaaattgattacgaggaagttgagcgtttagcgcttgaacacaaaccacgcatgattgttgcgggtttctctgcgtatagccaaattgtagattggcagcgtttccgcgacatcgcagacaaaattggtgcttatttatttgtagatatggcacacgtagcaggtctagtggctgcaggtgtttatccaaaccctgtgcaaattgctgacgtaacgactacgacaactcacaaaacattgcgtggcccacgttctggtctaatccttgcgaaagcaaacgaagagatcgagaaaaaattacaatctgctgtgttccctggtaaccaaggtggtccattagtacacgcagttgcagcaaaagcaatttgctttaaagaagcaatggcgcctgaatacaaagcgtatcaacaacaagttgttaaaaatgcgcaagcgatggctgaagttcttattgaacgtggttatgatgtagtatctggtggtacgaaaaaccacttgttcttgctttctttaatcaagcaagatattacaggtaaagatgcagatgcatggttaggtgctgcgcacattactgtaaacaaaaactctgtaccaaacgatccacgttcaccatttgtaacttcaggtatccgtattggtactccagcagtcactacacgtggttttggtgaagcagaagtacgtgatcttgcgagttggattgcagacattcttgacagcaaaggtgacgaagcagtaattaatactgtaaaagcaaaagtcgaagctgtttgcgcgaaattccctgtttacgcaaaataa

SEQ ID NO: 9340 - protein, 417 aa, Acinetobacter radioresistens
MFANISIAEFDPELAQAITNEDARQEAHIELIASENYCSPAVMEAQGSKLTNKYAEGYPGKRYYGGCEYVDIIEQLAIDRAKELFGADYANVQPHAGSQANSAVYLALLNPGDTVLGMSLAHGGHLTHGAKVSFSGKTYNAIQYGLNPETGEIDYEEVERLALEHKPRMIVAGFSAYSQIVDWQRFRDIADKIGAYLFVDMAHVAGLVAAGVYPNPVQIADVTTTTTHKTLRGPRSGLILAKANEEIEKKLQSAVFPGNQGGPLVHAVAAKAICFKEAMAPEYKAYQQQVVKNAQAMAEVLIERGYDVVSGGTKNHLFLLSLIKQDITGKDADAWLGAAHITVNKNSVPNDPRSPFVTSGIRIGTPAVTTRGFGEAEVRDLASWIADILDSKGDEAVINTVKAKVEAVCAKFPVYAK

SEQ ID NO: 9341 - DNA, 1535 bp, Actinobacillus actinomycetemcomitans
  CDS (190)..(1452): transl_table=11
tttaacgcaaaaaacagcacaaaaaagctcaccacagcttgcgttcgccaatcaaccgacaaatactgccgagtgaaaaattttcataattagaatgaaaaaaaacacatccggcgttattaagatttttattgcgaaaattgagtacaatagaccgcagttccaattcactaccaagaggagaacaccatgtttaaaaaaagtatgaacatcgccgattacgatcccgtgttatggcaagctattgaaaatgaaaaccgccgccaggaagaacatatcgaattaatcgcttctgaaaactatgccagcccgcgcgtaatgcaagcgcaaggttcccaattcaccaacaaatatgcggaaggctacccgggcaagcgttattatggcggttgtgaatacgcggacattgtggaacagctcgctattgagcgtgcgaaagaattattcggcgccgattatgtgaacgtgcaaccgcactccggttcgcaagccaatgcggcagtttacatggggttactcaatccgggcgataccattttaggcatgagcttagcgcacggcggtcacttaacccacggcgcgtccgtgagtttctccggcaagatttatcacgcggaacaatacggcattaccgacgaagggttaatcgactatgatgcgttacgcaaacaagcccatgacgtgaaaccgaaaatgatcgtaggcggattctccgcgtattctcaagtagtggattggaaaaaaatgcgtgaaatcgccgatgaagtgggcgcatatttattcgtggatatggcgcacgttgcgggcctggttgctgcaggtatttacccgaatccattgccgtacgcccatgtggtgaccactactacccacaaaaccttaggcggtccgcgtggcggtttgattctttcttcttgcggtgatgaagaaatctataaaaaactcaacagcgccgttttccctgcaggtcagggcggtccgttggtgcacattatcgcggcgaaagcggtgtgcttcaaagaagccttggagccggaatacaaagtgtatcaacaaaatgtgttgaaaaacgccaaagccatggtggaagtgttcaaacaacgctgttataaagtcgtttccaacggcactgaaaaccacttgttcttagtggacttagtcagccatggattgaccggtaaagccgccgatgccgcattaggcaaggccaacattaccgtcaataaaaactctgtgccgaacgatccgcaaaaaccgttcatcacttccggtatccgtgtgggcacgccttccgtcacccgtcgcggtttcaacgaagcggacgtgaaagaacttgccggctggatgtgtgacgtattagacgccatcggcaaagataacgaagcggaagtgattgccgacaccaaagacaaagtcttggcaatttgtaaacgtcttccggtttacgcgtaattttaatcaaatgaaaaaaaacaaagcggtaatgaaaattgccgctttttctttttgagaaatatgacagtcaaaatcttaca

SEQ ID NO: 9342 - protein, 420 aa, Actinobacillus actinomycetemcomitans
MFKKSMNIADYDPVLWQAIENENRRQEEHIELIASENYASPRVMQAQGSQFTNKYAEGYPGKRYYGGCEYADIVEQLAIERAKELFGADYVNVQPHSGSQANAAVYMGLLNPGDTILGMSLAHGGHLTHGASVSFSGKIYHAEQYGITDEGLIDYDALRKQAHDVKPKMIVGGFSAYSQVVDWKKMREIADEVGAYLFVDMAHVAGLVAAGIYPNPLPYAHVVTTTTHKTLGGPRGGLILSSCGDEEIYKKLNSAVFPAGQGGPLVHIIAAKAVCFKEALEPEYKVYQQNVLKNAKAMVEVFKQRCYKVVSNGTENHLFLVDLVSHGLTGKAADAALGKANITVNKNSVPNDPQKPFITSGIRVGTPSVTRRGFNEADVKELAGWMCDVLDAIGKDNEAEVIADTKDKVLAICKRLPVYA

SEQ ID NO: 9343 - DNA, 1293 bp, Anaplasma marginale
  CDS (1)..(1293): transl_table=11
atggttgggtacattggcaatgttgatataggggtgtttgacgccgaggtcgcaaacagcatgtcggcggaactagaaaggcagaacacgctgctgcagatgatcgcgtcggaaaattttgtgagtcgtgcggtcttgcaggcccagggttctgtgctaactaacaaatacgctgagggatatgcgggtagcaggtactactgcggttgcgccctagttgacgttgtggaaaacctagccgttgagcgtctctgcagactttttgggtgtaaatttgctaatgtgcagccacactctggctcccaggccaaccagcaggtttttatggcgctcttgaaacctggtgatactattcttggcatgtccctggattgcggaggacacttaacccacggtgcggcccctaatgtttcggggcggtggtttaatgccgtgtcttatggggtcaatcgcgatacggggctcatagatatggatgaggtggaggctcttgccctgtctgccaaaccctcattgattattgccggggcgtcttcatacccgcgaaggatagactttgccgcttttagggccatcgcagataaggtgggggcatatttgcttgcggacatagctcactattcggggctgattgctgggggctgctatccatcaccgtttgggcacgcgcatgtcgttacttccaccacccataagaccctccgggggcctaggggcgccgttataatgactgacgatgaagaaatacacaaaaagataaggctgtccgtgtttcctggaatgcagggtggcccgctgatgcatgtgatagcggcgaaggcggtggcgttcaaagaggctctgcatccggatttcaagctatacgcccaacaggtgctagaaaactcccgcgttcttgctggtgttttgtcttccgaggggctggatgttgtcacgggcgggactgatagccacatcgtgctacttgacctgagatcaaagggtgtaaccggcagggaagtatcttcctccttggaaagagccggtattgtgtgcaacaagaatgcggttccctttgacacagaaaaaccctgggttacttctggaataaggctgggctctgctgctgaaacctcgcgcgggcttggagtacctgagtttgaaagcatagggcgcttggttgcgaaggttgttaatgcttgttctttgggtcaagaaaaaatgtctgcggcggaagcagaggttaggcgcgaagtaaatggcctagtgcgcagccttcccatgtcggcgtttcctgtgtgtgaggtgtgctaa

SEQ ID NO: 9344 - protein, 430 aa, Anaplasma marginale
MVGYIGNVDIGVFDAEVANSMSAELERQNTLLQMIASENFVSRAVLQAQGSVLTNKYAEGYAGSRYYCGCALVDVVENLAVERLCRLFGCKFANVQPHSGSQANQQVFMALLKPGDTILGMSLDCGGHLTHGAAPNVSGRWFNAVSYGVNRDTGLIDMDEVEALALSAKPSLIIAGASSYPRRIDFAAFRAIADKVGAYLLADIAHYSGLIAGGCYPSPFGHAHVVTSTTHKTLRGPRGAVIMTDDEEIHKKIRLSVFPGMQGGPLMHVIAAKAVAFKEALHPDFKLYAQQVLENSRVLAGVLSSEGLDVVTGGTDSHIVLLDLRSKGVTGREVSSSLERAGIVCNKNAVPFDTEKPWVTSGIRLGSAAETSRGLGVPEFESIGRLVAKVVNACSLGQEKMSAAEAEVRREVNGLVRSLPMSAFPVCEVC

SEQ ID NO: 9345 - DNA, 1287 bp, Aquifex aeolicus
  CDS (1)..(1287): transl_table=11
atggaacaccttctgaaaacggaccccgaggtttttgacgctgttgtaaaggagtacgaaaggcagttttataacctggaaatgatagcctcagagaacttcacttccctcgcggtaatggaagcgacgggaagcgtcctcacgaacaagtacgcggaaggacttccgggaaagaggtattacggaggctgtgagtacgtagatgtagttgaaaatctcgccatagaaagagcaaaaaaactcttcggagcggagcacgcaaacgttcagccccactcgggttctcaggcgaacatggcggtgtactttgccgttctaaaccccggtgacaccataatgggaatggatttggcccacggaggacatctaacccacggagccaaggtaaacttcagcgggaaactctacaacgtaatccactacggtgtaaatccggaaacggagctcatagattacgaccagttgtacaaactggcaaaggagcacaaaccgaagttaatagtgggaggagcctcggcctatccacgcgtgtttgactgggcaaagatgagggaaatagcggacgaagtgggtgccctctttatggtcgacatggcacactacgctggtctcatagcgggaggcgtttaccccaatcccgtcccttacgcccagtttgtgacctcaacgacccataaaactctcaggggaccaaggagcggttttatcctaactacaaaggaatacgcaaaagccgtagacaagagcgtctttcccggaattcaaggtggtccattaatgcacgttatagcggcaaaggctgtagcttttaaagaggctatgagcgaagagttcaaggagtacgcaaaacaggttgtagaaaacgcaagggttctcgccgaagaactgaaaaagtacgggtttaagatagtcacgggaggaacggactctcacatagtcctcgttgacctcaggaataaaaacattatcggaaaagacgcggaaaaggctctggaaaaggctggaataacggtaaacaaaaacgcggtgccttttgaccctctaccgcctacaaagactagcgggataaggataggaacggctgcactcacaacgagggggatgaaggaagacgaaatgagaaagatagcaggctggataaatgaagtactttcaaacatggacgacgagaagaccatacagagagtaaggcaggaagtaagagagctgtgtgaaacttttcctttatatccggaactcaagaggagaatagatgagcttcgtagtggcaaggcaaccgatctttga

SEQ ID NO: 9346 - protein, 428 aa, Aquifex aeolicus
MEHLLKTDPEVFDAVVKEYERQFYNLEMIASENFTSLAVMEATGSVLTNKYAEGLPGKRYYGGCEYVDVVENLAIERAKKLFGAEHANVQPHSGSQANMAVYFAVLNPGDTIMGMDLAHGGHLTHGAKVNFSGKLYNVIHYGVNPETELIDYDQLYKLAKEHKPKLIVGGASAYPRVFDWAKMREIADEVGALFMVDMAHYAGLIAGGVYPNPVPYAQFVTSTTHKTLRGPRSGFILTTKEYAKAVDKSVFPGIQGGPLMHVIAAKAVAFKEAMSEEFKEYAKQVVENARVLAEELKKYGFKIVTGGTDSHIVLVDLRNKNIIGKDAEKALEKAGITVNKNAVPFDPLPPTKTSGIRIGTAALTTRGMKEDEMRKIAGWINEVLSNMDDEKTIQRVRQEVRELCETFPLYPELKRRIDELRSGKATDL

SEQ ID NO: 9347 - DNA, 1281 bp, Bacteroides fragilis
  CDS (1)..(1281): transl_table=11
atgaaaagagacgatttaattttcgatattatcgaaaaagaacatcaacgtcagttgaaaggcattgagctgatcgcatcagaaaatttcgtaagtgatcaggtgatggaggcaatgggatcttgtcttaccaataaatatgcggaaggatatccgggtaaacgctactatggtggctgtgaagtggtagaccaaagcgaacaaattgccattgaccgcctgaaagagatttttggtgcagaatgggccaatgtgcaaccccactcaggagcacaggctaatgcagccgtatttctggctgtactgaatccgggagataaattcatggggctgaatctggcacatggaggacacctttcacatggttcattagtaaacacttcgggaatcatttatactccctgcgaatataatctgaaacaggaaactgggcgcgtagattacgatcaaatggaggaagtagcattgcgtgaaaagcccaaaatgatcattggaggcggttcggcctactctcgtgaatgggattataaacgtatgcgcgaaattgccgacaaggtaggagcaattctcatgatcgacatggcacatcctgctgggttaattgcagccggtctattggataatcctgtgaaatatgcacatattgtgacttcaaccactcataagaccctccgaggacctcgtggtggcgtaatcatgatgggaaaagactttcctaatccttggggaaagaaaactccgaaaggagaaattaagatgatgtctcaactacttgactcagctgtattcccaggaatacaaggagggccgttggaacatgtgattgcagccaaagctgtagctttcggtgaatgtttgcaacccgaatataaagaatatcaaaaacaggtacaaaagaatgccgctgtattagcacaagccttgattgaccgtggtttcactattgtttcaggtggcacagataatcattccatgctggttgacttgcgtagtaaataccctactctaacaggtaaggttgcagaaaaagcactcgtatctgctgatataacagttaataaaaatatggttccgtttgatagtcgttccgcattccagacttcaggtatccgtttgggtactcctgccatcacaacacgtggtgcaaaagaagatctgatgttggaaatcgcggaaatgatcgaaaccgtattatctaacgtagaaaatgaagaagtgatagcacaagtacgtgcacgtgtcaacaagacaatggaaaaatatccgatcttcgcatattaa

SEQ ID NO: 9348 - protein, 426 aa, Bacteroides fragilis
MKRDDLIFDIIEKEHQRQLKGIELIASENFVSDQVMEAMGSCLTNKYAEGYPGKRYYGGCEVVDQSEQIAIDRLKEIFGAEWANVQPHSGAQANAAVFLAVLNPGDKFMGLNLAHGGHLSHGSLVNTSGIIYTPCEYNLKQETGRVDYDQMEEVALREKPKMIIGGGSAYSREWDYKRMREIADKVGAILMIDMAHPAGLIAAGLLDNPVKYAHIVTSTTHKTLRGPRGGVIMMGKDFPNPWGKKTPKGEIKMMSQLLDSAVFPGIQGGPLEHVIAAKAVAFGECLQPEYKEYQKQVQKNAAVLAQALIDRGFTIVSGGTDNHSMLVDLRSKYPTLTGKVAEKALVSADITVNKNMVPFDSRSAFQTSGIRLGTPAITTRGAKEDLMLEIAEMIETVLSNVENEEVIAQVRARVNKTMEKYPIFAY

SEQ ID NO: 9349 - DNA, 1248 bp, Bacillus licheniformis
  CDS (1)..(1248): transl_table=11
atgaaacatttacctgcgcaagatgaacaagtttttagcgccattcaagatgagcggaaacgtcaacagtcgaagattgagctgatcgcttctgaaaactttgtaagcgaagcggttatggaagctcaaggctcggttttaactaataaatatgcggaaggatatcctggtaaacgctactacggcggttgtgagcatgtagacgtggcagaggatatcgcgcgcgaccgcgccaagcagattttcggcgccgagcacgtcaacgttcagccgcattccggcgcacaagcgaacatggcggtatacttcacgattttggagcacggtgacactgtgttgggaatgaaccttgctcacggcggacatttaacgcacggcagccctgtcaacttcagcggtgttcagtacaacttcgttgaatacggcgttgataaagagacgcagtatattgattacgaagatgtccgtgaaaaggcgctcaaacataagcctaagctgatcgtggccggagcaagcgcatatccgcgcaccatcgattttaaaaagttccgcgaaatcgctgatgaagtcggagcctatgtgatggtggacatggcgcatatcgccggacttgtagcagcaggtcttcacccgaatcctgttccttacgctgactttgtgacgacgacaactcataaaacgcttcgcggaccgcgcggcggcatgattctttgccgtgaagagtttgcgaaacaaattgacaagtcgatcttccctggaattcaaggcggaccgttaatgcacgtgatcgctgcaaaggctgtttcctttggcgaagctttaaaggacgaattcaaaacatatgcccaaaatgtcatcaacaatgcgaagcgcttggctgaaacattgaaaaaagagggtatcgagctcgtatccggcggaacggataaccatcttgtgctggtcgacctgcgctctctcggcattaccggaaaagtggctgaaaatgtacttgatgaagtcggcatcaccgtcaacaaaaacgcgattccttatgatcctgaaaaacctttcgttacgagcggaatccgcgtcggtacagcagctgtgacgagccgcggctttgatctggaagcgatcgaagaagtgggagcgatcattgcgcttgcccttaaaaaccatgaagacgaagcgaaacttgaagaagcaaaacagcgtgtagaagcgctgacaaacagattcccgttgtataccgggcttgattactaa

SEQ ID NO: 9350 - protein, 415 aa, Bacillus licheniformis
MKHLPAQDEQVFSAIQDERKRQQSKIELIASENFVSEAVMEAQGSVLTNKYAEGYPGKRYYGGCEHVDVAEDIARDRAKQIFGAEHVNVQPHSGAQANMAVYFTILEHGDTVLGMNLAHGGHLTHGSPVNFSGVQYNFVEYGVDKETQYIDYEDVREKALKHKPKLIVAGASAYPRTIDFKKFREIADEVGAYVMVDMAHIAGLVAAGLHPNPVPYADFVTTTTHKTLRGPRGGMILCREEFAKQIDKSIFPGIQGGPLMHVIAAKAVSFGEALKDEFKTYAQNVINNAKRLAETLKKEGIELVSGGTDNHLVLVDLRSLGITGKVAENVLDEVGITVNKNAIPYDPEKPFVTSGIRVGTAAVTSRGFDLEAIEEVGAIIALALKNHEDEAKLEEAKQRVEALTNRFPLYTGLDY

SEQ ID NO: 9351 - DNA, 1254 bp, Bacillus clausii
  CDS (1)..(1254): transl_table=11
atggaacatttaaaaacgcaagatccagccgtatttgaagcgattcgccaagaacttggccggcaacgagacaaaattgaattgattgcttcagagaactttgtcagcgaagcggttatggaagcgcaaggctcggtcttgacgaataaatatgcagaaggctatcctggtcgccgttattatggtggctgcgagtatgttgatattgctgaagacgtcgcgcgcgacagagcgaaacaactttttggcgccgcatatgttaatgttcagccgcattctggcgcacaagcaaacatgggcgtttattttactattctcgaacatggagacacggtgcttggcatgaacttgtcccatggtggccatttaacgcacggcagcccagtcaattttagtggcattcaataccgttttgtggaatacggcgtccgtgaagacgacaagcgcattgattacgaagccgttagagaagcagccaagacgcaccagcctaaattaattgtagctggagcaagtgcttacccccgtgaaatcgactttaaaaaattccgggaaattgcggatgaagttggcgcttatcttatggtagacatggcccatattgctggccttgtcgctgcaggcctccatcaaaaccctgtgccatacgcccattttgtcacaacaacgactcataaaacgttacgtggcccacggggcggcatgattttgtgcaatgaggagacggcagaggaatttgggaaaaagctcgataagtcgatcttcccaggcattcaaggcggcccgcttatgcacgtgattgccgcaaaagcggttgcctttggagaagcattgtcagatgaatttaaaacgtatgccaagcaaatcattgccaatgcaaagcgccttggcgaaaagcttcaagcggaaggcgtggacatcgtttctggtggcacggataaccatttgctgttgcttgatttgcgttccttgcaattgaccggcaaagtcgctgaaaaagcgttagacgccgtcggcattacaaccaataaaaacgcaattccatttgatcctgagaaaccatttgtaacgagtggcattcgaattggcaccgccgctgttacatcgcgtggctttggggaaaacgaaatggatgaaattggcgaactcattgcactgacgctcaaaaacatcgacaatgaagaagcgctaaacagcgtccgttcacgtgttgccgcattgacaaaaacatttccgatgtacccaaatttgtaa

SEQ ID NO: 9352 - protein, 417 aa, Bacillus clausii
MEHLKTQDPAVFEAIRQELGRQRDKIELIASENFVSEAVMEAQGSVLTNKYAEGYPGRRYYGGCEYVDIAEDVARDRAKQLFGAAYVNVQPHSGAQANMGVYFTILEHGDTVLGMNLSHGGHLTHGSPVNFSGIQYRFVEYGVREDDKRIDYEAVREAAKTHQPKLIVAGASAYPREIDFKKFREIADEVGAYLMVDMAHIAGLVAAGLHQNPVPYAHFVTTTTHKTLRGPRGGMILCNEETAEEFGKKLDKSIFPGIQGGPLMHVIAAKAVAFGEALSDEFKTYAKQIIANAKRLGEKLQAEGVDIVSGGTDNHLLLLDLRSLQLTGKVAEKALDAVGITTNKNAIPFDPEKPFVTSGIRIGTAAVTSRGFGENEMDEIGELIALTLKNIDNEEALNSVRSRVAALTKTFPMYPNL

SEQ ID NO: 9353 - DNA, 1248 bp, Bacillus subtilis
  CDS (1)..(1248): transl_table=11
atgaaacatttacctgcgcaagacgaacaagtgtttaacgccattaaaaatgagcgtgaacgccaacagactaagatcgaattgattgcttctgagaactttgtaagtgaagcggttatggaagcacaaggatctgttttgacaaataagtacgcagaaggatatccgggcaaacgctactacggcggatgcgagcacgtcgatgtcgttgaagatatcgcccgtgaccgcgcgaaggaaatctttggagcggagcatgtaaacgttcagcctcattcaggcgcacaagcaaacatggcagtgtacttcacgattttggagcaaggcgatactgtacttgggatgaacctctcccacggcggccatttaacacacggaagcccagtcaacttcagcggtgttcaatataactttgttgagtacggcgtagataaagaaactcaatatattgattacgatgacgtgcgtgaaaaagccctcgctcataaaccgaagcttatcgtagcaggagcaagtgcgtatcctcgtacaatcgactttaagaaattccgtgaaattgctgatgaagtcggcgcttacttcatggtggatatggcacatatcgcaggacttgttgcggcaggccttcatccaaacccggttccttacgctgatttcgttacaacaacaacacataaaacacttcgcggtcctcgcggcggtatgatcctttgccgtgaagagtttggcaagaaaattgataaatcgatcttccctggaattcaaggcggccctctgatgcacgttattgccgcaaaagctgtttcattcggtgaagtattgcaggacgatttcaaaacatatgcacaaaacgtcatttcaaacgcgaaacgtctggctgaagccttaacgaaagagggcatccagctcgtttcaggcggaacagacaaccaccttatccttgttgaccttcgttcgctcggactgactggtaaggttgcggagcatgtacttgatgaaattggtattacgtctaacaaaaacgcgattccatatgatcctgaaaaacctttcgtaacaagcggcatccgtcttggtacagctgctgtaaccagccgcggttttgacggagacgcattagaagaagtcggtgctatcattgcgcttgcattgaaaaaccacgaagatgaaggaaaacttgaagaagcaagacagcgtgtagctgctctgactgataaatttcctttatataaagaattagattattaa

SEQ ID NO: 9354 - protein, 415 aa, Bacillus subtilis
MKHLPAQDEQVFNAIKNERERQQTKIELIASENFVSEAVMEAQGSVLTNKYAEGYPGKRYYGGCEHVDVVEDIARDRAKEIFGAEHVNVQPHSGAQANMAVYFTILEQGDTVLGMNLSHGGHLTHGSPVNFSGVQYNFVEYGVDKETQYIDYDDVREKALAHKPKLIVAGASAYPRTIDFKKFREIADEVGAYFMVDMAHIAGLVAAGLHPNPVPYADFVTTTTHKTLRGPRGGMILCREEFGKKIDKSIFPGIQGGPLMHVIAAKAVSFGEVLQDDFKTYAQNVISNAKRLAEALTKEGIQLVSGGTDNHLILVDLRSLGLTGKVAEHVLDEIGITSNKNAIPYDPEKPFVTSGIRLGTAAVTSRGFDGDALEEVGAIIALALKNHEDEGKLEEARQRVAALTDKFPLYKELDY

SEQ ID NO: 9355 - DNA, 1281 bp, Bacteroides thetaiotaomicron
  CDS (1)..(1281): transl_table=11
atgaaaagagacgacttaattttcgacatcatcgaaaaagagcaccaacgtcagctgaaaggtatcgagctgattgcatctgaaaactttgtaagtgaccaggtaatgcaggcaatgggttcttgcctgactaacaagtacgcagaaggttatccgggcaaacgttactacggaggttgtgaagtagttgaccaaagcgaacaaatcgctatcgaccgcctgaaagaaatcttcggtgccgaatgggcaaacgtacaaccgcattcaggagcacaagccaatgcagccgtatttctggctgttttgaatccaggcgacaagtttatgggattaaacctcgcacacggcggacacctttctcacggttcattagtaaacacttccggcattatctacactccttgcgaatacaatctgaatcaggaaaccggccgtgtagactacgaccagatggaagaagttgctttgcgcgaaaagccgaaaatgattatcggcggcggctctgcttattcccgcgaatgggactacaaacgtatgcgtgaaatcgcagataaagtaggcgctatcctgatgatcgacatggctcaccctgcgggtctgatcgctgccggactgttggagaacccggttaaatatgcacacatcgtcacttcgactacacataaaacacttcgcggacctcgtggtggggtcatcatgatgggaaaagatttccctaatccttggggaaagaaaactccgaagggtgaaatcaaaatgatgtctcaattactggattcagctgtattcccaggtgtacagggcggaccgttggaacacgtaatcgctgccaaagccgtagctttcggtgaaatcctgcaaccggaatacaaggaatatgcaaaacaggttcagaagaatgctgccatactggcacaggccttgatagaccgtggttttacaatcgtttccggtggtacggacaatcactccatgctggttgacctgcgtagcaaataccctgatctgacaggtaaggtagcagaaaaagcattagtttctgctgacattaccgtgaataagaacatggttccgtttgacagccgttctgctttccaaacttccggtatccgtctgggtactcctgccatcacaacccgtggtgcgaaagaagacctgatgatcgaaattgccgaaatgatcgaaacagttctgtctaacgtggaaaatgaagaggtgatcgcacaagtacgtgcacgtgtcaatgagacaatgaagaaatatcctctttttgctgattaa

SEQ ID NO: 9356 - protein, 426 aa, Bacteroides thetaiotaomicron
MKRDDLIFDIIEKEHQRQLKGIELIASENFVSDQVMQAMGSCLTNKYAEGYPGKRYYGGCEVVDQSEQIAIDRLKEIFGAEWANVQPHSGAQANAAVFLAVLNPGDKFMGLNLAHGGHLSHGSLVNTSGIIYTPCEYNLNQETGRVDYDQMEEVALREKPKMIIGGGSAYSREWDYKRMREIADKVGAILMIDMAHPAGLIAAGLLENPVKYAHIVTSTTHKTLRGPRGGVIMMGKDFPNPWGKKTPKGEIKMMSQLLDSAVFPGVQGGPLEHVIAAKAVAFGEILQPEYKEYAKQVQKNAAILAQALIDRGFTIVSGGTDNHSMLVDLRSKYPDLTGKVAEKALVSADITVNKNMVPFDSRSAFQTSGIRLGTPAITTRGAKEDLMIEIAEMIETVLSNVENEEVIAQVRARVNETMKKYPLFAD

SEQ ID NO: 9357 - DNA, 1314 bp, Bartonella henselae
  CDS (1)..(1314): transl_table=11
atgaccaagcaaggaaatgatacacaaaagcgtttttttaatgataatttacaaacagttgatgttgcaatctttgatgcgatcaggggagagtttgagcgtcaacaacatgaaattgagttgattgcgtcagagaatattgtttcaagggcagtccttgaagctcaaggatcagttttgaccaataaatatgcagaaggttatccaggaaagcgctattatggaggttgtcaatttgttgatgtgattgaaaatttagcaattgaacgagctaaaaagctttttggtgctgattttgcaaacgttcaggctaattctggtagccaaatgaatcaggctgtgtttttagctttactaaagccgggtgatacatttatggggttggatttaaattccgggggtcatcttacacatggttcatccgttaatatgtcaggaaaatggtttaaatctatttcctatggtgtacgtaaagaagatcagcttcttgatatggaggctgttgaacgccttgcaaaggaacataaacccaaacttattatagcaggtggatcggcttattctcgcttatgggattggaaaaaatttcgtgaaattgcagatgagattggtgcttatctcctcgttgatatgtctcatattgctggtttagttgctggtggtgttcatccttcacctgttccacatgcgcacattgtgacaacgacaacgcataaatcactgagaggtcctcgtggtggtttaattttaacaaatgatgaaattttagccaaaaaaattaactcagcgattttccctggtcttcagggtggtcctttaatgcacgtgattgcagctaaagctgttgcatttgaggaagctttgcaacctgttttcaaagattatagtgccaatgttgttgctaatgcaaaaaccttagcaaaaacactacagagcaacggttttgatattgtttctggcggtacggacaatcatttattgttggttgatttgcgttcaaaaaaagtgacaggaaaatgtgccgaattggctttagggcgtgctcatattacctgcaataaaaatagtattccttttgatcttgaaacaccatttataacatctggaattcgtcttggttcacctgctgcgacgacacgtggttttgcagaaaatgaatttattgaaattgctcatatgatttcggagattcttgataatctcggtatggcaaaaagtgatgaagacaatagtgccgttgaaatggttgttaggaaaaaggtggaagatatgacaaataaatttcctctttactcttaccttcacacttgttag

SEQ ID NO: 9358 - protein, 437 aa, Bartonella henselae
MTKQGNDTQKRFFNDNLQTVDVAIFDAIRGEFERQQHEIELIASENIVSRAVLEAQGSVLTNKYAEGYPGKRYYGGCQFVDVIENLAIERAKKLFGADFANVQANSGSQMNQAVFLALLKPGDTFMGLDLNSGGHLTHGSSVNMSGKWFKSISYGVRKEDQLLDMEAVERLAKEHKPKLIIAGGSAYSRLWDWKKFREIADEIGAYLLVDMSHIAGLVAGGVHPSPVPHAHIVTTTTHKSLRGPRGGLILTNDEILAKKINSAIFPGLQGGPLMHVIAAKAVAFEEALQPVFKDYSANVVANAKTLAKTLQSNGFDIVSGGTDNHLLLVDLRSKKVTGKCAELALGRAHITCNKNSIPFDLETPFITSGIRLGSPAATTRGFAENEFIEIAHMISEILDNLGMAKSDEDNSAVEMVVRKKVEDMTNKFPLYSYLHTC

SEQ ID NO: 9359 - DNA, 1314 bp, Bartonella quintana
  CDS (1)..(1314): transl_table=11
atgaccaaacaagaaaatgacatacaaaagcgcttttttaatgataatttacaaaccgttgatgttgcaatctttgatgcaatcaatggagagtttaaacgccaacaacacgaaattgaattgattgcgtcagagaatattgtttcaagggcagttcttgaagcacaggggtcaattttaaccaataagtatgcagaaggttatccaagaaagcgcttttatgggggttgtcgctttgttgatgtcgttgaagatttagcaattgaacgagcaaaacagctttttggtgctgcttttgctaacgtccaggctcattctggtagccaaatgaatcaagctgtatttttagctttactccagcctggtgatacatttatggggttggatttaaattctggtggtcatcttactcatggttcatccgttaatatgtcaggaaaatggtttgatgttgtttcttatggtgtgcgtaaagaagatcagattcttgatatggaggagattgaacgtcttgcaaaggaacataagcccaaacttattataacgggtggatcagcttattctcgcttatgggattggaaacgattccgtgaaattgcagatgagatcggtgcttatttgctcgttgatatgtctcatattgctggtttagtcgctggtggtgttcatccttcacctgtcccacatgcacatattgtaacaactacaacgcataaatcgctacgaggtcctcgtggtggtttgatattgacaaatgacgaaactttagccaggaagattaactcagcgatttttcctggtcttcaaggtggtcctttaatgcatgtaattgcagcgaaggctgttgcatttgaggaggctttgcaacctgctttcaagaattatagtgccaatgttgttgttaatgcgaaaaccttagcaaagacattacaaagtaatggttttgatattgtttctggtgggacagacaatcatttattgttggttgatttgtgttctaaaaaagtgacaggaaaacgtgctgaattggctttagggcgtgctcatattacctgtaataaaaatgctattccttttgatcttcaagcaccatctgtaacatcggggattcgtttgggatcacctgctgcgacgacacgtggtttggcggaaaatgagtttgtacaagttggtcatatgatttcagaagttcttgatggtctccagatggcaaagagcgatgaagacaataatgccgttgaaatggctgttaggaaaaaggtagaagatatgacaaataaatttcctctttactcttatcttcccatttgttaa

SEQ ID NO: 9360 - protein, 437 aa, Bartonella quintana
MTKQENDIQKRFFNDNLQTVDVAIFDAINGEFKRQQHEIELIASENIVSRAVLEAQGSILTNKYAEGYPRKRFYGGCRFVDVVEDLAIERAKQLFGAAFANVQAHSGSQMNQAVFLALLQPGDTFMGLDLNSGGHLTHGSSVNMSGKWFDVVSYGVRKEDQILDMEEIERLAKEHKPKLIITGGSAYSRLWDWKRFREIADEIGAYLLVDMSHIAGLVAGGVHPSPVPHAHIVTTTTHKSLRGPRGGLILTNDETLARKINSAIFPGLQGGPLMHVIAAKAVAFEEALQPAFKNYSANVVVNAKTLAKTLQSNGFDIVSGGTDNHLLLVDLCSKKVTGKRAELALGRAHITCNKNAIPFDLQAPSVTSGIRLGSPAATTRGLAENEFVQVGHMISEVLDGLQMAKSDEDNNAVEMAVRKKVEDMTNKFPLYSYLPIC

SEQ ID NO: 9361 - DNA, 1248 bp, Bdellovibrio bacteriovorus
  CDS (1)..(1248): transl_table=11
atgcattcaacttcactcagcttagcccaagtggatccggaaattctggccgccatcaacaaagaatctgaacgtcagcagttcggactggaaatgatcgcttctgagaactacacctccaaagctgtgatggaagctcagggctctatcctgaccaacaagtacgctgaaggctatccaggcaaacgctactatggcggctgcgtaaacgtggacacagttgaatccctggcgattgaaagagcaaagaaacttttcggcgttcagtatgccaacgtccagccacactctggatcccaggccaacatgggtgtttacctggcggcctgcaaagcgggtgaaactatcttgggcatggatctttctcacggcgggcatctgactcacgggtctccggtgaatttcagcgggatgctgttcaaagcagcttcgtacaagctggatccggaaacaggtcgtttgaattatgatacaatccgcgctacagcgaaagaggttcagccgaaactgatcattgcgggttacagtgcttatccgcgcaccttggactttgcaaaattcaaagagatcgcagacgaagtcggcgctcaactgctggtggacatggctcactttgcaggtcttgtggcaacaggccatcacccgtccccggttccttatgctgactacatcaccacgaccacacacaaaaccttgcgcggtcctcgtggcggcatgatcctgacgaactcagaagaaaaagccaagaccatgaactcccgcatcttccctggtatccagggtggaccgttggagcacgtgattgcgggtaaagccgtggccttcggcgaagctcttaaaccagagtttaaagattattccggcaaagtggttagcaacgcaaaagttctggcagaagagcttttgtctgcaggcttcaagcttgtgaccggcggcactgacaaccatttgatcctggtggatctgagcgatcgagaaatcacggggaagctggcagaaaattctttggatgaagctggcatcactgtgaataaaaacactgtgccaaatgaaaagcgctctccatttgtcacaagtggtgttcgcatcggaactcccgctttgaccacacgtggaatgggtccagcggaaatgaagcaaattgcgaaatggatcggccaagttctgaataacgctgaagatgctggtgtgaaaaaccgcgtgcatgaagaagtaaaagagctttgcaagcagttcccgatttactaa

SEQ ID NO: 9362 - protein, 415 aa, Bdellovibrio bacteriovorus
MHSTSLSLAQVDPEILAAINKESERQQFGLEMIASENYTSKAVMEAQGSILTNKYAEGYPGKRYYGGCVNVDTVESLAIERAKKLFGVQYANVQPHSGSQANMGVYLAACKAGETILGMDLSHGGHLTHGSPVNFSGMLFKAASYKLDPETGRLNYDTIRATAKEVQPKLIIAGYSAYPRTLDFAKFKEIADEVGAQLLVDMAHFAGLVATGHHPSPVPYADYITTTTHKTLRGPRGGMILTNSEEKAKTMNSRIFPGIQGGPLEHVIAGKAVAFGEALKPEFKDYSGKVVSNAKVLAEELLSAGFKLVTGGTDNHLILVDLSDREITGKLAENSLDEAGITVNKNTVPNEKRSPFVTSGVRIGTPALTTRGMGPAEMKQIAKWIGQVLNNAEDAGVKNRVHEEVKELCKQFPIY

SEQ ID NO: 9363 - DNA, 1254 bp, Borrelia burgdorferi
  CDS (1)..(1254): transl_table=11
atgagagatgatcaaatatttaatttaattgaaaaggaaaaattaagagaaagagagcatattgaacttattgcttctgaaaattttacatctttagagataaggcaggctgttggtagtattttaactaataagtatgccgaaggatatcctttgaatcgatactacggtggttgttcttttattgatgagattgaaactctggcaatttcgagagcaaaagagctttttggcgcaaagtatgccaatgttcaacctcatagcggatctcaggccaatatggctgccataatggctcttattagcccgggtgacaggattcttggtatgcaattatctcatggagggcatttaactcacggcagcagggtaaatttttctggtatattttttaacacttatttttatggtgtttctagagattctgagctaattgattatgatgaagttcttaaaatagctaaagattgcaggccaaatttaataatagctggagcttcttcttattcaagagaaattgattttaaaaaatttagagaaatagcagatgatgtttctgcttatcttttgtgtgatattgctcatattgcaggccttattgttgccggttttcataattcctcaattgatgtggcgcatcttactacaagtactacgcataaaactttaagagggccaagaggtggaataatactttctggaaaggattttgacaaattagtaaactttaatggaaaagagaagcctttgtttaatgctgtaaattctacagtttttcctggaactcaagggggtcctttagttcatgttattgcgggtaaggctattgcattcaaagaagctcttcaagaaagttttaaagaatacattgctaacgtaataaaaaatactaaagttatggctgaatatttcaaatcggaaggatttcgtattgttagtgggggcacagacaatcatttgtttttggttgatcttagtagttcggatctcaccggtgctgatgctgagaaattacttgagagcgtaaatattactttaaataaaaatgctattccttttgataaaaaaagcccttctttggcttctggtattagaattgggggcgctgctattacttctagaggcctaaatgaaagcgattctttaaatgttgctaaatttattgttagagctttaaaggcaaagtctgatattgaattaaaacaaataaaaaaggaagttgtaagatttattagagattttgacatgccttga

SEQ ID NO: 9364 - protein, 417 aa, Borrelia burgdorferi
MRDDQIFNLIEKEKLREREHIELIASENFTSLEIRQAVGSILTNKYAEGYPLNRYYGGCSFIDEIETLAISRAKELFGAKYANVQPHSGSQANMAAIMALISPGDRILGMQLSHGGHLTHGSRVNFSGIFFNTYFYGVSRDSELIDYDEVLKIAKDCRPNLIIAGASSYSREIDFKKFREIADDVSAYLLCDIAHIAGLIVAGFHNSSIDVAHLTTSTTHKTLRGPRGGIILSGKDFDKLVNFNGKEKPLFNAVNSTVFPGTQGGPLVHVIAGKAIAFKEALQESFKEYIANVIKNTKVMAEYFKSEGFRIVSGGTDNHLFLVDLSSSDLTGADAEKLLESVNITLNKNAIPFDKKSPSLASGIRIGGAAITSRGLNESDSLNVAKFIVRALKAKSDIELKQIKKEVVRFIRDFDMP

SEQ ID NO: 9365 - DNA, 1254 bp, Borrelia garinii
  CDS (1)..(1254): transl_table=11
atgagagatgatcaaatatttaatttaattgagaaagagaaattaagagaaaaagaacatattaagcttattgcatctgaaaattttacatctttagagataaggcaagctgttgggagtattttaactaataaatatgcggaaggataccctttgaatcgatattatggtggatgttcttttgttgatgagattgaaagtttagcaattttaagggcaaaagagctttttggtgcaaagtatgccaatgttcagcctcatagcggatctcaggctaatatggctgctataatggctcttattaaccctggtgacaggattcttggtatgcaattgtctcatggagggcatttaacacatggtagtagggtaaatttttctggcatattttttaacacttatttttatggcgtttctagagattctgagttgattgattatgatgaggttcttaaaatagctagagattgtagaccaaatttaataatagctggagcttcttcttattcaagagaaattgattttaaaaaatttagggaaatagcagacgatgtttctgcttatcttttgtgtgatattgcccatattgcgggccttattgttgccggttttcataattcttcgattgatgtagcacatcttactacaagtactacccataaaactttaagagggccaagaggtggaataatactttctggaaaagattttgacaaattggtaacctttaatggaaaagagaaagctttgtttaatgctgtaaattctacagttttccccggcactcaaggaggtcctttagttcatgttattgcagggaaggctattgcattcagagaggctcttcaagaaagttttagagaatacattgctaacgtaataaaaaatactaaagttatggctgaatatttcaaatcggaaggatttaggattgtcagtggaggtacagacaatcatttatttttggttgatcttagtaatttggatcttacaggtgccgatgctgagaaattgcttgagggtgtaaatattactttaaataaaaatgccattccttttgataaaaaaagtccttctttagcttctggtattagaattggaggcgctgctattacttccagaggtttaaatgaaaatgattctttaaatgttgctaaatttattgttagagctttaaagacaaggtctgacatcgaattaaaacaaatcaaaaaggaagttgtaagatttattagagattttgacatgccttaa

SEQ ID NO: 9366 - protein, 417 aa, Borrelia garinii
MRDDQIFNLIEKEKLREKEHIKLIASENFTSLEIRQAVGSILTNKYAEGYPLNRYYGGCSFVDEIESLAILRAKELFGAKYANVQPHSGSQANMAAIMALINPGDRILGMQLSHGGHLTHGSRVNFSGIFFNTYFYGVSRDSELIDYDEVLKIARDCRPNLIIAGASSYSREIDFKKFREIADDVSAYLLCDIAHIAGLIVAGFHNSSIDVAHLTTSTTHKTLRGPRGGIILSGKDFDKLVTFNGKEKALFNAVNSTVFPGTQGGPLVHVIAGKAIAFREALQESFREYIANVIKNTKVMAEYFKSEGFRIVSGGTDNHLFLVDLSNLDLTGADAEKLLEGVNITLNKNAIPFDKKSPSLASGIRIGGAAITSRGLNENDSLNVAKFIVRALKTRSDIELKQIKKEVVRFIRDFDMP

SEQ ID NO: 9367 - DNA, 1299 bp, Bradyrhizobium japonicum
  CDS (1)..(1299): transl_table=11
atgacctcagccaaaaccgcctccgcgcccgattcgtttttcaccgcctcgctcgaccaggccgacccggaaatcgcagccgccatcaagggcgagctcggccggcagcgccatgaggtcgagctgatcgcctccgagaacatcgtcagccgtgccgtgctggaagcgcagggttcggtgatgaccaacaaatatgcggaaggttatccgggcgcgcgttactatggcggttgtgagtgggtcgacgtcgccgagaacctcgcgatcgaccgcgccaagaagctgtttggcgctggcttcgccaacgtccagccgaactccggcagccagatgaaccaggcggtgttcctggcgctgctccagcccggcgacaccttcatgggcctcgacctcgcggccggcggccatctcacccatggctcgcccgtcaacatgagcggcaagtggttcaaggccgcgcactataccgtgcgccgcgaggaccagatcatcgacatggacgcggtccagaagcaggccgaggagatcaagccgaagctgatcgtcgccggcggctcggcctattcgcgcgcctgggacttcaagcgtttccgcgagatcgcggacagtgtcggcgcttacctcctggtcgacatggcccacttcgccggcctcgtcgccggcggcgtgcatgcctcgccggtgccgtatgcgcacgtcaccacaacgacgacgcacaagtcgctgcgcggtccgcgcggcggcctgatcctctctaacgacgagacactcgccaagaagctcaactcggcgatcttcccgggcctgcagggcggccccctgatgcatgtgatcgcggcgaaggcggtcgccttcggcgaggcgctgcgtccggacttcaaggtctatgcgaagaacgtcgtcgagaacgccaaagcgctggccgaggcgatgaagagccacgggttcgatattgtgtccggcggtaccgacaaccatctgatgctggtcgacctcaggccgaagggcctgaagggcaacgtctcggagaaggcgctggtccgcgcagccatcacctgcaacaagaacggcattcccttcgaccccgaaaagcccttcgtgacctcgggtctgcgtctcggcaccccggcggctacgacccgcggtttcggcgtcgctgaattccagcaggtcggcggcatgatcgccgaggttctcaacgcgatcgcgcagtccgacgacggcaaggcgccgctggtggaagccgcgatcaaggaacgggtcaaggcgctcaccgaccggttcccgatctatcagtaa

SEQ ID NO: 9368 - protein, 432 aa, Bradyrhizobium japonicum
MTSAKTASAPDSFFTASLDQADPEIAAAIKGELGRQRHEVELIASENIVSRAVLEAQGSVMTNKYAEGYPGARYYGGCEWVDVAENLAIDRAKKLFGAGFANVQPNSGSQMNQAVFLALLQPGDTFMGLDLAAGGHLTHGSPVNMSGKWFKAAHYTVRREDQIIDMDAVQKQAEEIKPKLIVAGGSAYSRAWDFKRFREIADSVGAYLLVDMAHFAGLVAGGVHASPVPYAHVTTTTTHKSLRGPRGGLILSNDETLAKKLNSAIFPGLQGGPLMHVIAAKAVAFGEALRPDFKVYAKNVVENAKALAEAMKSHGFDIVSGGTDNHLMLVDLRPKGLKGNVSEKALVRAAITCNKNGIPFDPEKPFVTSGLRLGTPAATTRGFGVAEFQQVGGMIAEVLNAIAQSDDGKAPLVEAAIKERVKALTDRFPIYQ

SEQ ID NO: 9369 - DNA, 1317 bp, Brucella suis
  CDS (1)..(1317): transl_table=11
atgtctcaagccaacgccgccacgaaagcgtcttcggacgttttcttcaatgcaagcctcgaggacatcgatcccgagattttcggtgcaatccgcaacgaacttggtcgccagcgccatgaaatcgagctgatcgcttcggaaaacatcgtttcgcgcgctgttctggaagcacagggttccatcctcaccaacaaatatgccgaaggctatccgggcaagcgctattatggcggctgccagtatgtcgatgtcgtggaagaactggcgatcgaacgcgccaagaagcttttcagtgccgaattcgccaatgttcagccgaattccggcagccagatgaatcaggcggttttcctcgcgctgcttcagccaggcgataccttcatgggcctcgaccttaattcaggtggccacctgacccacggttcgccggtcaatatgtccggcaagtggttcaatgtcgtgtcctacggcgtgcgcaaggacgatcatctgctcgacatggacgaagtcgcccgcctcgcacgcgaaaacaagcccaagcttatccttgcaggcggcacggcctattcgcgtatctgggactggaagcgtttccgcgagatcgccgatgaagtgggcgcttatctcatggtcgatatggcgcatattgccggtctcgtggctggcggtcagcatccgtcgccggttccccatgcccatgtctgcaccacgacaacgcacaaatcgcttcgcggtccgcgcggcggcatgatcctcaccaatgatgccgatattgccaagaagatcaattcggctgtcttccccggccttcagggcggcccgctgatgcatgtcatcgccggtaaggctgttgcctttgccgaggcgttgaagcttgagttcaagctctatgcgaagaatgtggtggataacgcccgtgcgcttgccgaggaattgaagtcgcacggcctcgacattgtttcgggcggcaccgacaaccatctcatgctggtcgatctgcgcccgaagaacgcaaccggcaagcgggcggaagccgctctcggacgcgccaacatcacctgcaacaagaacggcattcccttcgaccctgaaaagccgtttgtgacctccggcgtccgtcttggcacgcctgccggcaccacgcgcggcttcggcgttgcggaattcaaggaaatcggttcgctgatcgccgaggttctcgacggtttgaaggtcgccaattccgacgaaggcaatgcggctgtcgaacaggccgtgaaggaaaaggtcatcgccctgaccggccgtttcccgatgtacggctatcagggataa

SEQ ID NO: 9370 - protein, 438 aa, Brucella suis
MSQANAATKASSDVFFNASLEDIDPEIFGAIRNELGRQRHEIELIASENIVSRAVLEAQGSILTNKYAEGYPGKRYYGGCQYVDVVEELAIERAKKLFSAEFANVQPNSGSQMNQAVFLALLQPGDTFMGLDLNSGGHLTHGSPVNMSGKWFNVVSYGVRKDDHLLDMDEVARLARENKPKLILAGGTAYSRIWDWKRFREIADEVGAYLMVDMAHIAGLVAGGQHPSPVPHAHVCTTTTHKSLRGPRGGMILTNDADIAKKINSAVFPGLQGGPLMHVIAGKAVAFAEALKLEFKLYAKNVVDNARALAEELKSHGLDIVSGGTDNHLMLVDLRPKNATGKRAEAALGRANITCNKNGIPFDPEKPFVTSGVRLGTPAGTTRGFGVAEFKEIGSLIAEVLDGLKVANSDEGNAAVEQAVKEKVIALTGRFPMYGYQG

SEQ ID NO: 9371 - DNA, 1245 bp, Campylobacter jejuni
  CDS (1)..(1245): transl_table=11
atgagtttagaaatgtttgataaagaaatttttgatttaacaaacaaagagttagagcgtcaatgtgaaggtcttgaaatgatagcgagtgaaaatttcactttacctgaagtaatggaagttatgggaagtatcttgacaaacaaatacgcagaaggttatccgggtaaaagatattatggtggttgtgaatttgttgatgagattgaaactctagctattgaaagatgtaaaaaactttttaattgtaaatttgctaatgttcagcctaattcaggttctcaagctaatcaaggtgtttatgcggctttgattaatccaggtgataaaattttaggaatggatttaagtcatggcggacatttaactcatggtgcaaaagtaagttcttcgggcaaaatgtatgaaagctgtttttacggcgtagaacttgatggaagaattgattatgaaaaagtaagagaaattgctaaaaaagaaaaaccaaaacttatagtttgtggagctagtgcttatgcaagagtgattgattttgctaaatttagagaaattgctgatgaaataggtgcctatctttttgctgatatagcacatattgcaggtcttgttgtggcaggtgagcatccaagtccttttccatacgctcatgtagtaagctcaactacacataaaactttgcgtggcccaagaggtggtattattatgacaaatgatgaagagcttgctaaaaaaattaattctgccatttttccaggtattcaaggtggtcctttgatgcatgtaattgctgcaaaagcagtaggatttaaatttaatcttagcgatgagtggaaagtttatgcaaaacaagtaagaactaatgctcaagttttagctaatgttttaatggatagaaaatttaaacttgttagcgatggaacggataatcaccttgttttaatgagttttttagatcgtgaatttagtggaaaagatgcagatttagctcttggaaatgcaggtattactgcaaataaaaataccgttccaggagagattagaagtccttttatcacaagtggattaagacttggaactccagcccttactgccagaggttttaaagaaaaagaaatggaaattgtgtcaaattatattgcagatattttagatgatgttaataatgaaaaattacaagagaatattaaacaagaattaaaaaaacttgcaagtaattttattatttatgaaagggctatgttttga

SEQ ID NO: 9372 - protein, 414 aa, Campylobacter jejuni
MSLEMFDKEIFDLTNKELERQCEGLEMIASENFTLPEVMEVMGSILTNKYAEGYPGKRYYGGCEFVDEIETLAIERCKKLFNCKFANVQPNSGSQANQGVYAALINPGDKILGMDLSHGGHLTHGAKVSSSGKMYESCFYGVELDGRIDYEKVREIAKKEKPKLIVCGASAYARVIDFAKFREIADEIGAYLFADIAHIAGLVVAGEHPSPFPYAHVVSSTTHKTLRGPRGGIIMTNDEELAKKINSAIFPGIQGGPLMHVIAAKAVGFKFNLSDEWKVYAKQVRTNAQVLANVLMDRKFKLVSDGTDNHLVLMSFLDREFSGKDADLALGNAGITANKNTVPGEIRSPFITSGLRLGTPALTARGFKEKEMEIVSNYIADILDDVNNEKLQENIKQELKKLASNFIIYERAMF

SEQ ID NO: 9373 - DNA, 1323 bp, Chlorobium tepidum
  CDS (1)..(1323): transl_table=11
atggacaacgatattctgaaacggctcgaccccgaggtcttcgaggcgattgccaatgaaacaaaacgccaaaccgaaacgctcgaactgatcgcttcggagaacttcaccagcaaggcggtcatggaagcttgcggctcggtgatgaccaacaagtacgccgagggctaccccggcaagcgctactacggcggctgcgaatttgttgatgtggccgagaacctcgcccgcgaccgcgccaagaagcttttcggctgtgagtacgtcaacgtgcagccgcactccggttccagcgccaacatggcggtgcttttcgccgtgctcaagccgggcgacgccatcatgggcctcgacctctcccacggcggccacctgactcacggcagcaaggtgaacttctccggccagttctttgatgcccactcttacggcgttgacaaagagactggcatcatcgacatgaacaaggtcgaagagatggccaggcgagtcaagccgaagctcatcatcaccggcgcgagtgcctactcgcagggctttgacttcaaggcgttccgcgaagtcgccgacaaagtcggtgcgctgctcatggccgacatcgcccacccggcgggcctcgttgctgcgggcctttctgccaacccgatgccgcattgccacttcgtgaccaccaccacgcacaagaccctgcgcggcccacgcggcggcatgatcatgatgggcaaggatttcgagaatccgctcggcctgactatcaacaccaagaacggctcgcgcgtcaagatgatgtccgaggtgatcgacgccgaggtgatgcccggcatccagggcggcccgctcatgcacatcatcgccggcaaggcggttgccttcggcgaagcgctccagcccgagtttaaagcctatgcgcagcagatcaaggacaacgccgctgcaatggccgcgaagttcctcgcggcgggctaccacatcgtcagcggtggtacgaaaaaccacctcatgctgctcgacctgcgcaacaagaacgtcaacggcaaggtagccgaaaacctcctgcacgaagccggaatcacggttaacaaaaacatggtgcctttcgacgacaaatcgccgttcgtcaccagcggcatccgcatcggcaccccggcgatgaccactcgtgggatgaaggttgccgaagctgaaaagatcgttgaattcatcgatcgcgtcatcagcgctgccaacgacgccaacgtcgccgatgtctgcaaggccgtcagggctgaagttcgcgagctgtgccttggcttcccgctcaacaactacggttctctcgtctaa

SEQ ID NO: 9374 - protein, 440 aa, Chlorobium tepidum
MDNDILKRLDPEVFEAIANETKRQTETLELIASENFTSKAVMEACGSVMTNKYAEGYPGKRYYGGCEFVDVAENLARDRAKKLFGCEYVNVQPHSGSSANMAVLFAVLKPGDAIMGLDLSHGGHLTHGSKVNFSGQFFDAHSYGVDKETGIIDMNKVEEMARRVKPKLIITGASAYSQGFDFKAFREVADKVGALLMADIAHPAGLVAAGLSANPMPHCHFVTTTTHKTLRGPRGGMIMMGKDFENPLGLTINTKNGSRVKMMSEVIDAEVMPGIQGGPLMHIIAGKAVAFGEALQPEFKAYAQQIKDNAAAMAAKFLAAGYHIVSGGTKNHLMLLDLRNKNVNGKVAENLLHEAGITVNKNMVPFDDKSPFVTSGIRIGTPAMTTRGMKVAEAEKIVEFIDRVISAANDANVADVCKAVRAEVRELCLGFPLNNYGSLV

SEQ ID NO: 9375 - DNA, 1236 bp, Clostridium acetobutylicum
  CDS (1)..(1236): transl_table=11
atggattttgaaaatataaaagtaagtgattctgaagtctattctatcatagaagaagaaaatgcgagacaagaaaataatatagaacttattgcatctgaaaacttcacaagcaaagctgtaatggaagctatgggttcatatttaactaataagtatgcagaaggatatccaggaaaaagatattatggtggatgttacgtagttgataaagttgaagagcttgcacgtgaaagggcaaaaaaactttttaaagcagagcatgctaatgtacagccacattcaggttcacaagctaatatggctgtttactttgcagtattgaagccgggagacactataatgggaatgaacctaacagatggaggtcatttaactcatggaagtccagttaatttttcaggaaaactctttaatataattgcctatggtgtaagtgatgaaacagaacaaatagattatgaagcgtttagaaaaaaagccttggagtgtaagccaaagatgatagtatctggtgctagtgcatattcaagaattattgattttaagaaaataagagaaatatgcgatgaagtaggagcatatatgatggtagatatggctcatatagcaggacttgtagcagcaggacttcatccgtcaccaattccatatgctgattttgtaacaacaactactcataagactttaaggggaccaagaggcggagcaattttctgcaaggaaaagtatgcaaaggacattgataaatctgtattccctggaatgcaggggggacctttaatgcacataattgcaggaaaagcagtatgctttggagaagctttaaaggatgattttaaagattatgcacagcaaatagtaaataatgcaaaagtgtttgcagatgaacttacaaaatacggttttagaatagtttcaggtggaactgataatcaccttttattagttgatttaacgaacaaaaatataacaggaaaagatgcagaacatcttcttgattcagttggaataactgcaaacaaaaatactataccatttgagaaaaagagtccttttataacaagtggaataagaatgggtacaccttcagttacaactagaggatttaaggaagaggaaatgaaaaaagtagcgtatttcataaactatgttatagagcatagagatgaagatttaagtgaaataaggaaacaagtttcagaattatgtagtggatttcctatatataagtaa

SEQ ID NO: 9376 - protein, 411 aa, Clostridium acetobutylicum
MDFENIKVSDSEVYSIIEEENARQENNIELIASENFTSKAVMEAMGSYLTNKYAEGYPGKRYYGGCYVVDKVEELARERAKKLFKAEHANVQPHSGSQANMAVYFAVLKPGDTIMGMNLTDGGHLTHGSPVNFSGKLFNIIAYGVSDETEQIDYEAFRKKALECKPKMIVSGASAYSRIIDFKKIREICDEVGAYMMVDMAHIAGLVAAGLHPSPIPYADFVTTTTHKTLRGPRGGAIFCKEKYAKDIDKSVFPGMQGGPLMHIIAGKAVCFGEALKDDFKDYAQQIVNNAKVFADELTKYGFRIVSGGTDNHLLLVDLTNKNITGKDAEHLLDSVGITANKNTIPFEKKSPFITSGIRMGTPSVTTRGFKEEEMKKVAYFINYVIEHRDEDLSEIRKQVSELCSGFPIYK

SEQ ID NO: 9377 - DNA, 1233 bp, Clostridium perfringens
  CDS (1)..(1233): transl_table=11
atgaattttgacaacttagaaagagaagatgagcaaattgcacatcttgttcaaaaggaaaaggaaaggcaagaaaatagtatagagcttatagcttcagaaaactttgttagcaaagctgttatggaagctatgggatcatatttaacaaataaatatgctgagggttatccttcaaaaagatactatggtggatgtcacgtagtagatgaggttgaagatttagcaagagaaagagtaaaaaaattatttggggctgagcatgctaatgtacaaccacattcaggatcacaagctaatatggctgtttatttttcaatattagagccaggtgatactgtattaggaatggatttaagccatggaggacacttaactcatggttcatcagttaacttttcaggtagattatttaatttcgtgtcatatggtgtagataaagaaacagaaacaataaactatgaaactgtaagagaattagctcttaaacataaacctaaattaatagttgcaggagctagtgcatattcaagaattatagattttaaaactttaagagagatagcagatgaggtaggagcatacttaatggttgatatagctcacattgcagggcttgtagctacaggcttacatccatcaccagttccttatgctgattttgttacatcaacaactcataaaactttaagaggaccaagaggaggattaatactttgtaaagaaaaatttgcaaaagtattagataaaaatattttcccaggaatacaaggtggtcctttaatgcatataatagctgcaaaggctgtttgttttaaagaagcattagaaccaagttttaaaacatatatggagcaagttgttaaaaatgcacatgttttagcagaagctttagaagcttatggatttaaattagtttcaaatggaactgataaccatttaatacttgttgatttaactaataaagatataactggtaaagatgcagaaattcttttagatagtataggaataactttaaataaaaatactgtaccaaatgaaacaagaagcccatttgttactagtggtgttagaataggaactcctgctataacaactagaggatttaaagaagaagaaatgaaagaaatagcttctataataaatgatgctattaaagaaaaagatggagatttagaaccattaaaagcaagagttaaagctttatgtgctaagtatcctttatattaa

SEQ ID NO: 9378 - protein, 410 aa, Clostridium perfringens
MNFDNLEREDEQIAHLVQKEKERQENSIELIASENFVSKAVMEAMGSYLTNKYAEGYPSKRYYGGCHVVDEVEDLARERVKKLFGAEHANVQPHSGSQANMAVYFSILEPGDTVLGMDLSHGGHLTHGSSVNFSGRLFNFVSYGVDKETETINYETVRELALKHKPKLIVAGASAYSRIIDFKTLREIADEVGAYLMVDIAHIAGLVATGLHPSPVPYADFVTSTTHKTLRGPRGGLILCKEKFAKVLDKNIFPGIQGGPLMHIIAAKAVCFKEALEPSFKTYMEQVVKNAHVLAEALEAYGFKLVSNGTDNHLILVDLTNKDITGKDAEILLDSIGITLNKNTVPNETRSPFVTSGVRIGTPAITTRGFKEEEMKEIASIINDAIKEKDGDLEPLKARVKALCAKYPLY

SEQ ID NO: 9379 - DNA, 1305 bp, Corynebacterium efficiens
  CDS (1)..(1305): transl_table=11
atgaccgatgcccaccatgcggatgatgtccgttaccagccactgagcgagatcgatccggaggtggcccaggccatcgctggcgagctcagccgacagcgcgacacccttgagatgatcgcctccgagaactttgtgccccgttctgttctgcaggcccagggttccgttctcaccaataaatatgcagagggttaccccggccgccgttactacggtggttgcgagcaggtcgacatcatcgaggacctggcccgtgaccgtgccaaggccctgttcgatgccgagttcgccaatgtccagccgcactccggtgcccaggccaatgcagcggtcctgatgaccctggccgacccgggtgacaagatcatgggtctgtccctggcccacggtggtcacctgacccacggcatgaaactgaacttctccggcaagctctatgaagtcgccgcctacggcgtggaccccgacaccatgctcgttgacatggatcaggttcgtgagcaggccatcaaggagcagccgaaggtgatcatcgccggttggtccgcctacccccgtcacctggatttcgcggccttccgtgagatcgccgatgaggtcggagccaccctgtgggtggacatggcgcacttcgccggcctggttgccgccggtctgcaccccagcccggtgccgtacgccgatgtggtgtcctccaccgtccacaagaccctgggtggtccccgctccggcatcatcctggccaagcaggactacgccaagaagctgaactcctcggtgttcccgggccagcagggtggtccgctcatgcacgcgatcgccgccaaggccaccgccctgaagatcgccggcaccgaccagttcgccgagcgtcaggcccgcaccatcgagggtgcccgcatcctcgcggagcgtctcaccgcctccgacgccaaggccgcaggcattgatgtcctcaccggtggcaccgatgtgcacctggtcctggctgatctgcgcaactccgagatggacggccagcaggccgaggatctcctgcacgaggtcggcatcaccgtcaaccgcaacgcggttcccttcgacccgcgtccgccgatggtcacctccggtctgcgtatcggcaccccggcgctggccacccgtggtttcgatgccaccgccttcaccgaggtcgccgacatcatcggaaccgccctggcacagggcaagtccgcggatctggagtcactgcaggcccgcgtgaccaagctggctgagcagtacccgctgtacgagggtctcgaggactggaccatcgtctaa

SEQ ID NO: 9380 - protein, 434 aa, Corynebacterium efficiens
MTDAHHADDVRYQPLSEIDPEVAQAIAGELSRQRDTLEMIASENFVPRSVLQAQGSVLTNKYAEGYPGRRYYGGCEQVDIIEDLARDRAKALFDAEFANVQPHSGAQANAAVLMTLADPGDKIMGLSLAHGGHLTHGMKLNFSGKLYEVAAYGVDPDTMLVDMDQVREQAIKEQPKVIIAGWSAYPRHLDFAAFREIADEVGATLWVDMAHFAGLVAAGLHPSPVPYADVVSSTVHKTLGGPRSGIILAKQDYAKKLNSSVFPGQQGGPLMHAIAAKATALKIAGTDQFAERQARTIEGARILAERLTASDAKAAGIDVLTGGTDVHLVLADLRNSEMDGQQAEDLLHEVGITVNRNAVPFDPRPPMVTSGLRIGTPALATRGFDATAFTEVADIIGTALAQGKSADLESLQARVTKLAEQYPLYEGLEDWTIV

SEQ ID NO: 9381 - DNA, 1251 bp, Dechloromonas aromatica
  CDS (1)..(1251): transl_table=11
atgttttccgcgaaagacaccctggcaaaagttgaccctgaactctggcaggccattcaggccgaagtacagcgtcaggaagaccacatcgaactgatcgcgtccgaaaactacgtgagcaaggctgtcatggaagcccaaggctcccagctgaccaacaagtacgccgaaggctacccgggtaagcgctactacggtggctgcgaatacgttgacgtcgccgagcagatcgccatcgaccgcctgaagaagctgttcggcgccgaagccgccaacgtccagccgaattccggttcgcaggccaaccaggccgtgctgatggccttcgccaagccaggcgacaccatcatgggcatgagcctggccgaaggcggccacctgacccacggcatggcgctgaacatgtccggcaagtggttcaacgtcgtctcctacggcctgaatgaaaaggaagagatcgactacgacaagatggaagcgctggcccgcgagcacaagccgaagatcatcgtcgccggtgcctccgcctacgccctgcgcatcgactgggaacgcttcgccaagatcgccaaggaagtcggcgccattttctgggtcgacatggcccactacgccggtctgatcgccgccggattctacccgaacccggtgcctttcgccgatgtcgtgacctcgaccacgcacaagaccctgcgcggcccacgcggtggtgtcatcctgatgaaggccgagcacgaaaaggccctcaattccgccatcttcccgggcctgcaaggcggtccgctggagcatgtgatcgccgccaaggccgtcgccttcaaggaagccgcgacgcccgagttcaagaactaccaggaacaggtcatcaacaacgcccgcgtcatggcgcgcgtgctcggtgaagagcgcggtctgcgcatcgtttctggccgtaccgaaagccacgtcttcctgctcgacctgcgcgccaagaacatcaccggcaaggatgccgaagccgctctgggccgcgcccacatcacggtcaacaaaaacggcatcccgaacgacccgcagaagccgtttgttacctccggcatccgtatcggttcgccggccatgacgacgcgcggtttcaccgaaatcgaagccgagcagatcgctcatctggttgctgatgtgctggaagcaccgagcgacgaagccgtggccgcaactgttcgcgagaaagtttcggccctgtgcaagaagttcccggtctacggcgcctaa

SEQ ID NO: 9382 - protein, 416 aa, Dechloromonas aromatica
MFSAKDTLAKVDPELWQAIQAEVQRQEDHIELIASENYVSKAVMEAQGSQLTNKYAEGYPGKRYYGGCEYVDVAEQIAIDRLKKLFGAEAANVQPNSGSQANQAVLMAFAKPGDTIMGMSLAEGGHLTHGMALNMSGKWFNVVSYGLNEKEEIDYDKMEALAREHKPKIIVAGASAYALRIDWERFAKIAKEVGAIFWVDMAHYAGLIAAGFYPNPVPFADVVTSTTHKTLRGPRGGVILMKAEHEKALNSAIFPGLQGGPLEHVIAAKAVAFKEAATPEFKNYQEQVINNARVMARVLGEERGLRIVSGRTESHVFLLDLRAKNITGKDAEAALGRAHITVNKNGIPNDPQKPFVTSGIRIGSPAMTTRGFTEIEAEQIAHLVADVLEAPSDEAVAATVREKVSALCKKFPVYGA

SEQ ID NO: 9383 - DNA, 1248 bp, Dehalococcoides ethenogenes
  CDS (1)..(1248): transl_table=11
atgagctttttaaagacctcggacccggcagtttataatgccataatgcaggaaaccacccgcttaaaagaaacaattgacctcattgcttcggaaaactataccagcaaagctgttttagaagctcagggttccgttttcaccaataaatacgccgaaggttaccccggtaaaagatactacgccggatgtgaatatgcagatgccatagaagagctggctatagacagggccaagaccctgttccatgccgaacacgccaacgtccagccccattccggggctcaggctaacatggctgcctatttcgccatggtaaaacccggtgataccataatgggtcttaccctttcccatgggggacacctgacccatggttcaaaggccaatttcaccggtaaactttatcacgtaattgaatacgggctgaatgccgaaaccgaacggattgattatgacaatctggagaaactggctttggagcatcgcccccgcctgattgttaccggcgcttcggcctatccccggatactggattttgaacgtttcagagctatctgtgacaaggtagacgccaagctgatggtggatattgcccatattgccggtctggtagccgccgggcttcatccttcacccgtaccttacgctgacgtggttacctctaccagccacaaaaccctgcgcggcccgcggggcggctttatcctctgcaaagagcaatacgccaaagctattgaccaggcagtattcccggtaatacagggcggacccctcatgcaggtagttgccgccaaagcagtggcttttcaggaagctatgcagcccggttttgttacttaccagaagaaaatccttgaaaatacccaggtaatggctgaggaactccgcaaactggggcttcgcctggtttcaggcggcactgacaaccatttggtgctggtggaccttagtcccatcggggtaaacggttatgatgcccagctggcactgcgcagagccggtattgtaatcaaccgcaataccgtaccctttgccgaaaaccagaccgccaatgttccggctggtatacgcctgggctgtccggcggccaccagccgcggattcggtccggctgaaatccgccagacggtaagctggattggcaagatactcaaaaatataggcaacgaagatatagagaaacaggtgctggctgaggtaattcacctatgccgcaaattccctgttcccggcatagacgcataa

SEQ ID NO: 9384 - protein, 415 aa, Dehalococcoides ethenogenes
MSFLKTSDPAVYNAIMQETTRLKETIDLIASENYTSKAVLEAQGSVFTNKYAEGYPGKRYYAGCEYADAIEELAIDRAKTLFHAEHANVQPHSGAQANMAAYFAMVKPGDTIMGLTLSHGGHLTHGSKANFTGKLYHVIEYGLNAETERIDYDNLEKLALEHRPRLIVTGASAYPRILDFERFRAICDKVDAKLMVDIAHIAGLVAAGLHPSPVPYADVVTSTSHKTLRGPRGGFILCKEQYAKAIDQAVFPVIQGGPLMQVVAAKAVAFQEAMQPGFVTYQKKILENTQVMAEELRKLGLRLVSGGTDNHLVLVDLSPIGVNGYDAQLALRRAGIVINRNTVPFAENQTANVPAGIRLGCPAATSRGFGPAEIRQTVSWIGKILKNIGNEDIEKQVLAEVIHLCRKFPVPGIDA

SEQ ID NO: 9385 - DNA, 1239 bp, Desulfovibrio vulgaris
  CDS (1)..(1239): transl_table=11
atggacgagttgctgcttcaggaccccgaggtcggcaaggccatcattctcgaaatcgaacgtcagaccggcaagcttgagctcatcgcgtcggagaacttcgtctccgccgccgtccggcaggctcagggcagcgtcctcacccacaagtacgccgaaggctaccccggcaagcgctactacggcggatgcgagttcgtcgacatcgccgagaacatcgccatcgaacgcgcccgcaccatcttcggctgcgaatacgccaacgtgcagccccattcgggcagtcaggccaacatgggtgtctatttcgcgtgcctcaagcccggcgacaccatcctcggcatgaatctctcgcacggcggtcacctgacgcacggcagccccgtcaacttttccggtcgtctcttcaacgtggtgttctacggtgtcgagaaggagactggccgcatagactacgagcaggtggccgcactcgcacgcgagcacaagccctccctcatcgtcgccggtgctagcgcctacccccgcaccatcgacttcgcccgtttccgcgccatcgcagatgaagtgggcgcgaagctcatggtcgacatggcccacatcgcaggtctggtcgccgctggctaccaccccagccccgtgcagcacgcccactacaccacgaccaccacgcacaagacgctccgcggcccgcgcggtggcatgatcctctccaccgaggacaacggcaagacgctgaacagccagatattccccggcattcagggcggcccgctcatgcatgtcatcgccgccaaggccgtggccttcggcgaggcactgcgccccgcgttcaaggagtaccagaagcaggtggtggacaacgccgccgcccttgccggtgtgctcaccgccgccgggttcgatctcgtttcgggcggtaccgacaaccacctgatgctggtcgacctcaccagcaaggacgtcaccggcaaggacgccgagatagccctcgacaaggcgggcatcaccgtcaacaagaacaccgtcccgttcgagacccgttcgcccttcgtgacctccggtgtgcgtctcggcaccccggccctcaccacccgcggcatgaaggccgccgagatggagaaggtgggcggatggatcgtggacgccatcgccaacaccaccaatgagacccgactggcggagatcagccgcgaagtggaacgcttcgcacggcagttccccctgttcgcatggtag

SEQ ID NO: 9386 - protein, 412 aa, Desulfovibrio vulgaris
MDELLLQDPEVGKAIILEIERQTGKLELIASENFVSAAVRQAQGSVLTHKYAEGYPGKRYYGGCEFVDIAENIAIERARTIFGCEYANVQPHSGSQANMGVYFACLKPGDTILGMNLSHGGHLTHGSPVNFSGRLFNVVFYGVEKETGRIDYEQVAALAREHKPSLIVAGASAYPRTIDFARFRAIADEVGAKLMVDMAHIAGLVAAGYHPSPVQHAHYTTTTTHKTLRGPRGGMILSTEDNGKTLNSQIFPGIQGGPLMHVIAAKAVAFGEALRPAFKEYQKQVVDNAAALAGVLTAAGFDLVSGGTDNHLMLVDLTSKDVTGKDAEIALDKAGITVNKNTVPFETRSPFVTSGVRLGTPALTTRGMKAAEMEKVGGWIVDAIANTTNETRLAEISREVERFARQFPLFAW

SEQ ID NO: 9387 - DNA, 1254 bp, Escherichia coli O6
  CDS (1)..(1254): transl_table=11
atgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgctgctggaaccaggtgataccgttctgggtatgaacctggcgcatggcggtcacctgactcacggttctccggttaacttctccggtaaactgtacaacatcgttccttacggtatcgatgctaccggtcatatcgactacgccgatctggaaaaacaagccaaagaacacaagccgaaaatgattatcggtggtttctctgcatattccggcgtggtggactgggcgaaaatgcgtgaaatcgctgacagcatcggtgcttacctgttcgttgatatggcgcacgttgcgggcctggttgctgctggcgtctacccgaacccggttcctcatgctcacgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaagaagcgatggagcctgagttcaaaacttaccagcagcaggtcgctaaaaacgctaaagcgatggtagaagtgttcctcgagcgcggctacaaagtggtttccggcggcactgataaccacctgttcctggttgatctggttgataaaaacctgaccggtaaagaagcagacgccgctctgggccgtgctaacatcaccgtcaacaaaaacagcgtaccgaacgatccgaagagcccgtttgtgacctccggtattcgtgtaggtactccggcgattacccgtcgcggctttaaagaagccgaagcgaaagaactggctggctggatgtgtgacgtgctggacagcatcaatgatgaagccgttatcgagcgcatcaaaggtaaagttctcgacatctgcgcacgttacccggtttacgcataa

SEQ ID NO: 9388 - protein, 417 aa, Escherichia coli O6
MLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 9389 - DNA, 1266 bp, Ehrlichia canis
  CDS (1)..(1266): transl_table=11
atggttaggtatatcttagatcacaatttacaagatatagatgtagaagtttttgactgtatttccggagaattaaataggcaaaattctcaattacagttgatagcatcagaaaattttgttagtaaagcggttttagaagctcagggttctatattcacaaataaatatgcagaaggttatcctggtaaaagatattattgtggatgccactttgcagatattgtagagaatatagcaatagaacgtttatgtaagttatttggttgtaaatttgcaaatgttcagccgcattctggttcacaagctaatcaaggtgtatttgctgcattattaaagccaggtgatacagtagttggattatcacttgattgtggaggtcatttaactcatggttctgctcctagtatttcgggtaagtggtttaatgctgttcagtatcaagttgatcgtaatactggtttgctagatatggatgagatagaaaagctagttcttgagcataagccaacattacttattgctggttcatctgcttatcctcgtacaatagatttcaaaaggtttagagaaatagctgataaagttggagcatatcttttagctgacatagctcattatgctggattaattgctgctggagagtttccttcaccttttgaatatgctcatgttgttacatctactactcataagactttacgtggtcctaggggtgcagtaataatgactaattatgaagatattcataaaaagattcaatcttctatctttcctggtatgcaaggaggtccattaatgcatgttattgctgcaaaagctgtagcatttggagaagcattgaaacctgattttaaagattatgcaaaacaaataattaaaaattctagggttttagttgaagtatttaaagaaagagggcttaatattgttacagatgggacagattctcatatagttttagttgatttacgtcctaaaggtgttacaggtaaagatgcagtgcttgcactagaaagattgggaattatttgtaataaaaatgctattccttttgatacagaaaaaccttttgtaacttctggcttgcggtttggtagtgctgctgaaacatctagaggtttacaagaatcagagtttagagagattggtaatatggtttgtgatgttattgataacttaaaagctagtgatattgttaaagcatctgttgaacaggatgtgataaaaaaagttaaagaattaacctttgcttttatttcttaa

SEQ ID NO: 9390 - protein, 421 aa, Ehrlichia canis
MVRYILDHNLQDIDVEVFDCISGELNRQNSQLQLIASENFVSKAVLEAQGSIFTNKYAEGYPGKRYYCGCHFADIVENIAIERLCKLFGCKFANVQPHSGSQANQGVFAALLKPGDTVVGLSLDCGGHLTHGSAPSISGKWFNAVQYQVDRNTGLLDMDEIEKLVLEHKPTLLIAGSSAYPRTIDFKRFREIADKVGAYLLADIAHYAGLIAAGEFPSPFEYAHVVTSTTHKTLRGPRGAVIMTNYEDIHKKIQSSIFPGMQGGPLMHVIAAKAVAFGEALKPDFKDYAKQIIKNSRVLVEVFKERGLNIVTDGTDSHIVLVDLRPKGVTGKDAVLALERLGIICNKNAIPFDTEKPFVTSGLRFGSAAETSRGLQESEFREIGNMVCDVIDNLKASDIVKASVEQDVIKKVKELTFAFIS

SEQ ID NO: 9391 - DNA, 1239 bp, Enterococcus faecalis
  CDS (1)..(1239): transl_table=11
atggattacaaaacgtatgacccagatttatggaatgcaattgcaagagaagaagagcgccaagaaaataacttggaactaatcgcatctgagaatgtcgtgtcaaaagcagttatggctgcccaaggaagtattttaacgaataaatacgcagaaggttaccctggcaaacggtactatggtggttgtgaatttatcgatatcgtagaaaatttagctatcgatcgtgccaaagaattatttggtgcaaaattcgcgaatgtacaagcccattcaggttctcaagccaatacagcggcatacctttcattggttgaaccaggtgataccattttggggatggatttatcagctggtggtcacttaacacatggttcgcccgttaactttagtggaaaaacctataattttgtcagttatggagtggatccttcaacagaagtaatcgattacgatgtcgtgcgaattttagcaagagaacatcgtccaaaactaatcgttgcaggcgcaagtgcgtattcacgaacgattgacttcaaacgtttccgtgaaatcgctgatgaagtagatgccaagttaatggttgatatggcgcatattgcaggcttggtagcttcagggttgcacccaaatccagttccgtatgctgatatcgtaacaagtacgacccataaaacattgcgtggtcctcgtggcggtttaattttgacaaatagcgaagaattggcgaaaaaagtaaatagtagtattttcccaggcattcaaggtggcccattggaacatgtgattgccggaaaagccgcagcttttaaagaagcattggatccaagttttgctgaatatagtcagcaagtgattgcaaatgcgcaagcgatgacgaaagttttcaatcaagcgccagaagctcgtttaattagtggggcaacagataaccacttattactgattgaagtgacaggttttggtttaaatggaaaagaagcagaagctattttagatagtgtaaatattactgtcaataaaaattcaattccgtttgaacaattaagtccatttaaaacaagtggtatccgtattggaacgcctgcaattacttcacgtggttttaaagaagaagatgcggtagaagttgctaaattaatcgttcaagtcttaaaagatccagaaaatacagcagttcatgatgaagtcaaagcagctgtagcagcgctaactaaaaaatatccattatataactaa

SEQ ID NO: 9392 - protein, 412 aa, Enterococcus faecalis
MDYKTYDPDLWNAIAREEERQENNLELIASENVVSKAVMAAQGSILTNKYAEGYPGKRYYGGCEFIDIVENLAIDRAKELFGAKFANVQAHSGSQANTAAYLSLVEPGDTILGMDLSAGGHLTHGSPVNFSGKTYNFVSYGVDPSTEVIDYDVVRILAREHRPKLIVAGASAYSRTIDFKRFREIADEVDAKLMVDMAHIAGLVASGLHPNPVPYADIVTSTTHKTLRGPRGGLILTNSEELAKKVNSSIFPGIQGGPLEHVIAGKAAAFKEALDPSFAEYSQQVIANAQAMTKVFNQAPEARLISGATDNHLLLIEVTGFGLNGKEAEAILDSVNITVNKNSIPFEQLSPFKTSGIRIGTPAITSRGFKEEDAVEVAKLIVQVLKDPENTAVHDEVKAAVAALTKKYPLYN

SEQ ID NO: 9393 - DNA, 1239 bp, Geobacillus kaustophilus
  CDS (1)..(1239): transl_table=11
atgaattacttgccacaacaagatccgcaagtgttcgccgctattgagcaagagcggaagcggcaacatgcgaaaattgaactgatcgcctcggaaaactttgtcagccgcgcggtcatggaagcgcaagggtcggtgctgacgaacaaatatgcggaaggctatccgggacgccgctactacggcggttgtgaatatgtcgacatcgtcgaagatttggcgcgcgagcgagcgaagcagttgtttggagcggagcatgtgaacgtccagccgcactccggggcgcaggcgaacatggccgtttatttcaccgttcttgagcacggcgacacggtgcttggcatgaacttgtcgcacggcggccatttgacgcacggcagcccggtcaatttcagcggcattcagtacaattttgtcgaatacggcgtcgatccggaaacgcatgtcattgactatgacgacgtgcgcgaaaaagcgcgccttcaccggccgaagttgatcgtcgccggcgcgagcgcctatccgcgcatcatcgacttcgccaagttccgcgagattgccgatgaagtcggcgcctatttaatggttgacatggcccatattgccggtcttgttgcggcaggtgttcatccgaatccagtgccgtacgcccatttcgttacgacgacgacgcacaaaacgctgcgcggtccgcgcggcgggatgattttatgccaggagcagttcgccaaacagatcgacaaagccattttccctggcattcaaggcggcccgctcatgcatgtcattgccgccaaagccgtcgcgctcggcgaagcgttgcaagacgactttaaagtctacgcgaagcgcgtcgtggagaatgccaaacggctcgcagccgccttgcaaaacgaaggattcactctcatttccggcggcacggacaaccatttgctgcttgtcgatttgcgcccgcagcagctgaccgggaaaacggcggagaaagtgctcgatgaggtcgggattacggtcaacaaaaacacgattccgtacgatccggaaagcccgtttgtcacaagcggcatccgcatcggcacggccgcggtcacgacgcgcggcttcggattggaagagatggacgaaatcgccgccatcatcggccttgtgctgaaaaacgtcggcagcgaacaagcgcttgaggaagcgcgccaacgcgtcgccgctttgacggaaaagtttccgctctatcaagactaa

SEQ ID NO: 9394 - protein, 412 aa, Geobacillus kaustophilus
MNYLPQQDPQVFAAIEQERKRQHAKIELIASENFVSRAVMEAQGSVLTNKYAEGYPGRRYYGGCEYVDIVEDLARERAKQLFGAEHVNVQPHSGAQANMAVYFTVLEHGDTVLGMNLSHGGHLTHGSPVNFSGIQYNFVEYGVDPETHVIDYDDVREKARLHRPKLIVAGASAYPRIIDFAKFREIADEVGAYLMVDMAHIAGLVAAGVHPNPVPYAHFVTTTTHKTLRGPRGGMILCQEQFAKQIDKAIFPGIQGGPLMHVIAAKAVALGEALQDDFKVYAKRVVENAKRLAAALQNEGFTLISGGTDNHLLLVDLRPQQLTGKTAEKVLDEVGITVNKNTIPYDPESPFVTSGIRIGTAAVTTRGFGLEEMDEIAAIIGLVLKNVGSEQALEEARQRVAALTEKFPLYQD

SEQ ID NO: 9395 - DNA, 1248 bp, Geobacter metallireducens
  CDS (1)..(1248): transl_table=11
atgtcgatcctcgaaacctttgacccggcagtagccgaggccatccgtcatgaaaccgagcgccaggagtacaatctggagctcattgcgtccgaaaactttgtctccgaagcagtgatggaggcccaggggtcggttctgaccaacaaatatgctgaagggtaccctggcaagcgatactatggcggttgccaccatgtggatgtggtggagaaccttgcaattgagcgggcgaaagaactttttggtgccgatcatgcgaacgtccagccccactccggctcccaagccaatatggcggtttatttctcggtgctgaagccgggcgacaccattctcggcatgaatctctcccacggcggccaccttacccacggtagcccggtgaacttctcgggccggttcttcaacgtggttccctatggtgtttcccaggaaaccgagacgattgacttcaacgaagtcgagcgtctggcccttgagcataagccgaagctgatcgttgtgggggccagcgcctatccacgtgttctggattttgccgccttcagggccatagccgacaaagtgggggcgctggtcatggtggacatggcccatattgcggggctcgttgctgccggccttcacccaagcccggttccctatgccgagtttgtcaccacgacaacccacaaaaccctgcgtggaccccgcggcgggatgattctctgccgcgaggaatttgccaagaccctcaattccaatattttccccggtattcagggcggccctctcatgcatgtcatcgcggccaaggcagttgccttcaaagaggctcttgcgcctgaattcaagttgtatcaggagcagattgtcaagaatgcacggacccttgctgacgaactcatgaagcgcggcttccggcttgtctccggaggtaccgacaaccacctgatgcttgttaacctgacgggcaccgagttgaccggcaaggtggccgaggaggccctcgacaaagcgggtatcacggtcaacaagaacaccgtcccctttgagacacgctctccctttgttacctccggcttccggatcggtactcctgctgccacaagtcatggactcaaagaggcggagatggtggaagttgccgctttcatcgccgaggccttggcaaatgtggggaacgaggcaaagcttgcagaggtaaaggggaaagtgaacgcccttatgggccgttttccgctctatgccagccgcctgaagtaa

SEQ ID NO: 9396 - protein, 415 aa, Geobacter metallireducens
MSILETFDPAVAEAIRHETERQEYNLELIASENFVSEAVMEAQGSVLTNKYAEGYPGKRYYGGCHHVDVVENLAIERAKELFGADHANVQPHSGSQANMAVYFSVLKPGDTILGMNLSHGGHLTHGSPVNFSGRFFNVVPYGVSQETETIDFNEVERLALEHKPKLIVVGASAYPRVLDFAAFRAIADKVGALVMVDMAHIAGLVAAGLHPSPVPYAEFVTTTTHKTLRGPRGGMILCREEFAKTLNSNIFPGIQGGPLMHVIAAKAVAFKEALAPEFKLYQEQIVKNARTLADELMKRGFRLVSGGTDNHLMLVNLTGTELTGKVAEEALDKAGITVNKNTVPFETRSPFVTSGFRIGTPAATSHGLKEAEMVEVAAFIAEALANVGNEAKLAEVKGKVNALMGRFPLYASRLK

SEQ ID NO: 9397 - DNA, 1248 bp, Geobacter sulfurreducens
  CDS (1)..(1248): transl_table=11
atgtcgattctcgaaacctttgacccgcaggtagctgaggcgatccgccatgaaaccgaacggcaggagtacaacctggagttgatcgcttccgaaaactttgtttccgaggcggtactggaagcccagggctcggtgatgaccaataagtatgccgagggataccccggtaagcgctactatggtggatgccaccatgtggacgtggtggaaaatctcgctattgagcgggccaaggagcttttcggtgccgatcatgccaacgtccagccccattcgggctcccaggcaaatatggcggtctatttttcggtgctcaagcccggcgacaccattcttgggatgaatctgtcccacggcggccacctgacccacggcagccccgtgaacttctccggccgtttcttcaacgtggttccctacggcgtgtcccaggagaccgaaacgatcgacttcaatgaggtggagcgtcttgcccttgagcataagccgaagatgatagttgtgggggcaagcgcctatccccgaaccatcgattttgccgccttccgcatcattgccgataaggtcggcgcggttatcatggttgatatggctcacattgcgggcctggttgcggccggtctccatccgagccctgttccctacgctgaattcgtgaccaccactacccataagaccctcagaggtccccgcggcgggatgatcctgtgccgtgaggagtacgccaagacgctcaattccaacatcttccccggtatccagggggggccgctcatgcatgtcatcgcggccaaggccgttgccctcaaggaggccctccagcccgagttcaaagcgtatcaggcccagatcgtgaaaaatgccaaggcccttgccgacgagctggtaaagcgcgggttccggcttgtgtccggcggcaccgataaccatctgatgctggttaacctaaccggcaccgaactgaccggcaaggtggcggaagagtctctggataaggccggcatcacggtgaacaagaacacggtgcctttcgagacccgttcaccctttgtcacctccggtttccggatcggcactcccgcagccactacccacggtctcaaggaagctgaaatggccgacgtggcgggctttatcgcagaggccctggccaacgtggacaatgatgccaaactcgccgagattaaggggagggtcaatgtgcttatgaaacgcttccccctctatgctcaccgtctttcataa

SEQ ID NO: 9398 - protein, 415 aa, Geobacter sulfurreducens
MSILETFDPQVAEAIRHETERQEYNLELIASENFVSEAVLEAQGSVMTNKYAEGYPGKRYYGGCHHVDVVENLAIERAKELFGADHANVQPHSGSQANMAVYFSVLKPGDTILGMNLSHGGHLTHGSPVNFSGRFFNVVPYGVSQETETIDFNEVERLALEHKPKMIVVGASAYPRTIDFAAFRIIADKVGAVIMVDMAHIAGLVAAGLHPSPVPYAEFVTTTTHKTLRGPRGGMILCREEYAKTLNSNIFPGIQGGPLMHVIAAKAVALKEALQPEFKAYQAQIVKNAKALADELVKRGFRLVSGGTDNHLMLVNLTGTELTGKVAEESLDKAGITVNKNTVPFETRSPFVTSGFRIGTPAATTHGLKEAEMADVAGFIAEALANVDNDAKLAEIKGRVNVLMKRFPLYAHRLS

SEQ ID NO: 9399 - DNA, 1305 bp, Gluconobacter oxydans
  CDS (1)..(1305): transl_table=11
atgtcggaacacgccagccagtccacgctgaatcgtttctttcatgcccccctcaaggaggttgatgccgaagttgccaccatcctgaacgaggagctgacgcgccagcaggatggcatcgagctcatcgcttcggagaacatggcctcctttgccgtcatggaagcacagggttcagtgctgacgaacaagtatgcggaaggcctgccgggcaagcgctattatggcggttgcgtggatgtggaccgcgtcgagaaccttgccatcgatcgtctgaagaagatcttcggtgccgaattcgcaaacgtgcagccgcattccggcgccaatgccaaccaggccgccttcatggcgctggccaagcccggcgacacggttctgggcctgagccttgctgcgggtggacatctgacgcatggcgcagccccgaactattcgggcaagtggttcaactccgtacagtacggtgtacgcgccgaagacggtctgatcgactacgaccagatggaagccctggcccgcgagcacaagccgaagatcatcgtggctggcagctctgcctatccgcgcgtcatcgacttcgcgcgtttccgcaagattgccgatgaagtcggtgcgtatctgatggtggacatggcgcattttgccggtctggttgccgctggcctgtatccgaacccagttccgatggccgacatcaccacgtccacgacgcataagacgctgcgtggcccgcgtggtggcatcatcctgacgaacaaccccgatctggcgaagaaagtgaactccgccgtgttcccggggctgcagggcggtccgctcatgcacgtcattgcaggcaaggccgtcgcttttggcgaagccctgtcggatgagttcaaggcctatcagaagcgcgttctggccaatgcccgtgcgctggcggacgagcttcagaaccgtggcttcgacatcgtcacgggtggcacggacagccatctgatcctcgtggatctgcgtccgaagaaagtgacgggcaagctcgccgaagccatcctcgagcgcgctggcatcacggcgaacaagaacgccattccgttcgatccggaaaagccgttcgtaacctccggcatccgtctgggcagcccggcagcgacggcacgtggtttcggggaagccgagttccgcgaagtcggtcgtatgatcgacgaagtgctgacggcggctcttgaggaagacaatgccgaagccgtgacggcccgcgtgcatgaggaagtgaaggctctgtgccgccgcttcccgatctatgaccgcgcttctgcctaa

SEQ ID NO: 9400 - protein, 434 aa, Gluconobacter oxydans
MSEHASQSTLNRFFHAPLKEVDAEVATILNEELTRQQDGIELIASENMASFAVMEAQGSVLTNKYAEGLPGKRYYGGCVDVDRVENLAIDRLKKIFGAEFANVQPHSGANANQAAFMALAKPGDTVLGLSLAAGGHLTHGAAPNYSGKWFNSVQYGVRAEDGLIDYDQMEALAREHKPKIIVAGSSAYPRVIDFARFRKIADEVGAYLMVDMAHFAGLVAAGLYPNPVPMADITTSTTHKTLRGPRGGIILTNNPDLAKKVNSAVFPGLQGGPLMHVIAGKAVAFGEALSDEFKAYQKRVLANARALADELQNRGFDIVTGGTDSHLILVDLRPKKVTGKLAEAILERAGITANKNAIPFDPEKPFVTSGIRLGSPAATARGFGEAEFREVGRMIDEVLTAALEEDNAEAVTARVHEEVKALCRRFPIYDRASA

SEQ ID NO: 9401 - DNA, 1266 bp, Haemophilus influenzae
  CDS (1)..(1266): transl_table=11
atgtttacaagaaatatgactatcgctgattacgatccagtattgtggcaagcgattcaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtgagtatgctgacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatccaaatccactaccgcatgcacatgttgtgacaacaacaactcacaaaacattgggcggtccgcgtggtggtttaattctttcatcttgtggcgatgaagaaatctacaaaaaattacaatcatccgtattccctgcaaaccaagggggtccattagttcatattattgcggcaaaagcagtttgctttaaaggagcattagagcctcaatataaagaataccaagcaaatgtaatcaaaaatgcaaaagcaatggttgaagtatttaaacaacgtggttatgacgttgtgtcaaatggtactgaaaaccacttgttcttagtaagtttcatcaaacaaggattaacaggtaaagcagcagatgcggcattgggcaaagcaaatattaccgtgaataaaaatgctgtaccaaacgatccgcaaaaaccattcgtcacttctggcatccgtgtaggtacaccatctgtgactcgtcgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatga

SEQ ID NO: 9402 - protein, 421 aa, Haemophilus influenzae
MFTRNMTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYPNPLPHAHVVTTTTHKTLGGPRGGLILSSCGDEEIYKKLQSSVFPANQGGPLVHIIAAKAVCFKGALEPQYKEYQANVIKNAKAMVEVFKQRGYDVVSNGTENHLFLVSFIKQGLTGKAADAALGKANITVNKNAVPNDPQKPFVTSGIRVGTPSVTRRGFNENDVRELAGWMCDVLDALGKENEEQVIAETKEKVLAICKRLPVYPK

SEQ ID NO: 9403 - DNA, 1251 bp, Helicobacter hepaticus
  CDS (1)..(1251): transl_table=11
atggattactcaatcaaagagcaggactttgaggtctttgagctcatagaaaaagagcttgaacgacaaaatgagcatttagaaatgattgcgagtgaaaattttacttttccaagtgttatggaggctatgggaagtattttaacaaataaatatgctgaaggttacccatttaaacgctattatggaggctgtgagtttgttgataaaattgaagaaattgcgattgaacgagcaaaaaaactctttggtgcaaattttgttaatgtgcaaccacattcaggctcacaggctaatgcagcggtatatgcagcgattttaaaaccttatgataaaattttaggtatggatttaagccacggaggacatctcacacacggggctaaagtcagcacttcagggcaactttatcaaagcttcttttatggtgtagagcttaatgggcgtattgattatgataaactcgcacttcaagctcaagtggttaaaccaaatgttcttgtatgtggattctctgcttatactcgtgagcttgattttaaaagattgcgtgagattgcagattctgtaggggcttaccttatgggtgatattgctcacgtagctgggcttgtggttgcaggagaatatccaaatccttttccacattgccatattgttaccactacgacacataaaacattgcgcggacctagaggtggagcgattcttacaaatgatgaagaactctatgctaaaatcaataaggctgtatttccaggtatccaaggtggacctcttatgcatattatcgcaggaaaggcagtaggttttaaagaaaatctcaaacctgaatggaaaatttatgcaaaacaagtaaagtcaaatattcaagctcttgcagaggtgctcatcaagcgcaactatgaacttgtaagcggtggaagtgataatcatctaattttaatgagtttccttaacaaagattttagtggcaaagatgcagatttagcgcttggtaatgcgggaataacggtgaataaaaataccattccaggagaaatccgttctccttttattacaagtggtattaggattggctctcctgctctaactgcacgaggtatgaaagaaaaggagtttgaatggattggagaaaaaattgctgatattcttgatgatattaacaataccaatttgcaagaacatattaaggcacaagtcaaaaactttagtcgagattttagaatctatgaccgaccaattttttag

SEQ ID NO: 9404 - protein, 416 aa, Helicobacter hepaticus
MDYSIKEQDFEVFELIEKELERQNEHLEMIASENFTFPSVMEAMGSILTNKYAEGYPFKRYYGGCEFVDKIEEIAIERAKKLFGANFVNVQPHSGSQANAAVYAAILKPYDKILGMDLSHGGHLTHGAKVSTSGQLYQSFFYGVELNGRIDYDKLALQAQVVKPNVLVCGFSAYTRELDFKRLREIADSVGAYLMGDIAHVAGLVVAGEYPNPFPHCHIVTTTTHKTLRGPRGGAILTNDEELYAKINKAVFPGIQGGPLMHIIAGKAVGFKENLKPEWKIYAKQVKSNIQALAEVLIKRNYELVSGGSDNHLILMSFLNKDFSGKDADLALGNAGITVNKNTIPGEIRSPFITSGIRIGSPALTARGMKEKEFEWIGEKIADILDDINNTNLQEHIKAQVKNFSRDFRIYDRPIF

SEQ ID NO: 9405 - DNA, 1489 bp, Hyphomicrobium methylovorum
  CDS (154)..(1458): transl_table=11
cgcaacggccgttcccgcgcccttgttacacggggctcggggtcggttgagtgctggtgtccagcctcgtactatggttcaaagctcgttggccggacttgactccgtgtcctgagcgcgcagttaaatcactttcattttgaaggaaaacacatgtcgtccgcaccggctgcaggtactgcttctacgtcccgttttttcaagtcgcacgtgtcggagacggatcccgatattttcagcgccatccaaaaggaatttggccgccagcagcacgagatcgagctgatcgcgtctgagaacatcgtttcgcaggccgttctcgatgcagctggttcggtgctgaccaacaagtatgccgagggctatccgggcaagcgctactacggcggctgccagtacgtcgacatcgttgaagacatcgcgatcgaccgcgcaaagaagctcttcaactgcgaattcgcgaacgtgcagccgaactccggcagccaggcgaaccagggcgtgttcaatgcgctcgcgcagccgggcgacaccatcctcggtctctcgctcgctgccggtggtcacttgacccacggcgcgccggtgaaccagtccggcaagtggttcaaggccgtgcactacatggtcaagcccgactcgcacctcatcgacatggacgaagtgcgcaagctggcccaggagcacaagccgcgcatcatcatcgctggtggttcggcctatccgcgcaagatcgatttcgctgcatttcgcgcgattgcggatgaggttggcgcgatcttcctcgtcgatatggcgcacttcgccggtcttgttgcggccggtctcattccgagcccgttcccgcatgcccacgtcgtaacgacgacgacgcacaagacgctgcgcggaccccgtggcggcatgattttaacgaacgacgcggacatcgcgaagaagatcaactcggcgatcttccctggcattcagggcggcccgctcatgcacgttatcgccggtaaggccgtcgcattcggcgaggctctgcgtccggacttcaaggtctacatcaagcaggtgatggacaacgcccgcgcgctcggtgaagtgcttgtgcagaacggcttcgcgctcgtttctggcggcaccgacacgcacctcgttctcgtcgatctgcggccgaagaagctgaccggtacgaaggctgagaaggcgcttggccgtgccaacatcacctgcaacaagaacggcattccgttcgaccccgagaagccgatggtgacgtcgggcattcgtttgggttcgcctgcaggcacgacgcgcggcttcggcgttgccgaattccaggaaatcggccgcctgatctcggaagttctggatggcgttgcgaagaacggcgaagatggcaacggcgccgtcgaagcggccgtcaaggcaaaggctatcgctctttgcgatcgcttcccgatttacgcataacgctgtttacgcacatttgaagatatgcttg

SEQ ID NO: 9406 - protein, 434 aa, Hyphomicrobium methylovorum
MSSAPAAGTASTSRFFKSHVSETDPDIFSAIQKEFGRQQHEIELIASENIVSQAVLDAAGSVLTNKYAEGYPGKRYYGGCQYVDIVEDIAIDRAKKLFNCEFANVQPNSGSQANQGVFNALAQPGDTILGLSLAAGGHLTHGAPVNQSGKWFKAVHYMVKPDSHLIDMDEVRKLAQEHKPRIIIAGGSAYPRKIDFAAFRAIADEVGAIFLVDMAHFAGLVAAGLIPSPFPHAHVVTTTTHKTLRGPRGGMILTNDADIAKKINSAIFPGIQGGPLMHVIAGKAVAFGEALRPDFKVYIKQVMDNARALGEVLVQNGFALVSGGTDTHLVLVDLRPKKLTGTKAEKALGRANITCNKNGIPFDPEKPMVTSGIRLGSPAGTTRGFGVAEFQEIGRLISEVLDGVAKNGEDGNGAVEAAVKAKAIALCDRFPIYA

SEQ ID NO: 9407 - DNA, 1236 bp, Lactobacillus johnsonii
  CDS (1)..(1236): transl_table=11
atgaattatggagaaaaatcacctgcactttgggatgcaattaaaagtgaagagaaaagacaagaagatacaattgaattaattgcatcagaaaatattgtttccgatgctgtccgagaagcacaaggatctgttctcaccaataaatacgcagaaggatatcccgggaaaagatactatggtggatgtcaatatattgacaaggtagaacaattggcaattgactatgccaaaaaattatttaatgcagaatatgcaaatgtgcagcctcattctggttcacaggcaaacatgacagtttataatgctttgctaaagccaggagatactattttagggatgggtatggatgctggcggtcatcttacgcatggttcaaaggttaatttttcaggaaaaatttttaattctattagttatgacttaaatcctgaaactgaagaattggattttgatcgaattagacagcttgctatagagaagaagccaaaattaattattgctggtgcttctgcttatagcagaattattgattggcagaagtttcgtgagattgcggacgaagttggcgcctacctaatggttgatatggcgcatattgcaggtttagttgcaacgggagcacatccgagcccagttcctatagctgacgttgttacaacaactacacataaaactttgcgtggtccgcgtggaggaatgattctatctaacaataaagaattagggaagaaaattgattcggctctctttccaggaacgcaaggtggaccactagagcatgttattgctgcaaaggcacaagctttttatgaagatttacagccagaatttactcaatacattgatcaagtaattaagaattcaaaagccatggctgaagaatttaaaaatagcaaaaatattcgcgtggtttcaggtggaacagataaccacttgatgattattgatattaccaagactggtgtaacaggaaaagatgcccaaaatttgctagactctgtaaatattacgactaacaaagagtctattcctggtgataagcgaagcccatttattactagtggattaagaattggaacaccagcaataactagccgaggctttaaggaacctgatgctaaagaagtggctaaaataattattgaagttttggataagcctgaagatgcaggagtattggctgaggcaaaagaaagagttaatgatttagttcagaaatatcctattaaataa

SEQ ID NO: 9408 - protein, 411 aa, Lactobacillus johnsonii
MNYGEKSPALWDAIKSEEKRQEDTIELIASENIVSDAVREAQGSVLTNKYAEGYPGKRYYGGCQYIDKVEQLAIDYAKKLFNAEYANVQPHSGSQANMTVYNALLKPGDTILGMGMDAGGHLTHGSKVNFSGKIFNSISYDLNPETEELDFDRIRQLAIEKKPKLIIAGASAYSRIIDWQKFREIADEVGAYLMVDMAHIAGLVATGAHPSPVPIADVVTTTTHKTLRGPRGGMILSNNKELGKKIDSALFPGTQGGPLEHVIAAKAQAFYEDLQPEFTQYIDQVIKNSKAMAEEFKNSKNIRVVSGGTDNHLMIIDITKTGVTGKDAQNLLDSVNITTNKESIPGDKRSPFITSGLRIGTPAITSRGFKEPDAKEVAKIIIEVLDKPEDAGVLAEAKERVNDLVQKYPIK

SEQ ID NO: 9409 - DNA, 1239 bp, Lactobacillus plantarum
  CDS (1)..(1239): transl_table=11
atgaattaccaggaacaagatccagaagtatgggctgcgattagtaaggaacaggcacggcaacaacataatattgagttgattgcttctgagaacatcgtttcaaagggcgtccgggcagcgcaggggagtgtgctgaccaataaatactctgaaggctatccgggtcaccgcttttacggtggtaacgaatacattgaccaagtggaaaccttagcaattgaacgggctaagaaattatttggtgcggaatatgctaatgtgcaaccacactctggttcccaagccaatgcggctgcatatatggcactgattcaacctggtgaccgggtgatggggatgtcactagatgctgggggacacttaacacatggatctagtgtgaacttctctggtaaactttacgattttcaaggttatgggctcgatcctgaaaccgcagaattaaactatgatgcaattcttgcacaagcacaagattttcaaccaaagttaatcgttgcgggggcttctgcttatagtcgattgattgatttcaagaagtttcgcgagattgcagatcaagttggggccttattgatggttgatatggctcatattgccggcttagttgcggccgggctacatcctaatccagtgccatatgctgatgtggttacgacaacgacgcacaaaacgttacgggggccccgtggcggtatgattttagcgaaagaaaagtatggcaagaagatcaactcagccgttttccctggcaatcagggtgggccgttggatcacgtaattgcgggtaaagcgattgctttgggcgaagacttacagcctgagtttaaggtttatgcccaacatatcattgataatgccaaggcaatggcgaaggtcttcaatgactctgacttggttcgggttatttctggtggcacggacaatcatttaatgacgattgatgtcactaagtctggtttgaacggtcgccaagtacaagatctgttagatacggtttatattacggtcaacaaagaagcgattccgaatgagacgttaggggctttcaagacctctggtattcggttgggaacacctgcgattacgacccgtggttttgacgaagctgatgcaactaaggtcgctgaattgattttgcaagcgttacaagcaccgacagatcaagcaaatctagatgacgttaaacagcaagcaatggctttaacagcgaagcacccgatcgatgttgattaa

SEQ ID NO: 9410 - protein, 412 aa, Lactobacillus plantarum
MNYQEQDPEVWAAISKEQARQQHNIELIASENIVSKGVRAAQGSVLTNKYSEGYPGHRFYGGNEYIDQVETLAIERAKKLFGAEYANVQPHSGSQANAAAYMALIQPGDRVMGMSLDAGGHLTHGSSVNFSGKLYDFQGYGLDPETAELNYDAILAQAQDFQPKLIVAGASAYSRLIDFKKFREIADQVGALLMVDMAHIAGLVAAGLHPNPVPYADVVTTTTHKTLRGPRGGMILAKEKYGKKINSAVFPGNQGGPLDHVIAGKAIALGEDLQPEFKVYAQHIIDNAKAMAKVFNDSDLVRVISGGTDNHLMTIDVTKSGLNGRQVQDLLDTVYITVNKEAIPNETLGAFKTSGIRLGTPAITTRGFDEADATKVAELILQALQAPTDQANLDDVKQQAMALTAKHPIDVD

SEQ ID NO: 9411 - DNA, 1239 bp, Mesoplasma florum
  CDS (1)..(1239): transl_table=4
atgagtacaataaataaaaatattttagaatcacttaaaggtgaattaaaaagacaacaagatcacattgaattaatagcaagtgaaaactatgttagtgatgcagttttacaattatcaggaagtatattaactaataaatatgcagaaggttacccagataaaaggtattatggtggatgtgaatttgttgatcaaattgaaaaacaaggaattgaattagctaaaaaaatatttaatgcaggtcacgctaatttacaacctcattcaggtagtcaagctaatgaagctgtttatcgtgctttattacaaaacggagataaagttgtttctatgagtttagacgctggaggtcacttaacacatggttatccaattaatttttcaggtaataattatgattttaaattttatggagtaaatagagaaacagaagaaattgattttgatgaagttagaaaagttgttttagaacatcaaccaaaattaattgtcgctggagctagtgcttactcaagaattatagactttaaaaagtttagagaaattgcagatgaagttggagcattattaatggttgatatggctcatattgctggtttagttgctggtggtgctcacccaaaccctatggaatatgcagatgttgttacaacaacaacacacaaaactttaagaggcgcaagaggtggaatgattttatcaaaagctgaaattggtaaaaaaattgattcatcagttttcccaggtactcaaggtggacctttagaaaatcaaatagctgggaaagttcaagccttatatgaagcagatactcctgaatttaaagaatatgttcatcaagtagttgctaactcaaaagcatttgctaaagccttagcagataatggaatgagattaatagctaatggaacagataatcatttaattaatttagatgtaaaaaatactttaaatgttactggaaaagatgcagaaaaaatccttgaaagtattggtatagtttcaaataaaaacatgattccttttgatacagaaaaaccttttgttacaagtggaattagagttggaactgcagcaatgacaactagaggatttaaagaagaacaatttgttgaagttgctaaaataattgcaagtgcattaaaagatcaatcagaaacaaatttaaatactctttcaaaagaagttgctaaattatgtaagcaattcccaatatatgaacatttatcatattaa

SEQ ID NO: 9412 - protein, 412 aa, Mesoplasma florum
MSTINKNILESLKGELKRQQDHIELIASENYVSDAVLQLSGSILTNKYAEGYPDKRYYGGCEFVDQIEKQGIELAKKIFNAGHANLQPHSGSQANEAVYRALLQNGDKVVSMSLDAGGHLTHGYPINFSGNNYDFKFYGVNRETEEIDFDEVRKVVLEHQPKLIVAGASAYSRIIDFKKFREIADEVGALLMVDMAHIAGLVAGGAHPNPMEYADVVTTTTHKTLRGARGGMILSKAEIGKKIDSSVFPGTQGGPLENQIAGKVQALYEADTPEFKEYVHQVVANSKAFAKALADNGMRLIANGTDNHLINLDVKNTLNVTGKDAEKILESIGIVSNKNMIPFDTEKPFVTSGIRVGTAAMTTRGFKEEQFVEVAKIIASALKDQSETNLNTLSKEVAKLCKQFPIYEHLSY

SEQ ID NO: 9413 - DNA, 1239 bp, Methanosarcina barkeri
  CDS (1)..(1239): transl_table=11
atgtcttacattgaaaaaactgatccggaattgttcgaggctataaaaaaagaagccgagcgccaggaatataaactgaaccttatcgcatctgaaaattatgcgagtaaagccgtaatggaagctcagggatcgattctgaccaataaatatgccgaaggatattccggcaagcggtactatggtggctgcgacttcgtggacattgccgaggatctcgcgattgccagggcaaagaaaatctttaacgcaggctacgtcaacgtccagcctcactctggttctggggctaatatggctgtctatttctcggttttgaagccaggagacaccatcatgtccatggatctctctcacggcggtcatctttctcacggcagccctgtgagtttttccggaaagctctttaatattgtgccttacggggtcagtaaaaagactgagatgctggactattccgaacttatgaaaaaagcaaaggaaaacaaaccgcaaatgattgtttgtggagcttcagcttatcctcgtgaaatcgatttcaagcaattccgcgaaattgctgatgaggtaggagcctatctgcttgcagacattgcccacattgcaggtcttgtagttgcaggtgtgcacccgagtccagtaccttatgcggacttcgttaccagcacaacccacaaaactctccgaggcccaagaggcggaattattatctccaagacagaagaacttgcgaccagaattaacaaagcggttttccccggccttcagggtgggcctctcatgcacattatagccggaaaggcagtagcctttaaagaagccatgagtgaaaagttcaaacaggatcaggttcagaccgtaaagaacgcaaaaactctctgcaaatgcctgaaagagaaaggttttgatatggtatctggcgacacggataatcatcttatgcttgtcaatctcaacaatatgaatataacaggcaaggatgcagaagccgccctgagcaaagccgggattattgcaaacaaaaacacggtgccttttgagacacgcagtccatttatcacaagcggtgtaaggctcggaacccctgcctgtaccacgaggggtatgaaggaaacagaaatggaattaattgccgactatattgagaccgcaatcacaaactcagaaaacgataagatcctgtcggaaacaagtgacaaggtcagagaactctgttcaaggttccctgtttattgttaa

SEQ ID NO: 9414 - protein, 412 aa, Methanosarcina barkeri
MSYIEKTDPELFEAIKKEAERQEYKLNLIASENYASKAVMEAQGSILTNKYAEGYSGKRYYGGCDFVDIAEDLAIARAKKIFNAGYVNVQPHSGSGANMAVYFSVLKPGDTIMSMDLSHGGHLSHGSPVSFSGKLFNIVPYGVSKKTEMLDYSELMKKAKENKPQMIVCGASAYPREIDFKQFREIADEVGAYLLADIAHIAGLVVAGVHPSPVPYADFVTSTTHKTLRGPRGGIIISKTEELATRINKAVFPGLQGGPLMHIIAGKAVAFKEAMSEKFKQDQVQTVKNAKTLCKCLKEKGFDMVSGDTDNHLMLVNLNNMNITGKDAEAALSKAGIIANKNTVPFETRSPFITSGVRLGTPACTTRGMKETEMELIADYIETAITNSENDKILSETSDKVRELCSRFPVYC

SEQ ID NO: 9415 - DNA, 1257 bp, Methylococcus capsulatus
  CDS (1)..(1257): transl_table=11
atgttcagcaagggtatggaaattgccggattcgacgacgaactctgggctgcgatccaggaagaggaacgcaggcaagaggaccatatcgagctgatcgcatcggagaactatgccagcccgcgggtgctgcaggcacagggaaccgtgctgaccaacaaatacgcggaagggtatccgggcaaacgctactacggaggctgcgagtacgtcgacattgtggagacactggccatcgagcgcgcgaaacgactgttcggggctgattatgccaatgtccagccgcattccggttcgcaggccaatgccgccgtgtacatggctttgctgaagccgggcgatacggtgctgggcatgagtctggcgcacggtggacatctgacccatggcgccaaggtcaacttttcaggcaagatttacaatgccgtacaatatggactcaacccggaaaccggggagatcgattacgaccaggtcgacgaactggcccgggagcaccgtccaaagatgatcgtggccggtttctcggcctactcccaggtggtcgactggcagcgtttccgggcgattgccgactcggtcggtgcctggctcatggtcgacatggcccacgtcgcggggctgatcgcggccggcctgtaccccagcccggtgcagatcgccgacgtgaccacgaccacaacccacaagacgcttcgtggcccgcgcggtggcctgattctggccaaagccaatcccgaggtcgagaaacagctcaactcgctggttttccccggcattcaaggggggccgctgatgcatgtgatcgcggcgaaggcagtggcattaaaggaggccttgcagccggatttcaggcactaccagtcagcggtgatggagaacgccgacgccatggcgaagactttcatcgagcgcggctaccgtatcgtgtcgggcggcacccggaatcatctgttcctggtcgatctgatccaaaagggcctcaccggcaagctggcggaagaggtgttgggcagagcgcatatcaccgtcaacaaaaatgcggtgccgaacgatccgcagtcgcccttcgtgaccagcggcatccgggtggggacccccgcggtgacgacgcgcggctttggggtcgaggagtgccggctgttggcaggctggatgtgcgatatcatggactgcccgggagatgaaacggtcataggccaggtgcgcgaggaggtgacccatctgtgccggcgtttcccggtctatgccaactga

SEQ ID NO: 9416 - protein, 418 aa, Methylococcus capsulatus
MFSKGMEIAGFDDELWAAIQEEERRQEDHIELIASENYASPRVLQAQGTVLTNKYAEGYPGKRYYGGCEYVDIVETLAIERAKRLFGADYANVQPHSGSQANAAVYMALLKPGDTVLGMSLAHGGHLTHGAKVNFSGKIYNAVQYGLNPETGEIDYDQVDELAREHRPKMIVAGFSAYSQVVDWQRFRAIADSVGAWLMVDMAHVAGLIAAGLYPSPVQIADVTTTTTHKTLRGPRGGLILAKANPEVEKQLNSLVFPGIQGGPLMHVIAAKAVALKEALQPDFRHYQSAVMENADAMAKTFIERGYRIVSGGTRNHLFLVDLIQKGLTGKLAEEVLGRAHITVNKNAVPNDPQSPFVTSGIRVGTPAVTTRGFGVEECRLLAGWMCDIMDCPGDETVIGQVREEVTHLCRRFPVYAN

SEQ ID NO: 9417 - DNA, 1500 bp, Methylobacterium extorquens
  CDS (196)..(1500): transl_table=11
gtggggctagccgaatgcgctgcggtgccgcagaacggggctgatcccgttaaaaattttgaagacaggcgaaaaatcacctgtgcctggcctgtgatgccgcggcgtgtacgaatagtgcctgaaaaacacccccgtgaacgccgacgggagagcgggtgggtttgcccgtaaacaacgaaaagagctacgctcatgagcgccggaactgcgaccgacaccaccgacctcgactccttcttctcggctcatcttgccgagaccgatcccgagatcgccaaggccatctcgcaggagctgggccggcagcagcacgagatcgagctgatcgcgtccgagaacatcgtctcgcgcgccgtgctcgaagcgcagggctcggtcctgaccaacaagtacgccgagggttatccgggtcggcgctactacggcggctgccagttcgtggacatcgccgaggaactcgccatcgaccgggccaagcgcctgttcggctgcggcttcgccaacgtgcagccgaattcaggctcgcaggcgaaccagggcgtgttcatggccctgatgcagccgggcgacaccttcctcggcctcgacctcgcggccggcggccacctcacccacggcgcccccccgaacgtctcgggcaagtggttcaagccggtctcctacaccgtgcgccgcgaggaccagcgcatcgacatggagcaggtcgagcgcctcgcccaggagcacaagccgaaggtgatcatcgccggcggctcgggctacccgcgtcactgggacttcgcgaagttccgtgagatcgccgattccgtcggcgcctacttcttcgtcgacatggcccacttcgccggcctcgtcgccgcgggcctgcacccgtcgccgttcccgcatgcgcacgtcgccaccacgacgacgcacaagaccctgcgcggcccgcgcggcggcatgatcctgacgaacgacgaggcgctggccaagaagttcaactcggcgatcttccccggcctccagggcggcccgctgatgcacgtcatcgccgccaaggcggcggccttcggcgaggcgctgaagcccgagttcaagatctacgccaagcaggtgatcgacaacgcccgggcgctggccgacaccatcatctccggcggctacgacatcacctcgggcggcaccgacaaccacctgatgctggtcgaccttcagaagaagggcctcaccggcaaggcggccgaggcggcgctctcccgggccgacatcacctgcaacaagaacggcgtgccgttcgacccgcagaagccgacgatcacctccggcatccgtctcggcacgccggccagcaccacccgcggcttcggcgtcgccgagttcaagcaggtcggctcgctgatcgttcaggtgctcgatggcatcgccgagaagggcgatggcggcgacgcggcggtcgaggcggcggtgaaagagaaggtccacgccctcaccgatcggttcccgatctacgcctga

SEQ ID NO: 9418 - protein, 434 aa, Methylobacterium extorquens
MSAGTATDTTDLDSFFSAHLAETDPEIAKAISQELGRQQHEIELIASENIVSRAVLEAQGSVLTNKYAEGYPGRRYYGGCQFVDIAEELAIDRAKRLFGCGFANVQPNSGSQANQGVFMALMQPGDTFLGLDLAAGGHLTHGAPPNVSGKWFKPVSYTVRREDQRIDMEQVERLAQEHKPKVIIAGGSGYPRHWDFAKFREIADSVGAYFFVDMAHFAGLVAAGLHPSPFPHAHVATTTTHKTLRGPRGGMILTNDEALAKKFNSAIFPGLQGGPLMHVIAAKAAAFGEALKPEFKIYAKQVIDNARALADTIISGGYDITSGGTDNHLMLVDLQKKGLTGKAAEAALSRADITCNKNGVPFDPQKPTITSGIRLGTPASTTRGFGVAEFKQVGSLIVQVLDGIAEKGDGGDAAVEAAVKEKVHALTDRFPIYA

SEQ ID NO: 9419 - DNA, 1239 bp, Methanosarcina mazei
  CDS (1)..(1239): transl_table=11
atgtcttatattgaaaaaattgacccggaattgttcgaggctatcaaaaatgaagccgatcgtcaggaacacaagctgaacctgatcgcatcagaaaactatgcgagcagggctgttatggaagcccagggctctattatgaccaacaagtatgccgaaggatattccggtaaacgctattacggaggctgcgatttcgttgacgttgccgaaaatctcgccattgcaagggcaaaggaacttttcggggcaaagtatgtaaacgtccagcctcactcaggttcaggtgccaacatggctgtttatttctctgtgctgcagccgggggatactatcctgtccatggacctctctcacggcggacacctttctcacggcagccctgtaagtttctcaggaaaactctataacatcgtgccctatggggtcagcaaagagaccgaagccctggattacgatgagctccttaaactggcaaaagaatgcaagcccaggatgatagtatgcggagcttcagcctatccccgtgtgattgattttaaaaggttcagggaaattgctgatgaggtcggagcttacctccttgcagatattgcacacatcgcaggacttgtagttgcaggcgtacacccgagccctgttccttatgcggattttgttaccacaaccacccacaagaccctgcgcggtcccaggggcggaatgattatctcgaagactgaagagcttgcaataggcgtgaacaaagcggttttcccgggtatccagggcggccccctcatgcatatcatagctgcaaaagctgttgccttcaaagaagccatgagcgaagagttcaggcaggaccaggatcagaccgtaaagaacgcaaaggtcctgtgttcatgtctgaagcagaaaggttttgatattgtttcaggcggcaccgacaaccaccttatgcttgtaaatctcaataatatgaatattacaggaaaggacgctgaagctgcactgagcaaagccgggatcatcgccaacaaaaacacagttcctttcgagacccgcagcccattcgtaaccagcggggtaaggctcgggaccccttcctgcaccacaaggggcatgaaagaaaaggaaatggaactggttgcagactacatcgaggctgcaataaagaattcggaaaacgatgctcttctgtcggaaatcaatattaaggtaagggatctctgtttaaagttccctgtttacgaataa

SEQ ID NO: 9420 - protein, 412 aa, Methanosarcina mazei
MSYIEKIDPELFEAIKNEADRQEHKLNLIASENYASRAVMEAQGSIMTNKYAEGYSGKRYYGGCDFVDVAENLAIARAKELFGAKYVNVQPHSGSGANMAVYFSVLQPGDTILSMDLSHGGHLSHGSPVSFSGKLYNIVPYGVSKETEALDYDELLKLAKECKPRMIVCGASAYPRVIDFKRFREIADEVGAYLLADIAHIAGLVVAGVHPSPVPYADFVTTTTHKTLRGPRGGMIISKTEELAIGVNKAVFPGIQGGPLMHIIAAKAVAFKEAMSEEFRQDQDQTVKNAKVLCSCLKQKGFDIVSGGTDNHLMLVNLNNMNITGKDAEAALSKAGIIANKNTVPFETRSPFVTSGVRLGTPSCTTRGMKEKEMELVADYIEAAIKNSENDALLSEINIKVRDLCLKFPVYE

SEQ ID NO: 9421 - DNA, 1251 bp, Moorella thermoacetica
  CDS (1)..(1251): transl_table=11
atgaacctggaaacagtagccaaggttgatcccgaaatagtagccgccgtcaggggcgagcttcaacgccagcggacccacctggaactaatcgcctcagagaacttcgtcagccaggccgtcatggaggcctatagctgcgtcctgaccaataaatacgccgaagggtatcccggcaaacgctattatggcggttgtgaatgggccgacgtagtcgaaaacttggcccgggaaagggccaaagccctcttcggggccgagcacgccaatgtccagccccattccggcagccaggccaacaccgccgtctacctggccgttctgaacccgggcgataaggccctgggcatgaacctggcccacggcggccatttgacccacggtagcccggtaagcctttccggcaaatactataacttctgtttctacggcgtcgatgccaaaaccggccgtattgactatgacgccgtagcccgcatcgcccgtgaggagcggcccagactgatcgtcgccggggccagcgcctacccgcgggtaatcgactttgcccgtttccgcgagattgccgacgaggtcggcgccctgctgatggtggatatggcccatatcgccggactggtggccgccggtatccatcccaacccggtaccctacgcccacttcgtgaccaccaccacccataagaccatgcgcggtccgcggggtgggattatcctgaccaccagggaatacgcccgggatatcgataaggccgtcttccccggtgtccagggcggtcccctgatgcacgtcatcgccgccaaggctgtggccttaaaggaggccatgctgccggagttcaaacgttaccaggagcaaatagttaccaatgcccgtaccctggccgacgccctcatgggctacggatttaacctggtttccggcggtaccgacaaccacctaatgctcgtcgacctacgcaataagaatataaccggccgggaggccgaagatatcctggcctcggtccagattaccgtcaacaagaacgccatccccttcgacccgcagaagcccagcgtaaccagcggcatccgcctgggaacggccgctctgacctcccggggcatggacgccgacgccatggtccaggtggcccgggccatcgacctggccctctcctacggtccggatgagaagaaactggaggaagccaggggtatcgtcgccgaactctgccgggccttccccctctaccaggagctcgactaa

SEQ ID NO: 9422 - protein, 416 aa, Moorella thermoacetica
MNLETVAKVDPEIVAAVRGELQRQRTHLELIASENFVSQAVMEAYSCVLTNKYAEGYPGKRYYGGCEWADVVENLARERAKALFGAEHANVQPHSGSQANTAVYLAVLNPGDKALGMNLAHGGHLTHGSPVSLSGKYYNFCFYGVDAKTGRIDYDAVARIAREERPRLIVAGASAYPRVIDFARFREIADEVGALLMVDMAHIAGLVAAGIHPNPVPYAHFVTTTTHKTMRGPRGGIILTTREYARDIDKAVFPGVQGGPLMHVIAAKAVALKEAMLPEFKRYQEQIVTNARTLADALMGYGFNLVSGGTDNHLMLVDLRNKNITGREAEDILASVQITVNKNAIPFDPQKPSVTSGIRLGTAALTSRGMDADAMVQVARAIDLALSYGPDEKKLEEARGIVAELCRAFPLYQELD

SEQ ID NO: 9423 - DNA, 1251 bp, Nitrosomonas europaea
  CDS (1)..(1251): transl_table=11
atgttttcacagagcttgacgattgagcaggtcgatccggatttatggcaggctatcaaaggtgaagtacagcggcaggaagatcatatcgagctgattgcctcggaaaattatgccagtccggccgttttacaggcacagggtaccgtactgacaaacaagtatgctgaagggtatccgggcaagcggtattacggggggtgcaggtatgtggatatcgtcgagcagcttgctatcgaccgtctccggaatctgttcaatgcggaatatgtcaacgtgcagccacactccggttctcaggcaaatgccgcggtctatctgtcggctctgaagcccggagatacgctcctgggtatgtcgctggctcatggtggacatttgactcacggatcagcagtcaatatgagtggcaagatattcaattcaatctcttacggtctgaatccggaaaccgaagagatcgattacgcagaactggagcggcttgcacatgagcataaaccgcgcatgatcgtggctggagcatcctcctatgcacgagtcatagactggaaagcttttcgtcagattgctgacaacgtgggtgcctatctgtttgttgatatggcgcactatgccggattgattgctgccggttactatcccaatcctgtgggaatcgctgattttgtcaccagtaccacacataaaacactgcgtggtccgcgtggcggagtaatcatggccaagccggaacatgaaaaggcactcaattcggcagtatttccgcagacacaaggcggcccgctgatgcatgtcatcgcggccaaagcagtggctttcaaggaagcctccagccaggcgttcaaggattaccagaagcaggtcatcgagaatgcacgtgtcatggcaagggtgctgcaacagcgcggcctgcgtatcgtatctggccgtacggattgccatatgttcctggtcgatctgcgtgccaaaaatctgacaggaagggaggcagaatccgcgctggaggcggcgcatattaccgtcaacaagaatgcgattccgaatgatccgcaaaaacctttcgttaccagtggaatacggatcggtactccggccattactacgcgcggattcaaggagcctgagtccgaggaacttgccaatctggtggctgatgtgctggatgctccggccaacacagcagtgctggatcaggtcgcccggaaagcgcaggcattgtgtacgaagtttccggtgtatggaaactga

SEQ ID NO: 9424 - protein, 416 aa, Nitrosomonas europaea
MFSQSLTIEQVDPDLWQAIKGEVQRQEDHIELIASENYASPAVLQAQGTVLTNKYAEGYPGKRYYGGCRYVDIVEQLAIDRLRNLFNAEYVNVQPHSGSQANAAVYLSALKPGDTLLGMSLAHGGHLTHGSAVNMSGKIFNSISYGLNPETEEIDYAELERLAHEHKPRMIVAGASSYARVIDWKAFRQIADNVGAYLFVDMAHYAGLIAAGYYPNPVGIADFVTSTTHKTLRGPRGGVIMAKPEHEKALNSAVFPQTQGGPLMHVIAAKAVAFKEASSQAFKDYQKQVIENARVMARVLQQRGLRIVSGRTDCHMFLVDLRAKNLTGREAESALEAAHITVNKNAIPNDPQKPFVTSGIRIGTPAITTRGFKEPESEELANLVADVLDAPANTAVLDQVARKAQALCTKFPVYGN

SEQ ID NO: 9425 - DNA, 1311 bp, Novosphingobium aromaticivorans
  CDS (1)..(1311): transl_table=11
atgaccactgccaccgcagcgccggaaatccgtaaagccggcttcttcaccgaacatctcgagaccgcagacgccgaagtcttcgccgcgatccgtggcgagctgaagcgccagcagaccaagatcgaactgatcgcgtccgagaacatcaccagcctggccgtgcttgaagcgaccggttcggtcttcaccaacaagtacgccgaaggctatccgggcaagcgctactacggcggctgcgaatatgcagacgtggtcgaaaacctcgcgatcgagcgcgcgaagaagctgttcggctgcaacttcgccaacgtccagcccaactcgggcagccagatgaaccaggccgtgttcctcgcgctgcttcagcctggcgacagcttcatgggcctcgacctcaattcgggcggccacctgacgcacggttcgccggtcaacatgagcggcaagtggttcaagccgatcccctatggcgtgcgcgccgacgatcacctgatcgacatggacgaggttgcccgccttgcccgcgagaacaagcccaagctgatcatcgcaggcggcactgcatattcgcgcgtgtgggatttcaagcgcttccgcgagatcgccgatgaagtgggcgcctggctgctggtcgacatgtcgcacttctccggcctcgtcgctggcggtgcgcacccctcgcccttcccgcacgcccatgtcgtgaccagcacgacgcacaagtcgctgcgcggtccgcgttcgggcatcatcctgaccaacgacgaggatctggcgaagaagttcaacatggcggtgttccccggcatgcagggcggcccgctagtccacgtgatcgcggcaaaggcggtcgcgtttggcgaagcgctgcgtcctgaattcaaggcctatgccgcgcagatcgtcgccaacgcccgcgcgctggccgaagcggtcaaggacgccggcctttcggtcgtctcgggtgggaccgacaaccacctgatgctggtcgatctttctgccaaggacgtgacgggcaaggccgccgagaaggggctcgaccgcgcctggctgacctgcaacaagaacggcgtccccttcgacaagcgctcgcccttcgtcacgtcgggcatccgcctcggcaccccggcgggcacgacgcgcggtttccgcgaggaagagttccgcaagatcggcgcactgatcggtgaagtggtcgatggccttgcacgcaacggcgaagagggcgatggtcaggtggaacagcgcgtgcgcgaccgtgtcgccgagctttgcgcgcagttcccgatctatccggagctttga

SEQ ID NO: 9426 - protein, 436 aa, Novosphingobium aromaticivorans
MTTATAAPEIRKAGFFTEHLETADAEVFAAIRGELKRQQTKIELIASENITSLAVLEATGSVFTNKYAEGYPGKRYYGGCEYADVVENLAIERAKKLFGCNFANVQPNSGSQMNQAVFLALLQPGDSFMGLDLNSGGHLTHGSPVNMSGKWFKPIPYGVRADDHLIDMDEVARLARENKPKLIIAGGTAYSRVWDFKRFREIADEVGAWLLVDMSHFSGLVAGGAHPSPFPHAHVVTSTTHKSLRGPRSGIILTNDEDLAKKFNMAVFPGMQGGPLVHVIAAKAVAFGEALRPEFKAYAAQIVANARALAEAVKDAGLSVVSGGTDNHLMLVDLSAKDVTGKAAEKGLDRAWLTCNKNGVPFDKRSPFVTSGIRLGTPAGTTRGFREEEFRKIGALIGEVVDGLARNGEEGDGQVEQRVRDRVAELCAQFPIYPEL

SEQ ID NO: 9427 - DNA, 1236 bp, Oceanobacillus iheyensis
  CDS (1)..(1236): transl_table=11
atggaatttgtgaaacaagcagataccgaagtgtttgaagcaatgcaagccgaaaaaaatcgccagcaagataagattgagttaattgcatccgaaaattttgtaacaaaagcagtaatggatgcgatgggatctattcttaccaataaatatgcagaaggttatccaggcaagcgttattatggtggttgtgagcatgttgatgtagtggaaaatcttgctcgtgatcgtgcgaaagaattatttggtgctgatcacgcaaatgtacaacctcattcaggagcacaagcaaatatggcagtttattctgcggtacttgagcctggtgatacggtactaggtatgaatctaaatcatggtggacatttaactcatggtagcccagtgaactttagcggtcaattgtataattttgttgactatggtgtagacaaagagacagaacaacttgattatgatgctgtattggaaaaagcaaaggaagtaaaacctaaattaatcgtggctggagcaagtgcatactcccgttctattaattttgctaaattccgtgaaattgctgatgcagtagatgcatatctaatggtagatatggcacatattgctggtttagttgctactggtgaacatgaaaatccagttcctcatgcagattttgttactactacaacccataaaacattgcgcggacctcgtggtggtatgattctttgtaaagaagaatttgccaaaaaagtagataaagcgattttccctggaatccaaggtggaccgttaatgcatgttattgctgcaaaagctgtatcctttaaagaagcattgtcagatgactttaaagcatattcaaagcaaattgttgcaaatgcaaaattactaggggaagctctcaataaagaaggaattcgtattgtatctggaggtacagataaccatctactattattagatgttactccattacaattaaccggaaaagtagctgaaaaagcactagatgatatcggtattacaacgaataaaaacacgattccttttgatcaagaaagtccttttgtaacaagtggtatccgtattggtactgctgcagtaactacacgtggatttggtgaagaagaaatgaaagaaattgcttctattatttctttaacgttaaaacaccatgaagatgaagcgaagttaaaagaagcagcacaacgtgtacaagcacttacagaaaaattcacgctatatgcttaa

SEQ ID NO: 9428 - protein, 411 aa, Oceanobacillus iheyensis
MEFVKQADTEVFEAMQAEKNRQQDKIELIASENFVTKAVMDAMGSILTNKYAEGYPGKRYYGGCEHVDVVENLARDRAKELFGADHANVQPHSGAQANMAVYSAVLEPGDTVLGMNLNHGGHLTHGSPVNFSGQLYNFVDYGVDKETEQLDYDAVLEKAKEVKPKLIVAGASAYSRSINFAKFREIADAVDAYLMVDMAHIAGLVATGEHENPVPHADFVTTTTHKTLRGPRGGMILCKEEFAKKVDKAIFPGIQGGPLMHVIAAKAVSFKEALSDDFKAYSKQIVANAKLLGEALNKEGIRIVSGGTDNHLLLLDVTPLQLTGKVAEKALDDIGITTNKNTIPFDQESPFVTSGIRIGTAAVTTRGFGEEEMKEIASIISLTLKHHEDEAKLKEAAQRVQALTEKFTLYA

SEQ ID NO: 9429 - DNA, 1251 bp, Onion yellows phytoplasma
  CDS (1)..(1251): transl_table=11
atgaatcaaaagttaggattaaaagaccaagatcaagaaatctttgatcttattgaacaagaaaaaattagacaaaaagaaaatatcttattaattgcttcggaaaattttgtttctcaagcagtattagatgcccaaggaagcattttgactaacaaatatgcagaaggttatcctcaagctagatattataatggttgtaaaaatgtagatcaaatagaaaaaattgccattcaaagagcaaccaagctgtttggtgctaaatatgcaaacgtccaacctcattcaggttcacaagccaatatgggagcatttcaagccttattaaaacctggtgacaaaattttaggattatctttaatggatggaggacatcttactcacggtcataaattaagtttttctggtggtttttatgaagctcatttttataatgtccatccccaaactgaaatgcttgattatgatgaaattcgtaaagttgccttaaaagttaaacctaaattaattattgcaggatattcggcttattctaaaactattaattttaaaaagtttcgtcaaattgctgatgaagttaatgcctatttaatggcagatattgcccatattgcaggtttagttgcttgtgggcttcatccttgtccctttgaagctaacgccgatgttgttacttctactatgcacaaaacactgagaggaccgcgtggaggtttgattttaaccaataaagaagaagtatttaaaaaaataaatcgtggtatttttccaggtattcaaggaggaccttgtattcatactattgcagctaaagctgttgcttttcaagaagcgatgatgccttcttttaaagaatatcaaaagcaagttatcaaaaatgcaaacacctttgctaaagccttccaacaaaaaggttatcgcattgtaagtggaggcactgataatcatttatttttaattgatgttaaacataaaaatcctgagtttacaggatccaaaattgcaaacatgttagaaaaaataaatattgttgtcaacaaaaataccattccttttgatcaagaaaaaccttttgtgacaagcggtattagaattggcacacctgctatgacaacagtaggttttagagaaaatgattttattttagttgcagatttgatggacaaagctatcaatcacttggacgacgaatcttatttagcccaaattaaacaacaagttttggctttattaagtaaatttaataagtaa

SEQ ID NO: 9430 - protein, 416 aa, Onion yellows phytoplasma
MNQKLGLKDQDQEIFDLIEQEKIRQKENILLIASENFVSQAVLDAQGSILTNKYAEGYPQARYYNGCKNVDQIEKIAIQRATKLFGAKYANVQPHSGSQANMGAFQALLKPGDKILGLSLMDGGHLTHGHKLSFSGGFYEAHFYNVHPQTEMLDYDEIRKVALKVKPKLIIAGYSAYSKTINFKKFRQIADEVNAYLMADIAHIAGLVACGLHPCPFEANADVVTSTMHKTLRGPRGGLILTNKEEVFKKINRGIFPGIQGGPCIHTIAAKAVAFQEAMMPSFKEYQKQVIKNANTFAKAFQQKGYRIVSGGTDNHLFLIDVKHKNPEFTGSKIANMLEKINIVVNKNTIPFDQEKPFVTSGIRIGTPAMTTVGFRENDFILVADLMDKAINHLDDESYLAQIKQQVLALLSKFNK

SEQ ID NO: 9431 - DNA, 1263 bp, Pasteurella multocida
  CDS (1)..(1263): transl_table=11
atgttaaaaagaagtatgaacatcgctgattacgatccggttttatggcaggcaattcaagacgaaaatcgccgtcaagaagaacacattgaattaattgcatcagaaaactatgccagcccacgcgtgatggaagcacagggttctcaatttaccaataaatatgcggaaggttacccgggtaaacgttattatggtggttgtgaatatgcagatatcgttgagcaattagcgattgatcgtgcaaaagagttatttcatgcggattatgtgaacgtacaaccccactcgggttcgcaagctaacgcggcagtgtatggtgccttattacagccacatgacactattcttggtatgagccttgcacacgggggacacttaacgcacggtgcatcagtgagcttttcgggtaaaatctataatgcagtgcaatatggaattactgccgaaggtttaattgattatgaagatgtgcgtcaaaaagccttagagtgcaagccaaaaatgatcgtggcgggtttctctgcctattcgcaagtagtggattgggcgaaaatgcgtgaaatcgctgatgaagtgggagcgtatcttttcgtggatatggcgcacgtggcagggctgattgcagcaggtgtttacccaagtccgttaccacatgcacatgttgtgactactaccacacacaaaaccttagggggacctcgtggtggtttaattctatcggctgcgaaagatgaagatctttataaaaaattacaaagttctgttttccctgccaaccaaggtggtccgttagtgcatgtgatcgccgcaaaagcggtctgttttaaagaagcgcttgagcctgaatacaaagtgtatcaacaacaagtggtgaaaaatgcgaaagccatggtggacgtgtttaaacaacgtggttataacgtggtatccaatggcacagaaaaccatttattcttagtagatttagttagccacggtttaaccggtaaagcagcagatgctgcgttaggcagtgcaaacattaccgtcaacaaaaatgcggtaccaaacgatccacaaaaaccatttgtgacctcaggtatccgtgtgggcacaccatctatcacccgtcgtggctttaaagaagctgaatcggcagaattagccggttggatgtgtgatgtgttggatgcgatgggtaaagacaacgaagcacaagtgattgcacagacaaaagagaaagtcttagcaatttgtaaacgtcttcctgtttatgcttaa

SEQ ID NO: 9432 - protein, 420 aa, Pasteurella multocida
MLKRSMNIADYDPVLWQAIQDENRRQEEHIELIASENYASPRVMEAQGSQFTNKYAEGYPGKRYYGGCEYADIVEQLAIDRAKELFHADYVNVQPHSGSQANAAVYGALLQPHDTILGMSLAHGGHLTHGASVSFSGKIYNAVQYGITAEGLIDYEDVRQKALECKPKMIVAGFSAYSQVVDWAKMREIADEVGAYLFVDMAHVAGLIAAGVYPSPLPHAHVVTTTTHKTLGGPRGGLILSAAKDEDLYKKLQSSVFPANQGGPLVHVIAAKAVCFKEALEPEYKVYQQQVVKNAKAMVDVFKQRGYNVVSNGTENHLFLVDLVSHGLTGKAADAALGSANITVNKNAVPNDPQKPFVTSGIRVGTPSITRRGFKEAESAELAGWMCDVLDAMGKDNEAQVIAQTKEKVLAICKRLPVYA

SEQ ID NO: 9433 - DNA, 1281 bp, Porphyromonas gingivalis
  CDS (1)..(1281): transl_table=11
atgaaaaaagacagcgtaattttcgatctgatcgaaaaagaacatcagcgccagctcaaaggcatcgagctgatcgcatcggaaaactttgtaagcgaacaagttatgcaggctatgggtagctgtatgaccaataagtatgccgaaggttatcccggcaaacgctattacggtggttgtgaagtggtagaccaaagcgagcaaatcgccatcgaccgtatcaaacaactctacggagccgaatgggccaacgtacagcctcactccggagcacaggccaatatggccgttcttctggcttgcctcgaagcaggcgatacgttcatgggactgaacctcgaacacggcggccacctatcgcacggctcactcgtcaatagctcgggtatcctctaccgtcccatcggctacaatctgagcgaagagacgggaatggtggattacgaccacatggagaaaatggccatcgagcacaaacccaagctgatcatcggcggtggttcggcctattctcgtgagtgggactacaagcgtatgcgtgagatcgctgacaaggtgggtgccttgttgatgatcgatatggcacaccctgccggtctgatcgctgccggtctgctggagaaccccgtgaagtatgctcatatcgttacttctacgactcacaagacactgcgtggcccccgtggcggtatcatccttatgggcaaggacttcgacaatccttggggcaagaaaaccccgaagggcgagatcaagaagatgagcgcactcctcgactctgccgtattccccggtgtacagggtggtccgctcgagcacgttatagctgctaaggctgtagctttcggagaagcactggatccttcgttcaaggaataccaaacgcaggtgaaaaagaatgctgccgttttggctcaggctttcatggacaaaggctataaagtgatttccggtggtacggacaaccacagtatgctgatcgatcttcgtccgaagttccccgaactgacaggtaaagtggcagagaaagccctcgtggcagcggatattaccgtcaataagaacatggtaccgttcgattctcgctctgcattccagacatcgggcttccgcgtgggtactccggccatcaccactcgtggcgtaaaagaagataagatgggctatatcgtggagttgatagaccgtgtgctctccgcaccggaggacgaagccgtaatagcatcggttcgtaccgaagtcaaccggatgatggccgattatcctctctttgcttggtaa

SEQ ID NO: 9434 - protein, 426 aa, Porphyromonas gingivalis
MKKDSVIFDLIEKEHQRQLKGIELIASENFVSEQVMQAMGSCMTNKYAEGYPGKRYYGGCEVVDQSEQIAIDRIKQLYGAEWANVQPHSGAQANMAVLLACLEAGDTFMGLNLEHGGHLSHGSLVNSSGILYRPIGYNLSEETGMVDYDHMEKMAIEHKPKLIIGGGSAYSREWDYKRMREIADKVGALLMIDMAHPAGLIAAGLLENPVKYAHIVTSTTHKTLRGPRGGIILMGKDFDNPWGKKTPKGEIKKMSALLDSAVFPGVQGGPLEHVIAAKAVAFGEALDPSFKEYQTQVKKNAAVLAQAFMDKGYKVISGGTDNHSMLIDLRPKFPELTGKVAEKALVAADITVNKNMVPFDSRSAFQTSGFRVGTPAITTRGVKEDKMGYIVELIDRVLSAPEDEAVIASVRTEVNRMMADYPLFAW

SEQ ID NO: 9435 - DNA, 1296 bp, Rhodobacter sphaeroides
  CDS (1)..(1296): transl_table=11
atgaacgccccgcaccgcgacgacggcttctttaccgaaagcctctcttcccgcgatcccgagcttttcgcctcgatcaccggcgaactcggccgccagcgcgacgagatcgagctgatcgcctcggagaatatcgtgagccgcgccgtgatggaggcgcagggctcggtcatgacgaacaagtacgccgaaggctatgcgggcaagcgctactacggcggctgcgactatgtcgacgtggccgagacgctggccatcgagcgggcgaagcagctgttcggctgcgcctatgtgaacgtgcagccgaactcgggcagccaggccaaccagggcgtgttccaggcgctcatcaagccgggcgacaccattctgggcatggagctcgcctcgggcggccacctcacccacggggccgcgccgaaccagtccggcaagtggttcaacgcgatccagtatggcgtgcgccagcaggaccagctgatcgattacgatcaggtggcggcgctcgcgcgcgagcacaagcccaagctcatcatcgcgggcggctcggccatcccgcgccagatcgacttcgcccgcttccgggccatcgcggatgaggtgggcgcgctcctgatggtggacatggcccatttcgcgggcctcgtggcgggcggcgcccatccctcgcccttcccgcatgcggacgtggccaccaccacgacgcacaagacgctgcgcggtccgcgcggcggcatgatcctcacgaacagcgaggagatcgcgaagaaggtcaattcggccatcttcccgggcatccagggcggtccgctgatgcatgtgatcgcggccaaggcggtggccttcggcgaggcgctgcggcccgagttcaaggcctatgccgcgcaggtggtcaagaacgcgcaggcgctggcggacgagctgatgaagggcgggctcgacatcgtgacgggcggcaccgacacgcacctgatgctcgtggacctgcggcccaagggcgtgaagggcaatgcgaccgagaaggcgctgggccgcgcccacatcacctgcaacaagaacggcatcccgttcgaccccgagaagccgaccgtgacctcgggcgtccggctcggcacgcccgcgggcaccacccgcggcttcggtgaggcggagttccgcgagatcggccggctgatcgtcgaagtggtcgacgggctcgcggccaacggcgaagagggcaatgcggcggtggaagaggccgttaaggccaaggtcgcggcgctctgcgcccgcttcccgctctatccgacgctctga

SEQ ID NO: 9436 - protein, 431 aa, Rhodobacter sphaeroides
MNAPHRDDGFFTESLSSRDPELFASITGELGRQRDEIELIASENIVSRAVMEAQGSVMTNKYAEGYAGKRYYGGCDYVDVAETLAIERAKQLFGCAYVNVQPNSGSQANQGVFQALIKPGDTILGMELASGGHLTHGAAPNQSGKWFNAIQYGVRQQDQLIDYDQVAALAREHKPKLIIAGGSAIPRQIDFARFRAIADEVGALLMVDMAHFAGLVAGGAHPSPFPHADVATTTTHKTLRGPRGGMILTNSEEIAKKVNSAIFPGIQGGPLMHVIAAKAVAFGEALRPEFKAYAAQVVKNAQALADELMKGGLDIVTGGTDTHLMLVDLRPKGVKGNATEKALGRAHITCNKNGIPFDPEKPTVTSGVRLGTPAGTTRGFGEAEFREIGRLIVEVVDGLAANGEEGNAAVEEAVKAKVAALCARFPLYPTL

SEQ ID NO: 9437 - DNA, 1263 bp, Rickettsia conorii
  CDS (1)..(1263): transl_table=11
atgaatatttttaataataatttacacgaaacggataaagagattaatgaaataataaagcatgaaaagctacgtcaaagtagtgtaatcgagcttattgcatcagaaaatttcgtaagtcctgctgtgcttgaagctcaaggggcgcttctgactaacaaatatgccgaaggatacccaagtaagcgattctataacggttgcgaggaagtagataaagctgaaaatttagctatagaacgagtaaaaaaactctttaactgcaaatatgcaaatgtccaacctcattcaggatcacaagcaaatcaggctgtatatcttgctttattacagccgggtgatacggttcttggtatgtccttagatagcggtgggcatctaacgcacggtgcagctcctaatatgtctggtaaatggtttaacgccgtttcttatagcgtaaataaagagacttatttaatcgattatgatgagattgaacgcttagcggatttgcataaaccaaaattacttatagccggtttttctgcttatcctcgtaatattgattttgcaaaatttagagaaatcgtggataaagtaggagcttactttatggcagatattgctcatattgcaggacttgttgccacaggtgagcatcaaagccctattccttatgctcacgctgttacctctactactcataaaacacttagaggtccaagaggcggtttaattttatctaacgatgaagcgataggtcacaaaataaattctgcattatttccaggactacaaggtggtccgttaatgcatataatagctgcaaaagccgtagcttttttagaaaatttgcagcctgaatataaaagttatattcagcaggtaataagtaacgctaaagctttagcaagtagcttgcaagaaagaggatatgatatattaacaggtggtaccgataatcatattgttttagtggatttgcgtaaagacggaatcacgggtaagcttgccgcaaattctttggatagagcagggattacgtgtaataagaatgctatcccgtttgatgaaacttcgccttttatcacttcaggtattcgccttggtactcccgcatgtactactagaggttttaaagaaaaggattttgtattagtcggtcatatggtagcagatattttagacggcttaaaaaataatgaagataatagcgctcttgagcagaaagtattaaatgaagtgacaaaattaattgaattatttccgttttatggctaa

SEQ ID NO: 9438 - protein, 420 aa, Rickettsia conorii
MNIFNNNLHETDKEINEIIKHEKLRQSSVIELIASENFVSPAVLEAQGALLTNKYAEGYPSKRFYNGCEEVDKAENLAIERVKKLFNCKYANVQPHSGSQANQAVYLALLQPGDTVLGMSLDSGGHLTHGAAPNMSGKWFNAVSYSVNKETYLIDYDEIERLADLHKPKLLIAGFSAYPRNIDFAKFREIVDKVGAYFMADIAHIAGLVATGEHQSPIPYAHAVTSTTHKTLRGPRGGLILSNDEAIGHKINSALFPGLQGGPLMHIIAAKAVAFLENLQPEYKSYIQQVISNAKALASSLQERGYDILTGGTDNHIVLVDLRKDGITGKLAANSLDRAGITCNKNAIPFDETSPFITSGIRLGTPACTTRGFKEKDFVLVGHMVADILDGLKNNEDNSALEQKVLNEVTKLIELFPFYG

SEQ ID NO: 9439 - DNA, 1266 bp, Rickettsia felis
  CDS (1)..(1266): transl_table=11
atgaatatttttaataatcacttacacgaaacggataaagaaattgatgaaataatcaagcatgaaaagctgcgtcaaaatagcgtaattgagcttattgcatcagagaatttcgtaagtcccgcagtgcttgaagctcaaggatcgattctgactaataaatatgcggaagggtattcaggtaagcgtttctataacggttgtgaggaagtcgataaagctgagaatttagctatagagcgagtaaaaaaactctttaactgtaaatatgcaaatgtgcagtctcattccggttcacaagcaaatcaagctgtgtatcttgctttattacagcctggtgatacaattcttggtatgtctttagatagcggcgggcatctaacgcacggtgcagccccgaatatgtccggtaaatggtttaacgccgtttcttatagcgtaaataaagagacttatttaatcgattatgatgagattgaacgcttagcggatttgcataaaccaaaattacttatagccggtttttctgcttatcctcgtaatattgattttgcaagatttagagaaatagcggataaagtaggagcttactttatggcagatattgctcatattgccggacttgttgccacaggcgagcatcaaagccctattccttacactcatgctgttacctctaccactcacaaaacgctccgaggaccgcgaggcggtttaattttatctaacgacgaagagataggcaaaaagataaattctgcattatttccaggactacaaggcggtccgttaatgcatataatcgccgcaaaagccgtagcttttttagaaaatttgcagcctgaatataaaagctatattaagcaggtaataagtaatgctaaagctttagcaagtagcttgcaagaaagaggatatgatatattaacaggcggtaccgataatcatattgttttagtggatttgtgtaaagacgggattaccggaaagcttgctgctaattctttggatagagcagggattacatgtaataagaatgctatcccctttgatgaaacttcgccttttatcacttcaggtattcgtcttggcactccggcatgcactactagaggatttaaagaaaaggattttgtattagtcggtcatatggtagcagatattttagacggcttaaaaaataatgaagataatggtaaagccgagcaaaaagtactaactgaagtaacaaaactaattaaattatttccgttttatactcggtga

SEQ ID NO: 9440 - protein, 421 aa, Rickettsia felis
MNIFNNHLHETDKEIDEIIKHEKLRQNSVIELIASENFVSPAVLEAQGSILTNKYAEGYSGKRFYNGCEEVDKAENLAIERVKKLFNCKYANVQSHSGSQANQAVYLALLQPGDTILGMSLDSGGHLTHGAAPNMSGKWFNAVSYSVNKETYLIDYDEIERLADLHKPKLLIAGFSAYPRNIDFARFREIADKVGAYFMADIAHIAGLVATGEHQSPIPYTHAVTSTTHKTLRGPRGGLILSNDEEIGKKINSALFPGLQGGPLMHIIAAKAVAFLENLQPEYKSYIKQVISNAKALASSLQERGYDILTGGTDNHIVLVDLCKDGITGKLAANSLDRAGITCNKNAIPFDETSPFITSGIRLGTPACTTRGFKEKDFVLVGHMVADILDGLKNNEDNGKAEQKVLTEVTKLIKLFPFYTR

SEQ ID NO: 9441 - DNA, 1263 bp, Rickettsia prowazekii
  CDS (1)..(1263): transl_table=11
atgaatattttaaataataatttatatgaaatggataaagaaatttatgaaataatcaagaatgagaagattcgtcaaaataatgtaattgagcttattgcatcagagaattttgtaagttctgctgtattggaagctcaaggctcgattctgactaataaatatgcggaagggtatcccagtaagcgtttctataatggttgtgatgaagttgataaagctgaagtcttggctatagagcggataaagaaattatttaactgtaaatatgccaatgtgcaacctcattcaggctcgcaagcaaaccaaactgtgtatcttgctttattacaaccgtgtgatacaattcttggtatgtccttagatagcggtggacatctaacacatggtgcggcccctaatatatctggtaaatggtttaacactgtttcatatcatgtagatcaagaaacttatttaattgattatgatgaggttgaacgtttagctgtgttacataatccaaaattgcttatagcaggtttttctgcatatccgcgtaagattgattttgcaaaatttagaaaaatagcagataaagttggagcatatcttatggcagatattgctcatattgcagggcttgttgccacaggtgagcatcaaagtcctattccatatgcgcacgtagtaacctctacaactcataaaacgcttagagggccaaggggtggcttaatcttatctgatgatgaagagataggaaaaaaaataaattctgcattattcccagggttgcagggtggcccgttaatgcatataattgctgcaaaagcagtagcgtttttagaaaatttgcagcctgaatataaaaattatataaagcaggtaataagtaacgctaaagctttagcaattagcttacaagaaagaggttatgatatattaacaggtggtactgacaatcatattgttttagtggatttgcgtaaagacgggatcacaggtaagtgtgctgcaaattctttagatagagcagggattacgtgtaataagaatgctattccgtttgatacaacttcgccttttatcacttctggtattcgttttggtactcctgcatgtactactaaaggctttaaagaaaaggattttgtattaattggtcatatggtagcagagattttagatggcttaaagcataatgaagataatagtaaaactgaacagaaagtattaagtgaagtaaaaaagctaatgaaattatttccgttttatgactaa

SEQ ID NO: 9442 - protein, 420 aa, Rickettsia prowazekii
MNILNNNLYEMDKEIYEIIKNEKIRQNNVIELIASENFVSSAVLEAQGSILTNKYAEGYPSKRFYNGCDEVDKAEVLAIERIKKLFNCKYANVQPHSGSQANQTVYLALLQPCDTILGMSLDSGGHLTHGAAPNISGKWFNTVSYHVDQETYLIDYDEVERLAVLHNPKLLIAGFSAYPRKIDFAKFRKIADKVGAYLMADIAHIAGLVATGEHQSPIPYAHVVTSTTHKTLRGPRGGLILSDDEEIGKKINSALFPGLQGGPLMHIIAAKAVAFLENLQPEYKNYIKQVISNAKALAISLQERGYDILTGGTDNHIVLVDLRKDGITGKCAANSLDRAGITCNKNAIPFDTTSPFITSGIRFGTPACTTKGFKEKDFVLIGHMVAEILDGLKHNEDNSKTEQKVLSEVKKLMKLFPFYD

SEQ ID NO: 9443 - DNA, 1263 bp, Rickettsia typhi
  CDS (1)..(1263): transl_table=11
atgaatattttaaataataatttgtatggaatggataaagaaatttatgaaataatcaagaatgagaagcttcgtcaaaataacgtaattgagcttattgcatcagagaattttgtaagttctgctgtgcttgaagctcaaggctcgattctgactaataaatatgcggaagggtacccaagcaagcgtttttataatggttgtgatgaagttgataaagctgaagttttagctatagaacgtgcaaagaaattatttaactgtaaatatgcaaatgtgcaacctcattcaggctcgcaagcaaaccaagctgtgtatcttgctttattacaaccgtgtgatacaattcttggtatgtccttagatagtggtggacatctaacgcatggtgcagcccctaatatatctggtaaatggtttaacactgttgcatataatgtagataaagaaacttatttaattgattatgatgagattaaacgcttagctgtgttacataatccaaaattgcttatagcaggtttttctgcctatcctcgtaaaattgattttgcaagatttagagaaatagcggataaagttggagcatatcttatggcagatattgcacatattgcagggcttgttgctacaggagagcatcaaagccctattccatatgctcacgtagttacctctacaactcataaaacccttagagggccaaggggaggtttaatcttatctgattatgaagagataggtaaaaaaataaattctgcattattcccagggttacaaggtggtccactaatgcatgtaattgctgcaaaagcagtagcatttttagaaaatttgcagcctgaatataaatgttatatcaagcaggtaataagtaacgctaaagctttagcaattagcctgcaagaaagaggatatgatatattaacaggtggtactgacaatcatattgttttagtagatttgcgtaaagacgggatcaccggtaagtgtgctgcaaattctttagatagagcaggaattacttgtaataagaatgctattccgtttgatacaacttcaccttttgtcacttctggtattcgttttggcacttctgcatgtactactaaaggctttaaagaaaaggattttgtattaattggtcatatggtagcagagattttagacggcttaaagaataatgaagataatagtaaaactgaacagaaagtattgagtgaagtaaaaaagctaattaagttatttccattttatgactaa

SEQ ID NO: 9444 - protein, 420 aa, Rickettsia typhi
MNILNNNLYGMDKEIYEIIKNEKLRQNNVIELIASENFVSSAVLEAQGSILTNKYAEGYPSKRFYNGCDEVDKAEVLAIERAKKLFNCKYANVQPHSGSQANQAVYLALLQPCDTILGMSLDSGGHLTHGAAPNISGKWFNTVAYNVDKETYLIDYDEIKRLAVLHNPKLLIAGFSAYPRKIDFARFREIADKVGAYLMADIAHIAGLVATGEHQSPIPYAHVVTSTTHKTLRGPRGGLILSDYEEIGKKINSALFPGLQGGPLMHVIAAKAVAFLENLQPEYKCYIKQVISNAKALAISLQERGYDILTGGTDNHIVLVDLRKDGITGKCAANSLDRAGITCNKNAIPFDTTSPFVTSGIRFGTSACTTKGFKEKDFVLIGHMVAEILDGLKNNEDNSKTEQKVLSEVKKLIKLFPFYD

SEQ ID NO: 9445 - DNA, 1254 bp, Shewanella oneidensis
  CDS (1)..(1254): transl_table=11
atgctgaaaaaagatatgaatatcgcagattatgatccggaactgttcaacgcaattcagaacgaaactctgcgtcaagaagagcatattgagctgattgcttctgaaaactacaccagtccacgcgtgatgcaagcacaaggttcacaattaaccaacaagtacgccgaaggttatcctggcaagcgttactacggtggttgtgagtatgtggacgtagttgaaaccttagcgattgagcgtgcaaaacaactgtttggtgcgacttacgcaaacgtacaacctcactcaggttctcaagcaaacagcgccgtttatatggcattgttaaaaccaggcgataccgttttagggatgaatttagcccacggtggtcacttgacccacggttcacctgtaaacttctcaggtagactgtacaacatcattccttacggtatcgatgaatcaggcaaaatcgactatgacgaaatggaacgtctggccgtagaacacaaacctaagatgatgatcggtggtttctctgcttactcaggtattgttgactgggcaagaatgcgcgaaattgcagacaaaatcggtgcttatctgttcgttgatatggcgcacgtagcgggtcttattgctgctggcgtgtatccaaaccctgtgccacacgctcacgttgtgacttcaacgacccacaagaccttagcgggtcctcgtggtggtatcatcctgtctgctgccgatgatgaagagctatacaagaagctaaactctgcggtattccctggcggtcaaggtggtcctttgatgcacgttatcgcgggtaaagcggttgccttcaaagaagctctagagccagaattcaaaacctaccaacagcaagtggttaataatgctaaagctatggttgaagtgttccttgagcgcggttacaaaatcgtctctggcggaaccagcaaccacttaatgctagttgacctgattggtcgtgacttgaccggtaaagaagccgatgccgccttaggcagcgctaacattaccgtgaataaaaactcagtgccgaatgaccctcgttcaccattcgtgacttctggtgtacgtatcggtacccctgcgattacgcgccgtggctttaaagaagccgaagcgaaacaattaactggttggatctgtgacatcctcgacgatgcccataatcctgcggtcatcgagcgcgtaaaaggccaagtattggcactgtgcgctcgtttccctgtttacggttaa

SEQ ID NO: 9446 - protein, 417 aa, Shewanella oneidensis
MLKKDMNIADYDPELFNAIQNETLRQEEHIELIASENYTSPRVMQAQGSQLTNKYAEGYPGKRYYGGCEYVDVVETLAIERAKQLFGATYANVQPHSGSQANSAVYMALLKPGDTVLGMNLAHGGHLTHGSPVNFSGRLYNIIPYGIDESGKIDYDEMERLAVEHKPKMMIGGFSAYSGIVDWARMREIADKIGAYLFVDMAHVAGLIAAGVYPNPVPHAHVVTSTTHKTLAGPRGGIILSAADDEELYKKLNSAVFPGGQGGPLMHVIAGKAVAFKEALEPEFKTYQQQVVNNAKAMVEVFLERGYKIVSGGTSNHLMLVDLIGRDLTGKEADAALGSANITVNKNSVPNDPRSPFVTSGVRIGTPAITRRGFKEAEAKQLTGWICDILDDAHNPAVIERVKGQVLALCARFPVYG

SEQ ID NO: 9447 - DNA, 1296 bp, Silicibacter pomeroyi
  CDS (1)..(1296): transl_table=11
atgaacgcgagccaccaggataccggatttttcacagaggcgctttcggagcgtgatcccgagctgttcggggcgatcacgtccgagctggggcgtcagcgcgacgagatcgagctgatcgcgtcggaaaacatcgtttccgccgccgtgatgcaggcgcagggctcggtgatgaccaacaaatacgccgaaggctaccccggccggcgctattacggcggctgccagtatgtcgacatcgccgagaacctggcgatcgagcgggccaagcagctgtttggctgcggctttgccaatgtgcagcccaactcgggcagccaggccaaccagggcgtgttccaggcgctgatcaagccgggcgacaccatcctgggcatgagcctggacgcgggcggccacctgacccatggcgccgcgcccaaccagtcgggcaaatggttcaacgcggtgcaatacggcgtgcgccagcaggacaacctgctggattacgaccaggtcgaggcgctggccaaggagcaccggcccaagctgatcatcgccggcggctcggcgattccgcgccagatcgattttgcccggatgcgggagattgcggatatggtcggggcctacctccatgtcgatatggcgcatttcgccggtctggttgcggcgggcgagcacccgagcccgtttccgcacgcgcatgtggccaccacgaccacgcacaagaccctgcgcgggccccgtggcggtatgatcctcaccaatgatgaagatatcgctaagaaggtgaattcggcgatctttcccggtatccagggcggcccgctgatgcatgtgatcgcggccaaggcggtggcctttggcgaggcgctgcgccctgaattcaagacgtatattcaacaggttatcgccaatgcccaagcgctgagcgaccagttgatcaagggcggtctggacacggtgacccatggcaccgacacccatgtggtgctggtcgacctgcgccccaagggggtcaagggcaacgccaccgaaaaggctctggggcgcgcgcatatcacctgcaacaagaacggcgtgccgtttgatccggaaaagccgacggtgaccagcggcatccgcctgggcagccccgcgggcaccacgcgcggctttgccgagaccgaattccgccagatcgccgactggatcatcgaggtggtcgatggcctggccgccaatggcgaagacgccaacgaggccgtcgaggacaaggtcaaagcccaggtcgcagccctctgcgcaaaattccctatctatccaaacctttga

SEQ ID NO: 9448 - protein, 431 aa, Silicibacter pomeroyi
MNASHQDTGFFTEALSERDPELFGAITSELGRQRDEIELIASENIVSAAVMQAQGSVMTNKYAEGYPGRRYYGGCQYVDIAENLAIERAKQLFGCGFANVQPNSGSQANQGVFQALIKPGDTILGMSLDAGGHLTHGAAPNQSGKWFNAVQYGVRQQDNLLDYDQVEALAKEHRPKLIIAGGSAIPRQIDFARMREIADMVGAYLHVDMAHFAGLVAAGEHPSPFPHAHVATTTTHKTLRGPRGGMILTNDEDIAKKVNSAIFPGIQGGPLMHVIAAKAVAFGEALRPEFKTYIQQVIANAQALSDQLIKGGLDTVTHGTDTHVVLVDLRPKGVKGNATEKALGRAHITCNKNGVPFDPEKPTVTSGIRLGSPAGTTRGFAETEFRQIADWIIEVVDGLAANGEDANEAVEDKVKAQVAALCAKFPIYPNL

SEQ ID NO: 9449 - DNA, 1239 bp, Staphylococcus epidermidis
  CDS (1)..(1239): transl_table=11
atgtcttatatcgagaaaaaggataaagttgtttacgatgctattcaaaaggagtttcaacgacaaaatagtaatattgaactcattgcatcagaaaatttcgtatcacaagcagttatggaagcccaaggttcagtattaacgaataaatatgctgagggttatcctgggcgtcgttattatggagggtgtgagcatgtagatgtaactgagtccattgccattgaaagagcaaaagctttatttggagcagaacatgttaatgttcaaccccattcaggttctcaagctaatatggctgtgtatttggttgctttagaaatgggcgatactgtgttaggtatgaatttgagtcatggtggtcatttaacacatggggcaactgtcaattttagtggtaaattttatcattttgttgaatatggtgtggaccaagaaaatgaattaataaactatgatgaagtgagacgtttagcaattgagcatcaacctaaattaattgtagctggtgcttcagcatattcaagaactattgactttaaaaaatttaaagaaattgctgatgaagtaggagctaaattgatggtagatatggcacatattgctggtttagtagctgctggtttacatcctaatcctgtagaatatgctgattttgtgactactacaactcataaaactttacgcggtccacgtggtggtatgattttatgtaaagaagaatataaaaaagatatagataaaacaatcttcccaggtattcaaggcggtccattagaacatgtcatcgccgcaaaagctgttgcatttggagaagctttgaacgacgattttaaagattatcaaaatcaagtcattaaaaatgcacaagctttagctcaaacattaattgaagaaggcttcagagttgtatctggcggaacagacaatcatttagttgcagttgatgttaaaggttctatcaatatgactggtaaattagctgaagagacacttgataaagtaggaattacatgtaataagaatactattccatttgataaagaaaaaccgtttgtaacaagtggtgttagactaggaacaccagcagctacaactcgtggttttgatgaatctgcatttgtggaagtagcaaaaattattagtttagcattaaataactatgataatgatactaaactaaatgaagctaaagagagagttcacgcactcacatctaaatatccattatataattaa

SEQ ID NO: 9450 - protein, 412 aa, Staphylococcus epidermidis
MSYIEKKDKVVYDAIQKEFQRQNSNIELIASENFVSQAVMEAQGSVLTNKYAEGYPGRRYYGGCEHVDVTESIAIERAKALFGAEHVNVQPHSGSQANMAVYLVALEMGDTVLGMNLSHGGHLTHGATVNFSGKFYHFVEYGVDQENELINYDEVRRLAIEHQPKLIVAGASAYSRTIDFKKFKEIADEVGAKLMVDMAHIAGLVAAGLHPNPVEYADFVTTTTHKTLRGPRGGMILCKEEYKKDIDKTIFPGIQGGPLEHVIAAKAVAFGEALNDDFKDYQNQVIKNAQALAQTLIEEGFRVVSGGTDNHLVAVDVKGSINMTGKLAEETLDKVGITCNKNTIPFDKEKPFVTSGVRLGTPAATTRGFDESAFVEVAKIISLALNNYDNDTKLNEAKERVHALTSKYPLYN

SEQ ID NO: 9451 - DNA, 1263 bp, Streptomyces avermitilis
  CDS (1)..(1263): transl_table=11
atgtcgcttctgaacacgcctctgcacgagctcgacccggacgtcgccgccgccgtcgacgccgagctgaaccgtcagcagtccaccctcgagatgatcgcctcggagaacttcgctccggtcgcggtcatggaggcccagggctcggtcctcaccaacaagtacgccgagggctacccgggccgccgctactacggcggctgcgagcacgtcgatgtggtcgagcagatcgccatcgaccgggtcaaggagctgttcggcgccgagcacgccaacgtccagccgcactcgggcgcccaggccaacgcggccgccatgttcgcgctgctcaagcccggcgacacgatcatgggtctgaacctcgcgcacggcgggcacctgacccacggcatgaagatcaacttctccggcaagctgtacaacgtggtcgcgtaccacgtggacgagaccaccggccaggtggacatggccgaggtcgagaagctggccaaggagtccaggccgaagctgatcgtggccggctggtcggcgtacccgcgccagttggacttcgccgcgttccgccggatcgcggacgaggtcggcgcgtacctgatggtcgacatggcgcacttcgccggcctggtggcggcgggtctgcacccgaaccccgtgccgcacgcccatgtcgtgaccacgaccacgcacaagacgctgggcggcccgcgcggtggcgtgatcctgtcgacggccgaactggccaagaagatcaactccgcggtcttcccgggtcagcagggtggtccgctggagcacgtgatcgccgccaaggccgtctccttcaaggtcgccgcctccgacgacttcaaggagcgccagcagcgcacgctggacggcgcccgcatcctggccgagcgtctggtccgggacgacgtcaaggccgtgggcgtggacgtcctctcgggcggcacggacgtgcacctggtcctcgtcgacctgcgcgactccgagctggacggccagcaggccgaggaccgcctccacgaggtcggcatcacggtcaaccgcaacgccatcccgaacgacccgcgcccgccgatggtgacgtccggcctgcgcatcggtacgccggccctcgccacccgcggcttccaggccgcggacttcaccgaggtcgcggacatcatcgccgaggcgctgaagccgtcctacgacgcggacgccctcaaggcccgggtgacggcactggcggacaagcacccgctgtatcccggtctgaagtag

SEQ ID NO: 9452 - protein, 420 aa, Streptomyces avermitilis
MSLLNTPLHELDPDVAAAVDAELNRQQSTLEMIASENFAPVAVMEAQGSVLTNKYAEGYPGRRYYGGCEHVDVVEQIAIDRVKELFGAEHANVQPHSGAQANAAAMFALLKPGDTIMGLNLAHGGHLTHGMKINFSGKLYNVVAYHVDETTGQVDMAEVEKLAKESRPKLIVAGWSAYPRQLDFAAFRRIADEVGAYLMVDMAHFAGLVAAGLHPNPVPHAHVVTTTTHKTLGGPRGGVILSTAELAKKINSAVFPGQQGGPLEHVIAAKAVSFKVAASDDFKERQQRTLDGARILAERLVRDDVKAVGVDVLSGGTDVHLVLVDLRDSELDGQQAEDRLHEVGITVNRNAIPNDPRPPMVTSGLRIGTPALATRGFQAADFTEVADIIAEALKPSYDADALKARVTALADKHPLYPGLK

SEQ ID NO: 9453 - DNA, 1263 bp, Streptomyces coelicolor
  CDS (1)..(1263): transl_table=11
atgtcgcttctgaacacacccctgcacgagctggacccggacgtcgccgccgccgtcgacgccgagctggaccgccagcagtccaccctcgagatgatcgcgtcggagaacttcgccccggtcgcggtcatggaggcccagggctcggtcctcaccaacaagtacgccgagggctaccccggccgccgctactacggcggctgcgagcacgtcgacgtggtcgagcagatcgccatcgaccgggtcaaggcgctcttcggcgccgagcacgccaacgtgcagccgcactcgggcgcccaggccaacgcggccgcgatgttcgcgctgctcaagcccggcgacacgatcatgggtctgaacctcgcgcacggcgggcacctgacccacggcatgaagatcaacttctccggcaagctctacaacgtggtcccctaccacgtcggcgacgacggccaggtcgacatggccgaggtggagcgcctggccaaggagaccaagccgaagctgatcgtggcgggctggtcggcctacccgcgtcagctggacttcgccgcgttccgcaaggtcgcggacgaggtcggcgcgtacctgatggtcgacatggcgcacttcgccggtctggtcgcggcgggcctgcacccgaacccggtcccgcacgcccacgtcgtcaccacgaccacccacaagacgctgggcggtccgcgcggcggtgtgatcctctccacggccgagctggccaagaagatcaactccgccgtcttccccggtcagcagggtggcccgctggagcacgtggtggccgccaaggccgtcgccttcaaggtcgccgcgagcgaggacttcaaggagcgccagggccgtacgctggagggtgcccgcatcctggccgagcgcctggtgcgggacgacgcgaaggccgcgggcgtctccgtcctgaccggcggcacggacgtccacctggtcctggtggacctgcgcgactccgagctggacggacagcaggccgaggaccgcctccacgaggtcggcatcacggtcaaccgcaacgccgtcccgaacgacccgcgcccgccgatggtgacctccggtctgcgcatcggtacgccggccctggcgacccgcggcttcaccgccgaggacttcgccgaggtcgcggacgtgatcgccgaggcgctgaagccgtcctacgacgcggaggccctcaaggcccgggtgaagaccctggccgacaagcacccgctgtacccgggtctgaacaagtag

SEQ ID NO: 9454 - protein, 420 aa, Streptomyces coelicolor
MSLLNTPLHELDPDVAAAVDAELDRQQSTLEMIASENFAPVAVMEAQGSVLTNKYAEGYPGRRYYGGCEHVDVVEQIAIDRVKALFGAEHANVQPHSGAQANAAAMFALLKPGDTIMGLNLAHGGHLTHGMKINFSGKLYNVVPYHVGDDGQVDMAEVERLAKETKPKLIVAGWSAYPRQLDFAAFRKVADEVGAYLMVDMAHFAGLVAAGLHPNPVPHAHVVTTTTHKTLGGPRGGVILSTAELAKKINSAVFPGQQGGPLEHVVAAKAVAFKVAASEDFKERQGRTLEGARILAERLVRDDAKAAGVSVLTGGTDVHLVLVDLRDSELDGQQAEDRLHEVGITVNRNAVPNDPRPPMVTSGLRIGTPALATRGFTAEDFAEVADVIAEALKPSYDAEALKARVKTLADKHPLYPGLNK

SEQ ID NO: 9455 - DNA, 1239 bp, Symbiobacterium thermophilum
  CDS (1)..(1239): transl_table=11
atggatgcactgaagcggtatgatcccgaggtcttcgcggccattcagcaggaggtcgagcggcagcagcgcaacattgagctgatcgcctcggagaacttcgtgcccaaggcggtcctcgaggcggcgggcacggtgctcaccaacaagtacgccgagggctatcccggccggcggtactacggcggctgcgagtacgtggacatcgtggagaacatcgcccgggagcggctgaaggcggccttcggcgcggagcacgtcaacgtccagccgcactcgggggccaacgccaacacggcggtctacttcgccttcctccagcccggcgatacggtgctgggcatgaacctggcccagggcggccacctgacccacggctcgccggtcaacttcagcggcaggacttacaacttcgtgccctacggcctggacccggagaccgagcggatcaacatggaccaggtggcggagctggcccggcagcaccggcccaagctcatcgtcgccggctactcggcctacccgcgggtcctggacttcaagcggttccgggagatcgccgaagaggtgggcgccatcctgatggtggacatggcccacttcgccggcctggcggccacgggctactacccgaacccggtggagcacgcgcacgtggtcaccaccaccacccacaagacgctgcgcgggccgcggggcggggcgatcctctgcaagaaggagttcgccaaggagatcgacaaggcggtcttcccgggcatgcagggcggccccctgatgcacatcatcgccgccaaggcggtggccttcaagcagctctccgacccggactacagggcatactgcggccaggtggtgaagaacgccaaggccctggcccaggcgctgctggagcggggctaccggctggtcaccggcggcaccgacaaccacctgatgctggtggacctgcggcccaagggcatcaccggccgggacgcggagcacctgctggacagggtctcgatcacggtcaacaagaacgccatccccaacgaccccgagaagccgatggtgaccagcggcatccgcatcggcaccccggccatgaccacccgggggatgaaggaggccgagatggtccagatcgccgacctcatcgaccgggccatcacccaccggaacgacgaggcggagctggaccggatccgggcggaggtgcacgagctcacggcccggttcccgctctacgccgactag

SEQ ID NO: 9456 - protein, 412 aa, Symbiobacterium thermophilum
MDALKRYDPEVFAAIQQEVERQQRNIELIASENFVPKAVLEAAGTVLTNKYAEGYPGRRYYGGCEYVDIVENIARERLKAAFGAEHVNVQPHSGANANTAVYFAFLQPGDTVLGMNLAQGGHLTHGSPVNFSGRTYNFVPYGLDPETERINMDQVAELARQHRPKLIVAGYSAYPRVLDFKRFREIAEEVGAILMVDMAHFAGLAATGYYPNPVEHAHVVTTTTHKTLRGPRGGAILCKKEFAKEIDKAVFPGMQGGPLMHIIAAKAVAFKQLSDPDYRAYCGQVVKNAKALAQALLERGYRLVTGGTDNHLMLVDLRPKGITGRDAEHLLDRVSITVNKNAIPNDPEKPMVTSGIRIGTPAMTTRGMKEAEMVQIADLIDRAITHRNDEAELDRIRAEVHELTARFPLYAD

SEQ ID NO: 9457 - DNA, 1272 bp, Thermobifida fusca
  CDS (1)..(1272): transl_table=11
atgaccgcccagagcacttcgctcacccagtcgctggctcagctcgaccctgaggtcgcggcagccgtggacgccgagctcgcccgccagcgcgacaccttggagatgatcgcctccgaaaactttgcgccccgggcggtgctggaggcgcaaggcacggtgctgaccaacaagtacgcggaaggctacccgggccgccgctactacggcgggtgtgagcacgtggacgtcatcgaacagctggccatcgaccgtgccaaggccctgttcggtgccgagcacgccaacgtgcagccgcactcgggcgctcaggcgaacaccgccgtgtactttgcgctgctgcagccgggcgacaccatcctgggcctggacctcgcacacggcgggcacctcacccacggcatgcggatcaactactccggcaagatcctcaacgccgtggcctaccacgtacgcgagtccgacggcctgatcgactacgacgaggtcgaagcgctagccaaggagcaccagccgaaactgatcatcgcgggctggtcggcgtacccgcgccagttggactttgcccggttccgggagatcgccgaccagacaggcgccctcctcatggtggatatggcgcatttcgcgggtctggtcgcggctggactgcaccccaacccggtcccctacgccgacgtagtgaccaccaccacccacaagaccttgggcgggccgcgaggcgggctcatcctggccaaggaggagctgggcaagaagatcaactcggcggtgttcccggggatgcagggcggtccgctccagcacgtcatcgctgccaaggccgtagcgttgaaggtcgcggccagcgaagagttcgctgagcggcagcggcgcaccctttccggcgcgaagatcctcgccgagcggctcacccagcctgacgcggccgaggccggtattcgggtgctgaccggcggcaccgacgtccacctggtcctggtcgacctggtcaactcggaactcaacggcaaagaggcggaggaccggctgcacgagatcggtatcacggtcaaccgcaacgcggtccccaacgacccgcggccgcccatggtcacgtcgggactgcggatcggcaccccggctctcgccacccgcggtttcggcgacgccgacttcgctgaggtcgccgacatcatcgctgaggcgctcaagccgggcttcgacgcggcgaccctgcgctcccgcgtccaggcgctggccgccaagcacccgctctaccctggactgtga

SEQ ID NO: 9458 - protein, 423 aa, Thermobifida fusca
MTAQSTSLTQSLAQLDPEVAAAVDAELARQRDTLEMIASENFAPRAVLEAQGTVLTNKYAEGYPGRRYYGGCEHVDVIEQLAIDRAKALFGAEHANVQPHSGAQANTAVYFALLQPGDTILGLDLAHGGHLTHGMRINYSGKILNAVAYHVRESDGLIDYDEVEALAKEHQPKLIIAGWSAYPRQLDFARFREIADQTGALLMVDMAHFAGLVAAGLHPNPVPYADVVTTTTHKTLGGPRGGLILAKEELGKKINSAVFPGMQGGPLQHVIAAKAVALKVAASEEFAERQRRTLSGAKILAERLTQPDAAEAGIRVLTGGTDVHLVLVDLVNSELNGKEAEDRLHEIGITVNRNAVPNDPRPPMVTSGLRIGTPALATRGFGDADFAEVADIIAEALKPGFDAATLRSRVQALAAKHPLYPGL

SEQ ID NO: 9459 - DNA, 1224 bp, Thermus thermophilus
  CDS (1)..(1224): transl_table=11
atggtgagcaccctcaagcgggacgaggccctctttgagctcatcgccttagaggagaaaaggcagcgggaaggcctggagctcatcgccagcgaaaacttcgtctccaagcaggtgcgggaggcggtggggagcgtcctcaccaacaagtacgccgagggctaccccggggcccggtactacggggggtgcgaggccattgaccgggtggagtccctggccatagagcgggccaaggccctcttcggagcggcctgggccaacgtccagccccactccggctcccaggccaacatggcggtctacatggccctgatggagccgggggacaccctcatgggcatggacctcgcggccggcggccacctcacccacggctcccgcgtgaacttctccgggaagctttacaaggtggtctcctacggggtccgtcccgacacggagctcatagacctggaggaggtccgccgcctcgccctcgagcaccgccccaaggtgatcgtggccggggccagcgcctacccccgcttctgggactttaaggcctttcgggagatcgccgacgaggtgggggcctacctcgtggtggacatggcccacttcgccgggctcgtggccgcgggcctccacccgaaccccctgccttacgcccacgtggtgacgagcaccacccacaaaaccctccggggcccgaggggcggcctcatcctctccaacgaccctgagctcggcaagaggattgacaagctcatcttccccgggatccagggggggcccttggagcacgtgatcgccgggaaggccgtggccttctttgaggccctacagcccgagttcaaggagtacagccgcctggtggtggaaaacgccaagcgcctggcggaggcgcttgcccgccggggctaccgcatcgtcaccggggggacggacaaccacctcttcctcgtggacctgcgccccaagggcctcaccgggaaggaggcagaggagaggctggacgccgtggggatcacggtgaacaagaacgccatcccctttgaccccaagcccccccgggtcacctcggggatccgcatcggcaccccggccatcaccacccggggcttcacccccgaggagatgcccctcgtcgccgagctcatagaccgggcccttctggagggcccctcggaggccctgcgggaagaggtgcgcaggctcgccctggcccaccccatgccctga

SEQ ID NO: 9460 - protein, 407 aa, Thermus thermophilus
MVSTLKRDEALFELIALEEKRQREGLELIASENFVSKQVREAVGSVLTNKYAEGYPGARYYGGCEAIDRVESLAIERAKALFGAAWANVQPHSGSQANMAVYMALMEPGDTLMGMDLAAGGHLTHGSRVNFSGKLYKVVSYGVRPDTELIDLEEVRRLALEHRPKVIVAGASAYPRFWDFKAFREIADEVGAYLVVDMAHFAGLVAAGLHPNPLPYAHVVTSTTHKTLRGPRGGLILSNDPELGKRIDKLIFPGIQGGPLEHVIAGKAVAFFEALQPEFKEYSRLVVENAKRLAEALARRGYRIVTGGTDNHLFLVDLRPKGLTGKEAEERLDAVGITVNKNAIPFDPKPPRVTSGIRIGTPAITTRGFTPEEMPLVAELIDRALLEGPSEALREEVRRLALAHPMP

SEQ ID NO: 9461 - DNA, 1242 bp, Thermoanaerobacter tengcongensis
  CDS (1)..(1242): transl_table=11
atggatattgaaataataagaaaaacagacccagaaatcgcagaagtcatattaaaagaactcaacagacagagaaacaaaatagagcttatagcctctgaaaactttgtgagcagggccgtaatggaagcaatgggtacccctctcacaaataaatacgcagaagggtatcccggaaggcgttattacggtggctgtgaatatgtagatatggcagaggaacttgcaagggaaaggcttaaaaagcttttcggagcggaacacgcaaatgtgcagcctcactcgggagctcaggcaaatatggcagcttattttgcacttctaaaacctggagatactgtactaggaatggatttagctcacggcggacatttaacccatggaagcaaagtcaatttttctgggcaaatatataactttgtatcctatggcgtaagagaagatacaggatacatagactatgaccaagtagaagacctagcaaaaaagcataaaccaaaactaattgtagctggcgctagtgcttatccaagaataattgactttaagaaatttagagaaattgcagacaaggtaggagcatatctgatggtagacatggctcacattgccgggcttgtcgcagcaggtttacacccaaatcctgttccttatgcagacgtagtgacaactactactcataagactttaagaggacctagaggaggagctatactctgtaaacaagaacacgcaaaagccatcgacaaagcccttttccctggaacacaaggtggacccttaatgcatattatagcagcaaaagctgtatgttttaaagaagccctttcagatgagtttaaagaatatcaaaaaaggattgtagaaaacgcaaaagctttagcaaatgcattaatggaaagaggaataaatttggtatccggcggtactgacaaccacttaatgctattagatttgcgaaacacaggaataacaggaaaggaattggaaactagattagatgaagtaaacataacttgcaataaaaacgctataccttttgatccattaggaccaaatgtaacctctggcgtaagattaggtacacctgcagttaccaccagaggaatgaaaccggaagacatggtagaaatagcagatataatagctaatatgataaaagatgaaaattacaaagaaaaagcgaaagaaagggtagcaaaactacttgaaaaataccctctctacccagacctcttataa

SEQ ID NO: 9462 - protein, 413 aa, Thermoanaerobacter tengcongensis
MDIEIIRKTDPEIAEVILKELNRQRNKIELIASENFVSRAVMEAMGTPLTNKYAEGYPGRRYYGGCEYVDMAEELARERLKKLFGAEHANVQPHSGAQANMAAYFALLKPGDTVLGMDLAHGGHLTHGSKVNFSGQIYNFVSYGVREDTGYIDYDQVEDLAKKHKPKLIVAGASAYPRIIDFKKFREIADKVGAYLMVDMAHIAGLVAAGLHPNPVPYADVVTTTTHKTLRGPRGGAILCKQEHAKAIDKALFPGTQGGPLMHIIAAKAVCFKEALSDEFKEYQKRIVENAKALANALMERGINLVSGGTDNHLMLLDLRNTGITGKELETRLDEVNITCNKNAIPFDPLGPNVTSGVRLGTPAVTTRGMKPEDMVEIADIIANMIKDENYKEKAKERVAKLLEKYPLYPDLL

SEQ ID NO: 9463 - DNA, 1278 bp, Wolbachia pipientis wMel
  CDS (1)..(1278): transl_table=11
atgatgagtgttttaaaaaaaatctgtggctctaaaaatagtttaaagtcttttgataacgaggtttatcagtctatagaaaaagaattacaacgccaaaaatcacaattgcaattaattgcatcagaaaattttgcaagcaaagcggtaatggaggcacaaggctcttttctgactaataaatacgcagaaggttatccaggtaaaagatattactgtggttgtgagcatgtggacaaaattgaaagtctggctatagaaagactttgtaagttgtttggtgttaaatttgcaaacgttcaacctcattctggttctcaggcaaaccaggcggtatttgcttcactgcttactccaggcgatacaatacttggattatcactgagttgcggtgggcatctaactcatggtgcggcaccaagcctttctggtaaatggtttaagtcaattcaatatacagtgaataaagacacttatctgctcaatatggatgagatagaaaagctggcgctggagcataaaccgaaattgatcatagctggtgcttctgcttatccaagaaaaatggacttcaaacgctttcgcgagattgcagataaagttggtgcttatttgcttgcagacattgctcactatgcagggcttattgcagcgggcgaatatccatcccctgctgaatatgcacatgttatgacttccacgactcacaaaactttgcgtggtcctcgtggtggaatagtgatgaccaatgatgaagcattacacaaaaaaattcaatccgcagtttttccaggattgcagggcgggccacttatgcatgtgatagctgcaaaagctgttgcatttaaagaagcattagcaccagagtttaagacttatagcaagaaagtcgtggaaaatgcgaaagtgctggctcaagaattgcaaaagcatggacttgacattataaccggtggcactgactctcatatagtgctagttgacttaagatcgcagaaattaactggaaaagacgttgtagatagccttgagagagccggtattacctgtaataaaaactctgtaccatttgatacagcaaagccgaccatcacttcagggctccgttttggcaccgctgctgagacaacacgcggacttgaggcagaaaattttaaagagatagctggtctaataaatgaagtaattcaaggattaatcagcggaaatagctcaagtgtcgaaaaagcagtaaaagctaaagttgaaaggatttgtagtaattttcctatttattaa

SEQ ID NO: 9464 - protein, 425 aa, Wolbachia pipientis wMel
MMSVLKKICGSKNSLKSFDNEVYQSIEKELQRQKSQLQLIASENFASKAVMEAQGSFLTNKYAEGYPGKRYYCGCEHVDKIESLAIERLCKLFGVKFANVQPHSGSQANQAVFASLLTPGDTILGLSLSCGGHLTHGAAPSLSGKWFKSIQYTVNKDTYLLNMDEIEKLALEHKPKLIIAGASAYPRKMDFKRFREIADKVGAYLLADIAHYAGLIAAGEYPSPAEYAHVMTSTTHKTLRGPRGGIVMTNDEALHKKIQSAVFPGLQGGPLMHVIAAKAVAFKEALAPEFKTYSKKVVENAKVLAQELQKHGLDIITGGTDSHIVLVDLRSQKLTGKDVVDSLERAGITCNKNSVPFDTAKPTITSGLRFGTAAETTRGLEAENFKEIAGLINEVIQGLISGNSSSVEKAVKAKVERICSNFPIY

SEQ ID NO: 9465 - DNA, 1251 bp, Wolinella succinogenes
  CDS (1)..(1251): transl_table=11
atgaattacgcactagaaaccaatgacaaagagatttttgacctcattcatgaagagcttgatcgacaaaacacccaccttgagatgattgccagcgaaaacttcacctttcctgcggtcatggaggcgatggggagcgtgctcactaataagtatgctgagggctatccctataagcgctattacggcggttgtgagtttgttgatagagtcgaagagattgcgattgagcgagccaagaagctctttggatgtggttttgccaatgttcagccccacgcggggagccaagccaatgtcgcagtctataatgctctacttaagccctacgacaaaattttgggaatggatctaagccatgggggacatctcacgcatggagccaaagtgagtgtgacgggtcagacctatcagagcttcttttatggggtggagctggatggctatatcaactatgacaaggttgaagagatcgctaaaatcgtgaaacctcagatgattgtctgcggatttagtgcctatgccagggagcttgatttcaaacgattccgagagattgccgatagcgtgggcgctctgctcttgggtgatgtggcgcatgtggcgggattgattgtggcgggtgagtatcccaatcccttcccccactgccatattgtcaccaccaccacccacaagacgcttcgaggacctaggggtgggatgattctcaccaacgacgaagagatcgccaagaagattgacaaggcggtattccctggaatgcaaggggggcctttgatgcatgtgattgcagccaaggcggtgggctttggagagaatcttaagcctgagtggaaagagtatgccaagcaggtcaaagccaatgccaaagtgctcgctaaagtgctcatggccagaggctacacgctcgtgagtggaggcacagataatcatttgattctagtctctctgctggacaaagagtttagcggcaaagatgccgacagggcactaggcgaggcaggaatcacggtcaacaaaaacaccgttcctggagagactcgaagtccttttgtgaccagcggagtgagaatcggaagcgccgcgcttaccgctaggggcatgagagagaaggagtttgagttcattgcaaccaaaattgccgatgttctagatgatgtcaataacgccgctaaacacgcggagatcaaaaaagagatcgctgagtttgccaagggattccctgtctacaccaaggctattttttaa

SEQ ID NO: 9466 - protein, 416 aa, Wolinella succinogenes
MNYALETNDKEIFDLIHEELDRQNTHLEMIASENFTFPAVMEAMGSVLTNKYAEGYPYKRYYGGCEFVDRVEEIAIERAKKLFGCGFANVQPHAGSQANVAVYNALLKPYDKILGMDLSHGGHLTHGAKVSVTGQTYQSFFYGVELDGYINYDKVEEIAKIVKPQMIVCGFSAYARELDFKRFREIADSVGALLLGDVAHVAGLIVAGEYPNPFPHCHIVTTTTHKTLRGPRGGMILTNDEEIAKKIDKAVFPGMQGGPLMHVIAAKAVGFGENLKPEWKEYAKQVKANAKVLAKVLMARGYTLVSGGTDNHLILVSLLDKEFSGKDADRALGEAGITVNKNTVPGETRSPFVTSGVRIGSAALTARGMREKEFEFIATKIADVLDDVNNAAKHAEIKKEIAEFAKGFPVYTKAIF

SEQ ID NO: 9467 - DNA, 1254 bp, Yersinia pestis
  CDS (1)..(1254): transl_table=11
atgttaaagcgtgaaatgaacattgccgattacgatgcagatctgtggcgtgcaatggagcaagaagtcgtgcgtcaggaagaacacatcgaactgattgcgtctgagaactacaccagcccgcgtgttatgcaagcgcagggatctcagttaacgaacaaatatgctgaaggctatccaggcaagcgttattacggtggctgtgaatatgttgatgttgttgaacaattggcaatcgatcgcgctaaagcattatttggtgctgattacgcaaacgttcaacctcattctggttcgcaagctaacgttgctgtttactccgcgctgctgaaacccggtgacaccgtattggggatgaatctggcacacggcggtcacttgacgcatggttcaccagtgaacttctccggcaaactctacaacatcgtcccttatggtattgatgagtcgggtcaaattgattatgaagatctggcacgtcaggcagaaatacataaacccaaaatgattatcggtggcttctccgcctattctggtatcgttgattgggcaaaaatgcgtgaaattgccgacagcattgacgcatggttctttgttgatatggctcatgttgctggtctggttgctgcgggggtttatcctaacccggttccacatgcccacatcgttaccaccacgacgcacaagactctggctggcccacgtggcggtttgattctggcgaaagggggcgatgaagacttgtacaaaaaactgaactcttctgttttccctggtaaccagggtggcccattgatgcatgttatcgcaggtaaagcggtcgcgctgaaagaagcaatggaacctgagtttaaaatttaccaacagcaagtggctaaaaatgcgaaagccatggtggcggtgttcttggagcgcggttacaaagtggtttctggtggtacggataaccacctgttcttgctagatttggtggataaagacatcaccggtaaagacgctgatgcggctttaggccgtgcgaatatcaccgtgaacaaaaacagcgtacctaacgatccgaagagcccgtttgtgacatctggtgtgcgtattggtagcccagcgatcacccgccgtggcttcaaagaagcggaatcccgtgaattggctggctggatgtgtgatgtgttagataacatcaacgatgaagcgaccattgagcgtgtgaaacagaaagttctggctatctgcgctcgtttaccggtttacgcataa

SEQ ID NO: 9468 - protein, 417 aa, Yersinia pestis
MLKREMNIADYDADLWRAMEQEVVRQEEHIELIASENYTSPRVMQAQGSQLTNKYAEGYPGKRYYGGCEYVDVVEQLAIDRAKALFGADYANVQPHSGSQANVAVYSALLKPGDTVLGMNLAHGGHLTHGSPVNFSGKLYNIVPYGIDESGQIDYEDLARQAEIHKPKMIIGGFSAYSGIVDWAKMREIADSIDAWFFVDMAHVAGLVAAGVYPNPVPHAHIVTTTTHKTLAGPRGGLILAKGGDEDLYKKLNSSVFPGNQGGPLMHVIAGKAVALKEAMEPEFKIYQQQVAKNAKAMVAVFLERGYKVVSGGTDNHLFLLDLVDKDITGKDADAALGRANITVNKNSVPNDPKSPFVTSGVRIGSPAITRRGFKEAESRELAGWMCDVLDNINDEATIERVKQKVLAICARLPVYA

SEQ ID NO: 9469 - DNA, 1290 bp, Zymomonas mobilis
  CDS (1)..(1290): transl_table=11
atgactaaagaaacggcatctttctttaccgatcgcttggctgcggctgatccagatgtgttgacagcgatcaatcatgaattgaaccgccagcgcaagcagatcgagcttatcgcttctgaaaatattgtcagccgtgctgttctggaagcgcaaggctctgtctttaccaataaatatgctgaaggctatcccggcaagcgctattatcagggttgcgccccttccgatgagatcgaaacgctggctatcgaacgcgccaagaaattattcggcagcgaattcgtcaatgttcagccacattccggcgctcaggcaaatggtgccgttcttttagcggtcgcgaagcccggcgataccattatgggtctgtctttggatgccggtgggcatttgacccatggtgccaaggcggccatgtctggcaaatggttcaatgcagttcagtatgcggtgcatcctgaaacccagttgatcgattacgatcaggtgcgcgatctggctttgaaaaacaagccgcgcgttatcattgcgggtggctcagcctatccccgtcatatcgattttgccttcttccgtaaggttgccgatgaagtcggagctacctttatggttgacatggcgcattttgcaggtctggttgctggcggtgttcatccttcacctgtgccacatgcgcatatcacgaccacgacaacgcataagaccttgcggggcccgcgcggtggtatgatcttgaccgatgatccggctttggcaaagaaaatcaattcggctgtcttccctggcatgcagggtggccccttgatgcatgtcatcgcggcaaaagcagttgctttcggtgaggccttgcagccttctttcaaagaatatgcaaaagctgttgtcgaaaatgctcaagccttggcagctcgcttgaaagaacgcggtagcgatctcgtaacgggtggcacggatacgcatctggctttggttgatcttcggcctttgggtgtgactggccgtgatgctgattgtgctttggaacgcgccggtatcacctgcaacaaaaatggtattcctttcgatccgttaccgccagttaaaacctccggtatccgtctgggatcgcctgcggcgacgacccgcggtttccgtaaagcggaattccttcaggtcgctgatatgattgctgatgttcttgatgcgttgagcagcaagggcgaacaaggtgatccggcggttgaaaccgctgttcgtcagcgtgtcgaagcgctctgtgatcgcttcccactttatccggaattgtaa

SEQ ID NO: 9470 - protein, 429 aa, Zymomonas mobilis
MTKETASFFTDRLAAADPDVLTAINHELNRQRKQIELIASENIVSRAVLEAQGSVFTNKYAEGYPGKRYYQGCAPSDEIETLAIERAKKLFGSEFVNVQPHSGAQANGAVLLAVAKPGDTIMGLSLDAGGHLTHGAKAAMSGKWFNAVQYAVHPETQLIDYDQVRDLALKNKPRVIIAGGSAYPRHIDFAFFRKVADEVGATFMVDMAHFAGLVAGGVHPSPVPHAHITTTTTHKTLRGPRGGMILTDDPALAKKINSAVFPGMQGGPLMHVIAAKAVAFGEALQPSFKEYAKAVVENAQALAARLKERGSDLVTGGTDTHLALVDLRPLGVTGRDADCALERAGITCNKNGIPFDPLPPVKTSGIRLGSPAATTRGFRKAEFLQVADMIADVLDALSSKGEQGDPAVETAVRQRVEALCDRFPLYPEL

SEQ ID NO: 9471 - DNA, 1410 bp, Ashbya gossypii
  CDS (1)..(1410)
atgccataccacctatccgaatcgcacaagaagctcatctcctcgcacctgagcgagagcgacccagaggtggacgcgatcatcaaggatgaaattgacaggcaaaagcactcgattgtgctgattgcgtcggagaacttgacgtcgaccgccgtgttcgacgcgctaggaacgccgatgtgcaacaagtactcggagggctaccccggcgcgcgctactacggcgggaaccagcacatcgaccgcatggagctgctgtgccagcgccgcgcgctggaggcgttccacgtgacgccggaccgctggggcgtcaacgtgcagtcgctgtccgggtcgcccgcgaacctgcaggtgtaccaggcgctgatgaagccgcacgagcggctgatgggtctgcacctgcccgacggcgggcacctgtcgcacggctaccagacggagacgcgcaagatctccgcggtatcgacgtacttcgagtcgttcccgtaccgcgtggacccggagaccggcatcatcgactatgacacgctcgagaagaacgcggtgctgtaccggcccaagatccttgtggcgggcacctccgcgtactgccggctgatcgactacaagcggatgcgcgagatcgccgacaaggtcggtgcgtacctgatggtcgacatggcgcacatctcggggctggtcgccgcaggcgtcatcccctcgcccttcgagtacgccgacatcgtcaccaccaccacccacaagtcgctcagaggcccacggggagccatgatcttcttcaggagaggcgtgcgctccgtgcacccaaagaccggcgaggaggtaatgtacgacctcgagggccctatcaacttctccgtcttccccggccaccagggcggcccccacaaccacaccatctccgccctggccaccgcgctcaagcaggcgacgacccccgagttcagggagtaccaggagctcgtgttgaagaacgccaaggtcctggagaccgagttcaaaaagctcaactaccgcctcgtctccgacggcaccgactcccacatggtcctcgtctccttgcgcgagaagggcgtcgacggcgcccgcgtcgagcacgtctgcgagaagatcaacatcgccctcaacaagaactccatcccaggcgacaagtccgcgctcgtgcccggcggcgtccgcatcggcgcccccgccatgaccaccaggggcatgggcgaggaggacttcgcccgcatcgtcggctacatcaaccgtgctgtcgagatcgcccgttccatccagcagtcgctgcccaaggaggccaacaggctcaaggacttcaaggccaaggtcgagggcggcaccgacgagatagcacagctcgcccaggagatctacagctggactgaggagtaccctctgcctgtctaa

SEQ ID NO: 9472 - protein, 469 aa, Ashbya gossypii
MPYHLSESHKKLISSHLSESDPEVDAIIKDEIDRQKHSIVLIASENLTSTAVFDALGTPMCNKYSEGYPGARYYGGNQHIDRMELLCQRRALEAFHVTPDRWGVNVQSLSGSPANLQVYQALMKPHERLMGLHLPDGGHLSHGYQTETRKISAVSTYFESFPYRVDPETGIIDYDTLEKNAVLYRPKILVAGTSAYCRLIDYKRMREIADKVGAYLMVDMAHISGLVAAGVIPSPFEYADIVTTTTHKSLRGPRGAMIFFRRGVRSVHPKTGEEVMYDLEGPINFSVFPGHQGGPHNHTISALATALKQATTPEFREYQELVLKNAKVLETEFKKLNYRLVSDGTDSHMVLVSLREKGVDGARVEHVCEKINIALNKNSIPGDKSALVPGGVRIGAPAMTTRGMGEEDFARIVGYINRAVEIARSIQQSLPKEANRLKDFKAKVEGGTDEIAQLAQEIYSWTEEYPLPV

SEQ ID NO: 9473 - DNA, 1410 bp, Candida glabrata
  CDS (1)..(1410)
atgccttatgcgttatctgataagcacttgaagatggtcagtggccatctaagtgaaactgaccctgaagttgaacagattatcaaggatgaagtcgacagacaaaagcactccattgacttgatcgcctctgagaacttcaccaccacctctgtgttcgatgctttgggaactccactatgtaacaagtactctgagggttacccaggtgctcgttactacggtggtaacgaacacattgaccgcattgaaagactgtgtcaacagagagccttggaggctttccatgtaactccagacagatggggtgtcaatgttcagactttgtctggttctccagctaacttgcaggtatatcaagctttgatgaagccccacgaaagattaatgggtctatacttgccagatggtggccatttgtcccatggttacgctactgagaacagaaagatcagtgctgtctccacctacttcgaatccttcccatacagagtcaacccagaaactggtatcatcgactatgacaccttggagaagaatgctatcctatacagaccaaagattctagttgctggtacttctgcttactgtcgtctgatcgactacaagagaatgagagagatcgctgacaaatgtggtgcttacttaatggtcgacatggcccacatttccggtttggtcgccgctggtgtcattccatctccattcgaatacgctgacatcgttaccactaccactcacaagtctctaagaggtcctcgtggtgcaatgatcttcttcagaagaggtatcagatcagttaaccaaaagactggtaaggaaattccatatgacttggagaacccaattaacttctctgtcttcccaggtcaccaaggtggtccacacaaccataccattgctgctttggccaccgcactaaaacaagctgctactccagagttcaaggaataccaaactcaagttctaaagaacgctaaggctctagaaaatgagttccaaactctaggttacagactagtctcaaacggtaccgactcacacatggttttggtctccttgagagaaaagggtgtcgatggtgctcgtgttgaatatgtctgtgaaaagattaacattgccttgaacaagaactctattccaggtgataagtcagctttggtcccaggtggtgtacgtattggtgccccagctatgactaccagaggtatgggcgaagaagacttccacagaattgtacgttacattgaccaagctgtgaagtttgctgaacagacccagagctctttgccaaaggaagccaacaaattgaaggacttcaaggccaaggtcgacgaaattgccgaccaactggctccattgaagaaagaaatttacgactggactgctgaataccctctagctgtctaa

SEQ ID NO: 9474 - protein, 469 aa, Candida glabrata
MPYALSDKHLKMVSGHLSETDPEVEQIIKDEVDRQKHSIDLIASENFTTTSVFDALGTPLCNKYSEGYPGARYYGGNEHIDRIERLCQQRALEAFHVTPDRWGVNVQTLSGSPANLQVYQALMKPHERLMGLYLPDGGHLSHGYATENRKISAVSTYFESFPYRVNPETGIIDYDTLEKNAILYRPKILVAGTSAYCRLIDYKRMREIADKCGAYLMVDMAHISGLVAAGVIPSPFEYADIVTTTTHKSLRGPRGAMIFFRRGIRSVNQKTGKEIPYDLENPINFSVFPGHQGGPHNHTIAALATALKQAATPEFKEYQTQVLKNAKALENEFQTLGYRLVSNGTDSHMVLVSLREKGVDGARVEYVCEKINIALNKNSIPGDKSALVPGGVRIGAPAMTTRGMGEEDFHRIVRYIDQAVKFAEQTQSSLPKEANKLKDFKAKVDEIADQLAPLKKEIYDWTAEYPLAV

SEQ ID NO: 9475 - DNA, 1383 bp, Encephalitozoon cuniculi
  CDS (1)..(1383)
atgacagatgcaagagaaaagggcttctggacaggcccgctggagatggcagaccccgagctccatgccctgatctgcggagaggtcgagaggcagaagaagacaataaacctgatagcaagcgagaactatgcgcatcagagcgcgatggaggcctgtgggtctgtcctcaccaacaagtattcagaaggcagggtgggagagcgatactacggggggacgcactgggtcgacaggatcgagctcctctgccagaagagggctctcgagctcttcgggctggatcctgacgtctggggcgtcaatgtccagccatactcggggagcccagccaactttgcaatctacacggccgttgtccctccgggcgggaggatcatgggccttgacctgccgtctggaggacacctgacccatggatacaagacgaagaccaggaagatatctgcctcaagcgtctacttcgactcaaggccatacacagtggggagcaacggcctcatcgactacgagggcctcgagaagaccttcacggactttctgccgcacatcctgatctgcggatacagcgcatactccagagacatcgactacaagaggctgcagtcgatagccggcaggaacggtgcctttctgtttgcagacatctcgcacatctcgccgctggttgcgtctgggctgatgaacagcccgttcgagcactgcgacattgtcatgacgacaacgcagaaggggctccggggacctcgaggggcgctcatcttctacaggagggccgtgacaaagaatggggagactgtggatctggatgcccggatcaactttgccgtgtttccgatgctgcagggaggcccccacaaccacacgattgcagggattgcctctgcacttctccatgcaggaactcccgagtttgcggagtacacaaggcgcgtggtggagaactcgagggagctgtgcagccgcttgcagtctctgggccttgacatcctgacggggggaacggacaaccacatgctccttgtggatctccggagcacgggtgtcgacggggcggctgtggagcacatgtgcgatgccctgggcatcagcctgaacagaaacgccattgtcggaaactccagcccgctgagcccgtctggaatacgtgtgggcacatatgcagtcactgccaggggatttggccccgaggagatgagggaggttggagacataatcggcggggtagtcaagctctgcagggagatgacgggcggcaggaagatgtcgaaggccgatctccacagagtgacgtccgatgcccgggtcatgggcagcgagcaggttttagtgctgagaagaagagtgtgtgccctggcagaggcatatcccatctacgaatga

SEQ ID NO: 9476 - protein, 460 aa, Encephalitozoon cuniculi
MTDAREKGFWTGPLEMADPELHALICGEVERQKKTINLIASENYAHQSAMEACGSVLTNKYSEGRVGERYYGGTHWVDRIELLCQKRALELFGLDPDVWGVNVQPYSGSPANFAIYTAVVPPGGRIMGLDLPSGGHLTHGYKTKTRKISASSVYFDSRPYTVGSNGLIDYEGLEKTFTDFLPHILICGYSAYSRDIDYKRLQSIAGRNGAFLFADISHISPLVASGLMNSPFEHCDIVMTTTQKGLRGPRGALIFYRRAVTKNGETVDLDARINFAVFPMLQGGPHNHTIAGIASALLHAGTPEFAEYTRRVVENSRELCSRLQSLGLDILTGGTDNHMLLVDLRSTGVDGAAVEHMCDALGISLNRNAIVGNSSPLSPSGIRVGTYAVTARGFGPEEMREVGDIIGGVVKLCREMTGGRKMSKADLHRVTSDARVMGSEQVLVLRRRVCALAEAYPIYE

SEQ ID NO: 9477 - DNA, 1419 bp, Schizosaccharomyces pombe
  CDS (1)..(1419)
atgaagtgttctaataaagttctaacgataattaagttactcaaagcaccattggcagaatgtgatccgacagtgtataagattttggaatctgagaaaagccgtcagaaagagtcgatagctttaattgctagcgaaaactttacttcaagagctgtgatggatgcactcggaagtattatgcaaaacaaatatagtgaaggctatcctggtgcaagatattatggtggtaatgaatttatagatcaagctgaaagactatgtcaaacgagagctttagaagcttttcatttggatggggaaaaatggggagtaaatgtacaaccccattctgggtctccggccaacttacaggcttatcaagcagtaatgaagccacacgatcgcctaatgggtttagatttaccccatggcggtcatttatctcatggtttctctactccccagaaagctatttcagctgtctcgacttatttttccaccatgccatataacgtaaataaggaaactggtattattgactatgatagtttggaaaaggctgcgatacaatttcgtcctaaagttatagttgcaggcgctagtgcttatgcacgactcgttgattacaagcgtatgcgtaaaattacggaaatgtgcaatgcctatttgctttgtgatatggctcacatatccggtttagtagctgccggtgtaattccttctccgtttgaatacgccgatattgttactacgacgactcataagtctttacgtggaccgagaggagctatgatattttatcgaaaaggtactcgttctcacgataaacgtggtaatccaattttatatgaattagaggataaaatcaatttctcagtttttcctggacatcaaggcggcccccataatcatacaattactgcgttagctgtcgcccttggacaagcaaaaactcctgaattctatcaataccaaaaggacgttctaagtaacgccaaggcaatggccaatgcatttattactcgtggctataagttagtttcaggtggcacggatactcacttggttcttgttgatttgaccgacaaaggtgtagatggtgcccgtgtcgaacgtattttagagcttgtaaatatttctgccaacaagaatactgtgcccggagataagtctgctttaattccacgtggattacgtctgggaactccagcttgcactactcgcggttttgatgagaaggattttgagagagtggtagagctaattgatgaagttgtatctttgaccaagaaaataaatgaagctgctttgaaggaaggaaaatcgaagtttagagacttcaaagcatatgtgggtgatggttctaaattctctgaaatcgccaaactgaagaaagaagttataacttgggctggaaaatttgatttccccgtttaa

SEQ ID NO: 9478 - protein, 472 aa, Schizosaccharomyces pombe
MKCSNKVLTIIKLLKAPLAECDPTVYKILESEKSRQKESIALIASENFTSRAVMDALGSIMQNKYSEGYPGARYYGGNEFIDQAERLCQTRALEAFHLDGEKWGVNVQPHSGSPANLQAYQAVMKPHDRLMGLDLPHGGHLSHGFSTPQKAISAVSTYFSTMPYNVNKETGIIDYDSLEKAAIQFRPKVIVAGASAYARLVDYKRMRKITEMCNAYLLCDMAHISGLVAAGVIPSPFEYADIVTTTTHKSLRGPRGAMIFYRKGTRSHDKRGNPILYELEDKINFSVFPGHQGGPHNHTITALAVALGQAKTPEFYQYQKDVLSNAKAMANAFITRGYKLVSGGTDTHLVLVDLTDKGVDGARVERILELVNISANKNTVPGDKSALIPRGLRLGTPACTTRGFDEKDFERVVELIDEVVSLTKKINEAALKEGKSKFRDFKAYVGDGSKFSEIAKLKKEVITWAGKFDFPV

SEQ ID NO: 9479 - DNA, 1404 bp, Schizosaccharomyces pombe
  CDS (1)..(1404)
atgtcttccaacgacagtattatgttgactcctcttaaggaacaggatcccactgttgccgaaattatgagacacgaagctgatcgtcaacgttcttctgttgttcttatcgcctctgagaacttcacctctcgtgctgttatggatgctcttggaagtgtcatgagcaacaagtattcagagggttatcctggtgctcgttactatggtggtaacaagtttatcgatcaaattgaaactctttgccaagagcgtgcacttgctgccttcaatcttgatcctgctaaatggggtgtcaacgttcaatgtctttccggttcccccgctaacatgcaagtttatcaagccattatgcctcctcacggtcgtttaatgggtcttgacttgccttcaggtggccatctttctcacggttatcaaactgataccaagaagattagtgctgtttctacttactttgagtctatgccctaccgtgttgatcctaacaccggtttgattgactatgacatgttggagcacgacgctcagttattccgtcccaagatccttgttgctggtacttctgcttattgccgtctcattgactacgctcgtatgcgacaaattgctgacagcgttaacgcatacttggtcgttgacatggctcatatttctggtcttgtctcagctggtgttatcccttccccctttgaatatgctgatgttgttactaccaccactcacaagtctctacgtggacctcgtggtgctatgatcttcttccgtcgtggtcttcgtaagcatgacaagaagggtaaccccatttactatgacttggaggataagatcaacttctccgttttccctggccatcaaggtggtccccacaaccacaccatcactgctttggctgttgcattgaagcaatgccaagagcccgcttacaaggagtatcaagctcaagttgttaaaaatgctaaggtctgcgaagaggaattcaaaaagcgtggttacaaacttgctgctgacggtactgacagtcacatggttttggttgatgtcaagagcaagggtgttgacggtgctcgtgctgagcgcgtgttggaattgatcaacattgttaccaacaagaatactgtaccttctgacaaatctgctttctctccctctggtattcgtgtcggaacccctgccatgactactcgtggattcaaggaacaagactttgttcgtgttgttgactacattgaccgtgctcttacttttgccgccaacttacaaaaggagcttcccaaggacgccaacaagctcaaagacttcaaggctaaacttggtgaaggtgaacaataccccgagcttgttcaacttcaaaaagaagtcgctgagtgggcttctagcttccctcttgctgataagtggtaa

SEQ ID NO: 9480 - protein, 467 aa, Schizosaccharomyces pombe
MSSNDSIMLTPLKEQDPTVAEIMRHEADRQRSSVVLIASENFTSRAVMDALGSVMSNKYSEGYPGARYYGGNKFIDQIETLCQERALAAFNLDPAKWGVNVQCLSGSPANMQVYQAIMPPHGRLMGLDLPSGGHLSHGYQTDTKKISAVSTYFESMPYRVDPNTGLIDYDMLEHDAQLFRPKILVAGTSAYCRLIDYARMRQIADSVNAYLVVDMAHISGLVSAGVIPSPFEYADVVTTTTHKSLRGPRGAMIFFRRGLRKHDKKGNPIYYDLEDKINFSVFPGHQGGPHNHTITALAVALKQCQEPAYKEYQAQVVKNAKVCEEEFKKRGYKLAADGTDSHMVLVDVKSKGVDGARAERVLELINIVTNKNTVPSDKSAFSPSGIRVGTPAMTTRGFKEQDFVRVVDYIDRALTFAANLQKELPKDANKLKDFKAKLGEGEQYPELVQLQKEVAEWASSFPLADKW

SEQ ID NO: 9481 - DNA, 1554 bp, Arabidopsis thaliana
  CDS (1)..(1554)
atggcgatggccatggctcttcgaaggctttcttcttcaattgacaaacccattcgtcctcttattcgatccacttcatgttacatgtcttctttgcccagtgaagctgttgatgagaaggaaagatctcgtgtcacttggccaaaacagcttaacgcacctttagaggaggttgatcctgagattgctgacattattgagcatgagaaagctagacaatggaagggacttgaacttattccatctgagaacttcacatctgtgtcggtgatgcaagctgttgggtctgtcatgactaacaaatacagtgaaggctatcctggtgccagatactatggaggaaatgagtatatagacatggcagaaaccttatgccagaagcgcgctcttgaagctttccggttagatcctgaaaagtggggagtgaatgttcaacctttgtctggatctcctgccaacttccatgtgtacactgcattgttaaagcctcatgaaagaatcatggcacttgatcttcctcatggtggtcatctttctcatggttatcagactgacaccaagaagatatcagctgtgtctatcttctttgaaacaatgccctatagattggacgagagcactggctacatcgactacgatcagatggagaaaagtgctactcttttcaggccaaaattgattgttgctggtgcaagtgcttatgctagattgtatgactatgcccgcatcagaaaggtctgtaacaagcaaaaagctgtaatgctagcagatatggcacacatcagtggtttggttgctgctaatgtaatcccttcaccgttcgactatgctgatgttgtaaccaccacaactcacaagtcacttcgtggaccccgtggagccatgattttcttcagaaagggtgttaaggaaattaacaagcaagggaaagaggttttgtatgattttgaagacaagatcaaccaagctgtcttccctggtcttcaaggtggtccacacaaccacactatcacaggactagctgttgctttgaaacaggcaactacttcagagtacaaagcataccaagaacaagtcctgagtaacagtgcaaagtttgctcagactctaatggagagaggatatgaacttgtttctggtggaactgacaaccatctggttctagtgaatctaaagcccaagggaattgatggatctagagttgagaaagtgttggaagctgttcacattgcatccaacaaaaacactgttcctggagatgtttctgccatggttcctggtggaatcagaatgggtactcctgctctcacttccagaggctttgttgaggaagactttgccaaagtagctgaatacttcgacaaagctgtgacaatagctctcaaagtcaaatctgaagctcaaggaaccaagttgaaggatttcgtgtcagcaatggaatcctcttcaaccatccaatccgagattgcgaaactgcgccatgaagtcgaggaattcgctaagcagttcccaacaattgggtttgagaaagaaaccatgaagtacaagaactaa

SEQ ID NO: 9482 - protein, 517 aa, Arabidopsis thaliana
MAMAMALRRLSSSIDKPIRPLIRSTSCYMSSLPSEAVDEKERSRVTWPKQLNAPLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAANVIPSPFDYADVVTTTTHKSLRGPRGAMIFFRKGVKEINKQGKEVLYDFEDKINQAVFPGLQGGPHNHTITGLAVALKQATTSEYKAYQEQVLSNSAKFAQTLMERGYELVSGGTDNHLVLVNLKPKGIDGSRVEKVLEAVHIASNKNTVPGDVSAMVPGGIRMGTPALTSRGFVEEDFAKVAEYFDKAVTIALKVKSEAQGTKLKDFVSAMESSSTIQSEIAKLRHEVEEFAKQFPTIGFEKETMKYKN

SEQ ID NO: 9483 - DNA, 1494 bp, Ashbya gossypii
  CDS (1)..(1494)
atgtttattcgtcggttgcataccagttcgcgaaggttaacatgcggcgaggctcttcgtgcgtgccagcaaacaggcgctagaagtgctaatggccagctgatgctgtcgcagcatgtacaggaattcgacccggagatgtacgatatattaactaaggaacgctcaagacagaagcgtagtatcactttgattccaagcgagaacttcacatcagtggctgttatgaacttgctcggaagtgaaatgcaaaacaagtactcggaagggtatccgggtcagcggtattatgggggtaaccagtacatcgatatggcagagtccctgtgccaaaagcgcgctctggagctatatgggctagatcccgccaaatggggcgtcaatgtacagtcattgtccggagcaccagcgaacctctatgcttactcagccattatggaggttggcgatcgcatgatgggtctagatcttcctcacggtggccatctgtcccacggttaccagctacaaaatggaaacaaaatttcgtacatctccaagtacttccagaccatggcgtaccgtgtggaccctgccacaggcttggtcgactatgataccctgtctgagacctcgaaactcttcagacctaaggtgattgttgctggtacatcagcatatgcgcgggtcctggattataagcggtttagggagattgccgatgcctgtggcgcgtatctcctctctgatatggcgcatgtttctggtttggttgcagctggtgtgcacccatctcccttcgagtactccgacattgtcaccactaccacacacaaatccctaagaggaccaagaggtgccatgattttctaccggaaaggcattagaaaggtgaccaagaagggaaccgagatcatgtatgacttggacaagcgcatcaacttctcggttttcccagctcaccagggcgggccacataaccataccatttccgcacttgccgtcgcgttgaagcaggctgctactccagagttcaagaactatcaaaccgctgtggtagagaatgccaaagtttttggcgaagaactaagtaagcgtggctttagtcttgtctccggaggaactgatacacatctgctattgatcgacttgtcccccatgggcattgacgggtctaggcttgaaactatactggaacgactaaatattgcggccaacaagaacaccatcccaggcgacaagtccgctctatatccttctggcctgagagtcggtacgcctgcaatgaccacccgtgggtttggcccggccgaatttggccgggttgcagcgtatatcaacgaggctgttaaactggcaattggcttaaagtcacaagagccagtagacgctaaggacgccaagaccaggttggctcacttcaaaagtttttgcgcagaatcggaacaggtaaccaagctggccaacgaggtggcagactgggttgcacagtaccctgtgccaggagaattgtaa

SEQ ID NO: 9484 - protein, 497 aa, Ashbya gossypii
MFIRRLHTSSRRLTCGEALRACQQTGARSANGQLMLSQHVQEFDPEMYDILTKERSRQKRSITLIPSENFTSVAVMNLLGSEMQNKYSEGYPGQRYYGGNQYIDMAESLCQKRALELYGLDPAKWGVNVQSLSGAPANLYAYSAIMEVGDRMMGLDLPHGGHLSHGYQLQNGNKISYISKYFQTMAYRVDPATGLVDYDTLSETSKLFRPKVIVAGTSAYARVLDYKRFREIADACGAYLLSDMAHVSGLVAAGVHPSPFEYSDIVTTTTHKSLRGPRGAMIFYRKGIRKVTKKGTEIMYDLDKRINFSVFPAHQGGPHNHTISALAVALKQAATPEFKNYQTAVVENAKVFGEELSKRGFSLVSGGTDTHLLLIDLSPMGIDGSRLETILERLNIAANKNTIPGDKSALYPSGLRVGTPAMTTRGFGPAEFGRVAAYINEAVKLAIGLKSQEPVDAKDAKTRLAHFKSFCAESEQVTKLANEVADWVAQYPVPGEL

SEQ ID NO: 9485 - DNA, 1458 bp, Candida glabrata
  CDS (1)..(1458)
atgatgttgctacgtgccgctagagtgcccgtgttgggcagacgctttctttcccagcaacaattgatctcgaagcatgtgcaagaggtggaccccgagatgttccgcatcctcagcgatgagaggagcagacagaagcactctgtcacgctgatcccttctgagaacttcacgtcgaaggccgtcatggacctgctgggctctgagatgcagaacaagtactccgagggctaccccggcgagaggtactacggtggtaaccagttcatcgataaagctgagtcgctgtgccaggcccgtgccctggacctgtatggccttgaccctgagaagtggggggtcaatgtgcaggccctgagcggtgcccctgccaacctgtacgcttactccgcggtcatggaggtcggcgaccgtctgatgggtctcgacttgccccacggtgggcacttgtctcacggataccaattgccttccggaactaagatctcctacatctcaaagtacttcaacaccatgccataccacgtcaacaccgagaccggtatcattgactatgacactttggccatgacctctaagctgttcagaccaaaggtcatcgtcgcaggtacgtccgcatactcgaggaagctggactacgctaggttcagaaagatcgccgacggctgcggtgcctacttgctgagcgacatggcccacatctccggtctggtggccgccaatgtcatagactccccattcgagcactccgacatagtcaccaccaccacccacaaatccctaagaggcccccgtggtgctatgatattctacagaaagggtatcaagaaagtcaacaagaagactggcaaggagaccccattcactttcgacaagaccatcaacttctcagtgttcccaggccaccaaggtggcccacacaaccacaccatttctgcattggctgtggcattaaagcaagcaaagacccccgagttcgtcgagtaccagaagcaagtggtctccaacgcaaaggccttcggtgacgagctattgaagcgtggcttcgagctagtgtccggcggtaccgataatcacttgcttttgctaaacctgtccaacatgggcatcgacggtgctcgtttggaggctatcctggagaagattaacatcgccgcaaacaagaacaccatcccaggtgacaagtccgcgctgttcccatcaggtttgagagtaggtaccccagccatgactaccagaggcttccaagaacaagacttcaagaaggtcgctgagtacatcgacaacgccgttaaactatccattgctctgaagtcccaggagtccgcagacgctaaggacgtcagatcaaagctaaacagcttcaagcagttgtgtgaccagtctgaaccagtgcaaaaattagccgaagaagtgtcctcatgggtaggcacattcccagttcctggcgaattgtag

SEQ ID NO: 9486 - protein, 485 aa, Candida glabrata
MMLLRAARVPVLGRRFLSQQQLISKHVQEVDPEMFRILSDERSRQKHSVTLIPSENFTSKAVMDLLGSEMQNKYSEGYPGERYYGGNQFIDKAESLCQARALDLYGLDPEKWGVNVQALSGAPANLYAYSAVMEVGDRLMGLDLPHGGHLSHGYQLPSGTKISYISKYFNTMPYHVNTETGIIDYDTLAMTSKLFRPKVIVAGTSAYSRKLDYARFRKIADGCGAYLLSDMAHISGLVAANVIDSPFEHSDIVTTTTHKSLRGPRGAMIFYRKGIKKVNKKTGKETPFTFDKTINFSVFPGHQGGPHNHTISALAVALKQAKTPEFVEYQKQVVSNAKAFGDELLKRGFELVSGGTDNHLLLLNLSNMGIDGARLEAILEKINIAANKNTIPGDKSALFPSGLRVGTPAMTTRGFQEQDFKKVAEYIDNAVKLSIALKSQESADAKDVRSKLNSFKQLCDQSEPVQKLAEEVSSWVGTFPVPGEL

SEQ ID NO: 9487 - DNA, 1746 bp, Flaveria pringlei
  CDS (34)..(1587)
tgagaattgaaacaacttaacagttggttgacaatggcgatggcgttagctcttcgtaggctctcatcttctgcagacaaaccgttgcaacgcctcttcaatggcggtcatctctactctatgtcgtcgttgcctagtgaagctgtgtacgagaaggaacggcctggtgtcacttggccgaagcagttgaatgctccgcttgaggttgtggatcctgagatcgcggatattattgagcttgaaaaggctcggcaatggaagggtcttgaactcataccatcagagaactttacctctctatcagtgatgcaagcagttggatccgtgatgaccaacaaatacagtgaagggtatccaggagctagatactatggtggaaatgagtatattgacatggcggaaacgttgtgtcaaaagcgtgcattggaagcctttcggttggatcctgcaaaatggggagtgaatgtgcagcctctttcaggatcaccagctaatttccatgtctacactgcattattaaaggctcatgacagaatcatggcacttgatcttcctcatggtgggcatctgtcacatggttatcagaccgacacaaagaaaatatctgcggtatctatatttttcgagactatgccttacagattgaatgaaagcactggctatatcgattatgaccagttggagaaaagtgcaacactcttcaggccaaaattgattgttgctggtgcaagtgcttatgctcgattatatgactatgctcgaatccgcaaggtttgtgacaagcaaaaagctattatgttggcagatatggcacacattagtgggttggttgcagctggtgtcatcccatccccttttgactatgcagatgttgtgaccaccacaacccacaagtcactccgaggaccacgtggtgccatgattttctttaggaaaggactgaaagaagtcaacaaacaaggcaaagaggtcttctatgattatgaagacaaaatcaaccaggccgtctttcctggacttcaaggaggtccacacaatcacacaatcactggattggcagttgcattgaaacaggcaacaacagcagaatacaaggcgtaccaagaacaagttatgagtaatagtgccaagtttgcagagactctagttaagagtggatatgaacttgtttctggtggaacagagaaccacttagttttggttaatttgaaaaataagggaattgatggttcaaaggttgaaaaggtgttggaggctgttcacattgcagccaataaaaacactgttcctggtgatgtctctgccatggttcctggtggcatcagaatgggaacccctgctctcacctctaggggatttgttgaagaggactttgctaaagttgcctacttctttgaccttgctgtaaaattggctgtgaagatcaagggtgaagccaaagggacaaagttgaaggactttgtgactgcaatggagtccagtgccatccaatcagaaatctcaaagctacgccatgacgtggaggaatacgcgaaacaattcccgacaatcggatttgagaaagaaaccatgaaatacaaaaactaaggaatcatacaagccgggtgccatgaagatggaagtggatgcttccatttcaaaccagtatctattctagaatgtgggttataaggctttttctgtatgatgaatcttctgtatatgtaaatcaatgcagcatttcaataaacttttcatttaatcttg

SEQ ID NO: 9488 - protein, 517 aa, Flaveria pringlei
MAMALALRRLSSSADKPLQRLFNGGHLYSMSSLPSEAVYEKERPGVTWPKQLNAPLEVVDPEIADIIELEKARQWKGLELIPSENFTSLSVMQAVGSVMTNKYSEGYPGARYYGGNEYIDMAETLCQKRALEAFRLDPAKWGVNVQPLSGSPANFHVYTALLKAHDRIMALDLPHGGHLSHGYQTDTKKISAVSIFFETMPYRLNESTGYIDYDQLEKSATLFRPKLIVAGASAYARLYDYARIRKVCDKQKAIMLADMAHISGLVAAGVIPSPFDYADVVTTTTHKSLRGPRGAMIFFRKGLKEVNKQGKEVFYDYEDKINQAVFPGLQGGPHNHTITGLAVALKQATTAEYKAYQEQVMSNSAKFAETLVKSGYELVSGGTENHLVLVNLKNKGIDGSKVEKVLEAVHIAANKNTVPGDVSAMVPGGIRMGTPALTSRGFVEEDFAKVAYFFDLAVKLAVKIKGEAKGTKLKDFVTAMESSAIQSEISKLRHDVEEYAKQFPTIGFEKETMKYKN

SEQ ID NO: 9489 - DNA, 1497 bp, Kluyveromyces lactis
  CDS (1)..(1497)
atgctttcaagatctgctcgttgttctagggctgttctcttcagtgccaaacgctctctagcttcccaggctaatactggtgctaatgccagtgctaaccaggttatggtatcaaagcatgtgcaagacattgacccagaaatgtatgacatcttgacgaaagaacgcaaaagacaaaaacattccatcactttgattccaagtgaaaacttcacttctaagtctgttatggatcttttgggttccgaaatgcaaaacaagtattctgagggctatccaggtgagcgttactatggtggtaatcaatttattgatatggcagaatctctgtgccaaaagcgtgccttggaattgtacaatttggatcctcaactatggggagttaacgttcagccattgtccggtgctccagctaacttatacgcttattctgcagttatggaaacaaacgaccgtttgatgggtttggatttacctcatggtggtcatttgtctcacggctaccaattgccaagtggtactaagatttcatatatctccaagtattttcaaacaatgccataccatgtcgactcacaaactggcataatcgattatgatttcttgtccaagacgtctaaattatttagacctaaggttatcgttgcaggtgcttctgcatactccagagtcttggattacaagcgtttcaaggagattgctgatgcatgcggggcctacttgatgtctgatatggcccatatctcgggacttgtcgccgctggtgttactcgttctccattcgaatattctgatattgttacaactactacccacaaatctttacgtgggccaagaggtgctatgatcttttacagaaagggtgttagaaaggttacaaagaaaggtaaggaagtcctatacgacttggataagagaatcaacttttccgtgttcccaggtcatcaaggtggtccacataatcatactatttctgccttagccgttgctttgaaacaagctgccactccagaattcaaagagtaccaagccgctgttgttgaaaatgctcgtattttcggcgaagaattagtcaagaagggcttcgaattagtttctggcggtaccgatactcatttgatcttgatcaatttatctaacttgggcattgatggtgccaggttggaaaccctgttggaaaacatcaacattgctgctaataaaaatactattccaggtgataaatcggctttgttcccgtcaggtttgagagttggtacaccagctatgaccactagaggctttgggccacaagaatttgcccaagtcgctgcttatattgacagagctgttaagttagccattggcatcaaatctcaagaatctccagatgctaaagacgctagatcgaagttagccagcttcaaagaactatgcaaggaatcagaccaagtcaagcaactagctgacgaagtctatcaatgggttggtgagttcccagttccaggtgaattataa

SEQ ID NO: 9490 - protein, 498 aa, Kluyveromyces lactis
MLSRSARCSRAVLFSAKRSLASQANTGANASANQVMVSKHVQDIDPEMYDILTKERKRQKHSITLIPSENFTSKSVMDLLGSEMQNKYSEGYPGERYYGGNQFIDMAESLCQKRALELYNLDPQLWGVNVQPLSGAPANLYAYSAVMETNDRLMGLDLPHGGHLSHGYQLPSGTKISYISKYFQTMPYHVDSQTGIIDYDFLSKTSKLFRPKVIVAGASAYSRVLDYKRFKEIADACGAYLMSDMAHISGLVAAGVTRSPFEYSDIVTTTTHKSLRGPRGAMIFYRKGVRKVTKKGKEVLYDLDKRINFSVFPGHQGGPHNHTISALAVALKQAATPEFKEYQAAVVENARIFGEELVKKGFELVSGGTDTHLILINLSNLGIDGARLETLLENINIAANKNTIPGDKSALFPSGLRVGTPAMTTRGFGPQEFAQVAAYIDRAVKLAIGIKSQESPDAKDARSKLASFKELCKESDQVKQLADEVYQWVGEFPVPGEL

SEQ ID NO: 9491 - DNA, 1803 bp, Pisum sativum
  CDS (22)..(1578)
atggacctttctatctctaacatggctatggcaatggcgcttcgtaagctttcatcttccgtcaacaaatcttcacgtcctctcttttctgcttcatctctttactacaagtcttctttgcctgatgaagctgtttacgacaaagagaatccacgtgttacgtggccaaagcaattgaattctccacttgaggttattgatcctgaaattgctgatataattgagcttgaaaaagctagacagtggaaggggctggaactgataccatcagagaattttacttctttatctgttatgcaagctgttggctctgtcatgacaaacaaatacagtgaaggttatcctggggcaagatattatggaggaaatgagtatattgacatggcagaaacactatgccagaagcgtgccttggaagcatttcggttggatcctgctaaatggggagtgaatgtgcagcctctgtctggttcgccttcaaactttcaagtttacactgcattgttgaaacctcatgatagaatcatggcacttgatctccctcatggagggcatctttctcatggataccagaccgacaccaaaaagatatctgcagtctctatattttttgagacaatgccatataggttggatgaaagcacaggatacattgactatgaccagctagagaaatcggctacactcttcaggccaaagttaatagttgccggtgctagtgcctatgcaaggctgtatgattatgcacgcatacgcaaggtttgcgataaacagaaagctgtgttgttagcagatatggcacatatcagtggattggttgcagctggtgttatcccttcaccttttgattatgcagatgtagtgacaaccacaactcacaagtcacttcgcggcccacgtggagctatgatatttttcaggaagggattaaaagaagtcaacaaacaaggaaaagaggtgttctatgactatgaggacaaaatcaatcaagctgtcttccccggactgcaaggtggtcctcacaaccataccattacaggtttagctgttgcattgaagcaggctacaactccagagtatagagcatatcaagagcaggttctcagcaatagctcaaagtttgcaaaggctctgagtgagaaaggctatgatcttgtttccggtgggactgagaatcatttagttttggtgaatctgaagaacaagggtattgatgggtccagagttgagaaagtgttggaattagtacatattgctgctaataaaaacacagttccaggagatgtgtctgctatggttcctggtggcatcaggatgggaactcctgcgcttacttcaaggggatttgttgaggaggatttcgttaaggtagcagagtattttgatgcagctgtgagtttggccttgaaggttaaggcagaaagcaaaggaacaaaattaaaggacttcgtggaagcattgcagacatcctcttacgtgcaatcagagatttccaagcttaagcatgatgttgaggagtttgcaaaacaatttccaaccattggttttgaaaaagcaaccatgaagtacaacaaataagtaaaagaaagtttccatcagtggctgttaacactatgatggtcaagcccttcaaggtgatcagttttatgcttaatggaagaggagattatatatagcagatgaaaatcattaggatggaacttttttatgtatggaacttgcaaaacttgatcagatatcttcttgcaatgtatagatacatatatttataatttattaaatgtgaattgcgacttgcgagct

SEQ ID NO: 9492 - protein, 518 aa, Pisum sativum
MAMAMALRKLSSSVNKSSRPLFSASSLYYKSSLPDEAVYDKENPRVTWPKQLNSPLEVIDPEIADIIELEKARQWKGLELIPSENFTSLSVMQAVGSVMTNKYSEGYPGARYYGGNEYIDMAETLCQKRALEAFRLDPAKWGVNVQPLSGSPSNFQVYTALLKPHDRIMALDLPHGGHLSHGYQTDTKKISAVSIFFETMPYRLDESTGYIDYDQLEKSATLFRPKLIVAGASAYARLYDYARIRKVCDKQKAVLLADMAHISGLVAAGVIPSPFDYADVVTTTTHKSLRGPRGAMIFFRKGLKEVNKQGKEVFYDYEDKINQAVFPGLQGGPHNHTITGLAVALKQATTPEYRAYQEQVLSNSSKFAKALSEKGYDLVSGGTENHLVLVNLKNKGIDGSRVEKVLELVHIAANKNTVPGDVSAMVPGGIRMGTPALTSRGFVEEDFVKVAEYFDAAVSLALKVKAESKGTKLKDFVEALQTSSYVQSEISKLKHDVEEFAKQFPTIGFEKATMKYNK

SEQ ID NO: 9493 - DNA, 1745 bp, Solanum tuberosum
  CDS (6)..(1562)
ctgcaatggctatggcaatagctcttcggaggctttccgctacagttgacaaaccggttaagagtctctacaatggtggctctctctattacatgtcatcactgcctaatgaagctgtatacgacaaagaaaaatctggggtagcttggccaaagcaactgaatgctccactagaggttgttgatcctgagattgctgacattattgagcatgagaaagcacgccaatggaaggggctcgaactcattccatcagaaaatttcacttctgtttcggtgatgcaagcagttggatcagtcatgactaacaagtacagtgaaggatatcctggtgccagatactatgggggaaatgagtacatagacatggcagaaaccttatgccagaaacgtgctttggaagcattcaggttggatcctgcaaaatggggagtgaatgtgcagcctctatcaggatcacccgctaattttcaagtttacactgcattattaaaacctcatgagagaatcatggctcttgatcttcctcatggtggacatctttctcatggatatcagactgatacaaagaagatatctgcagtctctatattctttgagacaatgccatacagactcgatgagagcactggctatattgactatgaccagctcgagaaaagtgccacactctttcggccaaaattgattgttgctggtgctagtgcctacgcacgtctttatgactatgacagaatccgaaaggtttgcaacaaacagaaagctattttgttagcagatatggcacacattagtggattggttgcagctggagttatcccatcaccatttgattatgctgatgttgtcactaccacaacccacaagtcccttcgtggccctcgtggtgctatgattttttacaggaagggtgttaaagaggttaacaagcaaggcaaggaggttttctacgactatgaagacaaaattaaccaggcagtctttcctggacttcaaggtggtccccacaatcacaccatcactggcttggcagttgccttgaaacaggccactactccagaatacagagcttaccaagagcaagttctcagcaactcctcaaaatttgcccaggctttaggggagaagggctatgaacttgtctctggaggaaccgataatcacttggttttggtgaacatgaaaaacaagggtattgatggttccagggttgaaaaagtcttggaagctgtacatattgcagccaacaagaacaccgttcctggagatgtatctgccatggtccctggtggcatcagaatgggaactcctgcactcacttctcggggatttcttgaggaagattttgttaaagttgctgatttctttgatgctgctgtgaagatagcagtgaaagtaaaggctgaaactcaagggacaaagttgaaagactttgtagcaacactagaatccagtgctccaatcaagtctgaaattgcaaaactccgtcatgatgtggaggagtatgctaagcagttccctacaattgggtttgagaaagaaaccatgaagtacaaaaactaagaggtacatacacaaggcacctaatatccagattcataaaggtgaaaggggaagaaaatccaaccatgacttgctttcaagtacatgttctcatgcttataatatgtaaagaaatctagcagatgttggttcccatgtatgcagtttgtatatttaacacttacagtccaactgaggtccttt

SEQ ID NO: 9494 - protein, 518 aa, Solanum tuberosum
MAMAIALRRLSATVDKPVKSLYNGGSLYYMSSLPNEAVYDKEKSGVAWPKQLNAPLEVVDPEIADIIEHEKARQWKGLELIPSENFTSVSVMQAVGSVMTNKYSEGYPGARYYGGNEYIDMAETLCQKRALEAFRLDPAKWGVNVQPLSGSPANFQVYTALLKPHERIMALDLPHGGHLSHGYQTDTKKISAVSIFFETMPYRLDESTGYIDYDQLEKSATLFRPKLIVAGASAYARLYDYDRIRKVCNKQKAILLADMAHISGLVAAGVIPSPFDYADVVTTTTHKSLRGPRGAMIFYRKGVKEVNKQGKEVFYDYEDKINQAVFPGLQGGPHNHTITGLAVALKQATTPEYRAYQEQVLSNSSKFAQALGEKGYELVSGGTDNHLVLVNMKNKGIDGSRVEKVLEAVHIAANKNTVPGDVSAMVPGGIRMGTPALTSRGFLEEDFVKVADFFDAAVKIAVKVKAETQGTKLKDFVATLESSAPIKSEIAKLRHDVEEYAKQFPTIGFEKETMKYKN

SEQ ID NO: 9495 - DNA, 1698 bp, Saccharomyces cerevisiae
  CDS (226)..(1698)
atgattctctccgttatctgctggttcttagtccactgtctgttctgtcccccttctgtccaagagatagaatataaaaaagactcattatttttttttaggtacttcgcttattggtggtcaatgagaaaaaaaatactaaaagccatcgcctcttggagaagagcaaactatcaaaaatcatcaagccgacatttccacatcgagtctcatagtctttcaatcatgtttcccagagcttctgcattggccaaatgtatggcaactgttcatcgtcgtgggctactcaccagtggtgcacaatcgctagtctccaaaccagtctcggagggagatccagagatgtttgacatcttgcaacaagaacgtcacagacaaaaacactctatcacccttatcccatcagaaaacttcacctcgaaggccgttatggatttgctaggttctgagctccaaaacaagtattctgaaggttatccaggtgaaagatactacggaggtaacgaaatcatcgataagtccgaatccttgtgtcaagcaagagctctggaactgtacggattagaccctgccaagtggggagttaatgttcaaccattaagcggggcacctgccaatttgtatgtttactccgctatcatgaacgttggtgaaagattaatgggattggatttgccagatggtggtcacttgtctcacgggtaccaacttaagtcaggaacgccaatttctttcatttccaaatacttccaaagtatgccataccatgtcgaccacactacggggctaatcgattacgataacttgcaagtattggccaaggcattcagaccaaaggtgatcgtggccggtacttccgcgtactcgagattaatagactacgctagattcaaggaaatttcccaaggatgcggcgcatatttgatgagtgatatggcacacatatccggtttggtggcagccaatgttgtcccatctccatttgaacattccgatatagttaccacaaccactcacaagtccttgagaggcccaagaggtgctatgattttcttcagaaagggtatcaagtctgtcaccaaaaagggcaaggaaatcccatatgagttagaaaagaaaatcaacttctcagttttcccaggacatcaaggtggtcctcacaaccatactatcggtgcaatggcagtggcattaaagcaagcgatgtctccagaattcaaagaataccaacaaaaaattgtcgacaacagcaaatggtttgctcaggaactaaccaagatgggttataagttggtttccggcggtaccgataaccacttgattgttattgacttatccggtactcaggtagacggtgctcgtgtcgagacaattttaagtgccttgaacattgctgctaacaagaacaccatcccaggtgataagagtgctcttttcccctctggtctaagaatcggtactccagcaatgaccacgagaggatttggccgtgaagagttttctcaagtcgcaaagtacattgattctgccgttaagctcgctgaaaatttgaaaactttggaaccaacaacgaaactagatgcaagatcaagactcaatgagttcaagaagttgtgtaatgaatctagtgaagtcgctgctttgtctggcgagatttccaagtgggtcggtcaataccctgtcccaggtgatatctaa

SEQ ID NO: 9496 - protein, 490 aa, Saccharomyces cerevisiae
MFPRASALAKCMATVHRRGLLTSGAQSLVSKPVSEGDPEMFDILQQERHRQKHSITLIPSENFTSKAVMDLLGSELQNKYSEGYPGERYYGGNEIIDKSESLCQARALELYGLDPAKWGVNVQPLSGAPANLYVYSAIMNVGERLMGLDLPDGGHLSHGYQLKSGTPISFISKYFQSMPYHVDHTTGLIDYDNLQVLAKAFRPKVIVAGTSAYSRLIDYARFKEISQGCGAYLMSDMAHISGLVAANVVPSPFEHSDIVTTTTHKSLRGPRGAMIFFRKGIKSVTKKGKEIPYELEKKINFSVFPGHQGGPHNHTIGAMAVALKQAMSPEFKEYQQKIVDNSKWFAQELTKMGYKLVSGGTDNHLIVIDLSGTQVDGARVETILSALNIAANKNTIPGDKSALFPSGLRIGTPAMTTRGFGREEFSQVAKYIDSAVKLAENLKTLEPTTKLDARSRLNEFKKLCNESSEVAALSGEISKWVGQYPVPGDI

SEQ ID NO: 9497 - DNA, 1779 bp, Flaveria pringlei
  CDS (25)..(1578)
cctagagcgagagaaaaactaacaatggcgatggcatcggctcttcgtaggctctcatcttcttcaaacaaaccgttgcagcgtctgttcaatggcggtcatctatattcaatgtcatcgttgcctagtgaagctgtgtatgagaaagaaaggcctggcgtcacttggccgaaacagttgaacgctccacttgaggttggggatcctgagattgctgatattattgagcttgaaaaggctcggcaatggaagggtcttgaactcatactctcagagaactttacctccctgtcagtgatgcaagcagttggatctgtgatgactaacaaatacagtgaagggtatccgggtgctagatactatggtggaaatgagtacattgacatggcggaaaccttgtgtcagaagcgtgccttggaagcctttcggttagatgctgcaaaatggggagtgaatgtgcaacctctttcagggtcaccagcaaatttccatgtctatactgcattattaaaggctcatgacagaatcatggcacttgatcttcctcatggtggccatctgtcacatggttatcagactgatacaaagaagatatctgcagtatccatatttttcgagactatgccttacagattgaacgagagcaccggctatattgattatgaccagttggagaaaagtgccacacttttcaggccaaaactgatagttgctggcgcaagtgcttatgctagattatatgactatgcacgtattcgtaaggtttgtgacaagcaaaaagccattttgttagcagatatggcacacattagtgggttggtagcagctggtgtcatcccatccccatttgactatgcagatgttgtgaccacaaccacccacaagtcacttcggggcccacgaggcgccatgattttcttcaggaaaggggtgaaagaagtcaacaaacaaggcaaagaggttctctatgattatgaagacaaaatcaaccaggctgtctttcctgggcttcaaggtggcccacacaatcacacaatcactggattggcagttgcattgaaacaggcaacaacagcagaatataaggcatatcaagagcaagtcatgagtaattgtgccaaatttgcagagactctagttaagagcggatatgaacttgtttccgggggaacagagaaccacttagtgttggtcaatttgaagaataagggaattgatggttcaagggttgaaaaggtgttggaagctgttcacattgcagccaataaaaacactgttcctggtgatgtgtctgccatggttcctggtggcatcagaatgggaacccctgctctcacttctaggggatttgttgaagaggattttgctaaagttgcctacctctttgaccttgctgtaaaattggctgtgaagatcaagggtgaagcccaagggacaaagttgaaggactttgtggctgcaatgcagtccagtgccttccaatcagaaatttcaaagctacgccacgacgtggaggagtatgccaaacaattcccaacaatcgggtttgagaaagaaaccatgaaatacaaaaactgaggaatcatacaagccaggtatcattaaggtggaggtgaggtgaagacaatgcttccatttggaagtggggagccatgtatctagaatgaatgtgattataaggcttttgtgtatgaaatcaagttgtaaccatctgtatatgtaaatcaactcgactgatgttttctataaacaaataaaactttctataatttttaaaat

SEQ ID NO: 9498 - protein, 517 aa, Flaveria pringlei
MAMASALRRLSSSSNKPLQRLFNGGHLYSMSSLPSEAVYEKERPGVTWPKQLNAPLEVGDPEIADIIELEKARQWKGLELILSENFTSLSVMQAVGSVMTNKYSEGYPGARYYGGNEYIDMAETLCQKRALEAFRLDAAKWGVNVQPLSGSPANFHVYTALLKAHDRIMALDLPHGGHLSHGYQTDTKKISAVSIFFETMPYRLNESTGYIDYDQLEKSATLFRPKLIVAGASAYARLYDYARIRKVCDKQKAILLADMAHISGLVAAGVIPSPFDYADVVTTTTHKSLRGPRGAMIFFRKGVKEVNKQGKEVLYDYEDKINQAVFPGLQGGPHNHTITGLAVALKQATTAEYKAYQEQVMSNCAKFAETLVKSGYELVSGGTENHLVLVNLKNKGIDGSRVEKVLEAVHIAANKNTVPGDVSAMVPGGIRMGTPALTSRGFVEEDFAKVAYLFDLAVKLAVKIKGEAQGTKLKDFVAAMQSSAFQSEISKLRHDVEEYAKQFPTIGFEKETMKYKN

SEQ ID NO: 9499 - DNA, 1587 bp, Oryza sativa
  CDS (1)..(1587)
atggcgatggcttcgcaccacctcgcccagccgcccacgcgcgcggctctctcctcgcgccccacctacccgctctccagccatcaccactcctcccgtctccagctcccgctcgtcagcggggcgcggcgcagcaggctgtcccccgcggtggcgacgtccccggtcgccgccccagcgatggacgccgtggccgactgggggctgaccactctggaggaggctgacccggaggtgtacgacctcgtcgagcgcgagaagcggcggcagcgcgcgggcgtcgagctcatcgcgtcggagaacttcacctcgctcgccgtcatggaggcgctgggctcgccgctcaccaacaagtactccgagggcatgccggggtcccgctactacggaggcaacgaggtcatcgacgaggtggaggagctctgccgcgcccgcgcgctcgccgccttccacctcgaccccgaggcctggggcgtcaacgtgcagccctactccggctcgccggcgaacttcgccgcctacaccgggctgctccaaccccacgagcggatcatggggctcgatttgccgtccggcggccacctcacgcacggctactacaccgccggcggcaaaaagatctccgccacgtccatctacttcgagagcctgccgtacaaggtgagctccgagacaggatacgtcgattatgataagctggaggagaaggccatggattttcggcccaagctcatcatctgcggcgggagcgcgtacccgcgggattgggattacgccaggttcagggccatcgcggataagtgcggcgccatgttgctctgcgacatggctcacatcagtggcctagttgccgcgcaggaggctgcaaatccttttcaatattctgatgtggttaccaccaccacccacaagagtctccgagggccaagatctggtatgatcttctacaggaagggcctgaagcctcccaagaaaggccagcctgagggcgctctgtatgactacgaggacaggatcaacttcgcagtgtttccgtcgctccaagggggccctcacaaccaccaaattgctgcgctagcggttggtttgaagcagactatgtcacctggattcaagtcttatattaagcaggtcaaggccaatgctgttgcccttggtaaccatttgatgagtaagggctacaaattggttactgacggaacagagaaccatcttgttctctgggatctgcgccctcttggcttgactgttgagaaggtctgtgatttgtgcagcattacactgaacaaaaatgctgtctttggggatagcagtgcaatgtcacctggtggtgtccgcattggtacacctgccatgacatcaaggggtttggtagaggaggactttgtacagatcgccgagttccttcaccaggcagtgaccatctgcttggatgttcagaaggagcgtggcaagcttctcaagtacttcaacgagggcctggagaacaacaaggacattgaggacctcagggcggaggtggagaagtttgccacttcattcgagatgcctggcttcagggtatccgacatgaagtacaaggattag

SEQ ID NO: 9500 - protein, 528 aa, Oryza sativa
MAMASHHLAQPPTRAALSSRPTYPLSSHHHSSRLQLPLVSGARRSRLSPAVATSPVAAPAMDAVADWGLTTLEEADPEVYDLVEREKRRQRAGVELIASENFTSLAVMEALGSPLTNKYSEGMPGSRYYGGNEVIDEVEELCRARALAAFHLDPEAWGVNVQPYSGSPANFAAYTGLLQPHERIMGLDLPSGGHLTHGYYTAGGKKISATSIYFESLPYKVSSETGYVDYDKLEEKAMDFRPKLIICGGSAYPRDWDYARFRAIADKCGAMLLCDMAHISGLVAAQEAANPFQYSDVVTTTTHKSLRGPRSGMIFYRKGLKPPKKGQPEGALYDYEDRINFAVFPSLQGGPHNHQIAALAVGLKQTMSPGFKSYIKQVKANAVALGNHLMSKGYKLVTDGTENHLVLWDLRPLGLTVEKVCDLCSITLNKNAVFGDSSAMSPGGVRIGTPAMTSRGLVEEDFVQIAEFLHQAVTICLDVQKERGKLLKYFNEGLENNKDIEDLRAEVEKFATSFEMPGFRVSDMKYKD

SEQ ID NO: 9501 - DNA, 1554 bp, Brassica napus
  CDS (1)..(1554)
atggcgatggccatggctcttcggcgactttcttcttcagttgacaaacctattcgtcctcttatcagatcaactacatgctacatgtcatctctgcccagtgaagctgttgatgacaaggagagatctcgtgtcacttggccaaaaaagcttaacgcatctttggaggaggttgatcctgagattgctgacattattgagcatgagaaagctagacaatggaagggacttgaactcattccatctgagaatttcacatctgtctcggtgatgcaagctgttggctctgtgatgactaacaagtacagtgaagggcaccctggtgctagatactatggaggaaatgagtacatagacatggcagagactttatgccaaaagcgcgctcttgaggctttcagattagatcctgaaaagtggggagtgaatgtgcaacccttgtctggatctcctgccaacttccatgtctacactgcattgctcaaacctcatgagagaatcatggcacttgatcttcctcatggtggtcatctttctcatggttatcagactgacaccaagaagatatctgctgtgtctatcttctttgagacaatgccttatcgcttggacgagagcactggctacattgactatgatcagatggagaaaagtgctactcttttcaggccaaaactgattgttgctggtgcgagtgcttatgctcgattgtatgactatgcccgcatccgaaaggtgtgtaacaagcaaaaagctgtgatgctagcagatatggcacacatcagtggtttggttgctgctggtgtaatcccttcaccgttcgactatgcagatgttgtgaccaccacaactcacaagtcacttcgtggaccccgtggagccgtgattttctacagaaagggtgttaaagaaattaacaaacaagggaaagaggttttgtatgattttgaagacaagataaatcaagccgtcttccctggtcttcaaggtggtccacataaccacactattacaggactagctgttgctttaaaacaggcaactacttcagagtacaaagcataccaagagcaagtcctgagcaactctgcaaagttcgctcagactctgatggagaaaggttatgaacttgtttctggtggaaccgacaaccatctggttctagtgaacctgaagcccaagggaattgatggatctagagttgagaaagtgttggaagctgttcacattgcatcaaacaaaaacactgttcctggagatgtttctgccatggttcctggtggaatcagaatgggtacacctgctctcacttccagaggctttgttgaggaagactttgctaaagtagctgaatactttgacaaagctgtaacgttggctctcaaagtcaaatctgaagctcaagggaccaagctgaaagactttgtgtcagcaatggaagcttcttcaaccattcaatcagagattgctaagctgcgccatgaagttgaggaatttgctaaacagtttccaacaattgggtttgagaaagaaaccatgaagtacaagaactaa

SEQ ID NO: 9502 - protein, 517 aa, Brassica napus
MAMAMALRRLSSSVDKPIRPLIRSTTCYMSSLPSEAVDDKERSRVTWPKKLNASLEEVDPEIADIIEHEKARQWKGLELIPSENFTSVSVMQAVGSVMTNKYSEGHPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAAGVIPSPFDYADVVTTTTHKSLRGPRGAVIFYRKGVKEINKQGKEVLYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVTLALKVKSEAQGTKLKDFVSAMEASSTIQSEIAKLRHEVEEFAKQFPTIGFEKETMKYKN

SEQ ID NO: 9503 - DNA, 1416 bp, Linum usitatissimum
  CDS (1)..(1416)
atggatccagtcaaggtatggggaaacactcctttgcaaaccgtggaccctgagatccacgacctcatcgagaaggagaagcgccgtcaatgccgcgggatcgagctcatcgcctccgagaacttcacctccttcgccgtcatcgaagccctcggcagcgccctcaccaacaagtactccgagggcatgcccggaaatcgctactacggcggcaacgagtacatcgatcagatcgagaacctctgcgtatcccgcgccttgaccgctttccacttggacgacaccaagtggggcgtcaatgtccagccttactccggctcccctgccaatttcgccgcctacaccgccattctcaagccccatgatcgtatcatgggattggatctcccatctggtggtcatctgactcatggatactacacctccagcgggaagaagatctccgcaacttccatttacttcgagagcttgccttacaaggtgaattccagcactggctacatcgactacgataagctggaagagaaggctttggatttcaggccacggttgatcatctgtggtggcagtgcttaccctagggactgggattacgctagatttagggctattgctgataaatgcggtgctcttttgctctgcgatatggctcacattagcggcctagttgctgctcaggaagctgccaacccctttgagttctgtgacattgtcacaaccaccacccacaagagtttgaggggtcccagagctggtatgatcttctaccgcaagggacctaagccagccaacaagaagggtcagcctcaaggcaactatgaattcgaggacaacatcaacttctctgtcttccctgccctccagggaggcccccataatcaccagatcggtgcccttgctgttgcattgaagcaggccgcgacccctgcattcaaggcctatgccaagcaagtgaaggccaatgctgttgctgttgggaactatttgatgagcaaaggctacaccttggtcactggaggaactgagaaccaccttgttctgtgggatctgagacctcttgggttgactggtaacaaggtcgagaaggtttgcgatctctgtaacatcactgtgaacaagaatgcagtgttcggagacagcagtgcattgtccccaggaggcgtgagagttggggcacctgccatgacttcaagagggttgttggagaaagactttgagcaaatcggagagttcctccaccgtgctgtggccttaacactgagcatccagaaggaatatgggaagttactgaaggacttcaacaagggcctggagaacaacaaagagatcgaagcattgaaagctgatgttgagaaatttgcaggttcatttgatatgcctggtttcctcatgtctgagatgaagtaccaggagtaa

SEQ ID NO: 9504 - protein, 471 aa, Linum usitatissimum
MDPVKVWGNTPLQTVDPEIHDLIEKEKRRQCRGIELIASENFTSFAVIEALGSALTNKYSEGMPGNRYYGGNEYIDQIENLCVSRALTAFHLDDTKWGVNVQPYSGSPANFAAYTAILKPHDRIMGLDLPSGGHLTHGYYTSSGKKISATSIYFESLPYKVNSSTGYIDYDKLEEKALDFRPRLIICGGSAYPRDWDYARFRAIADKCGALLLCDMAHISGLVAAQEAANPFEFCDIVTTTTHKSLRGPRAGMIFYRKGPKPANKKGQPQGNYEFEDNINFSVFPALQGGPHNHQIGALAVALKQAATPAFKAYAKQVKANAVAVGNYLMSKGYTLVTGGTENHLVLWDLRPLGLTGNKVEKVCDLCNITVNKNAVFGDSSALSPGGVRVGAPAMTSRGLLEKDFEQIGEFLHRAVALTLSIQKEYGKLLKDFNKGLENNKEIEALKADVEKFAGSFDMPGFLMSEMKYQE

SEQ ID NO: 9505 - DNA, 1416 bp, Zea mays
  CDS (1)..(1416)
atggaccccgtcgccacatgggggctaaccccgcccgcgggcgccgacccggagatctacgacctcctggagcgcgagaagcggcgccagcgtcgcggcatcgagctcatcgcctccgagaacttcacctccttcgccgtcatggaggcgctcggctccgcgctcactaacaagtactccgagggcatgcccggcgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccgccacctcgatctactttgagagcctgccgtacaaggtgagcgccgcaacggggtacatcgactacgagaagctcgaggagaaggcacttgacttccgccccaagctcatcatctgcggtggcagtgcgtacccgagggactgggattacgccaagctcagggccgtcgccgacaaggtcggggccctgctgctctgcgacatggcgcacatcagcgggctcgtcgccgcgcaggaagctgcaaatccttttgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgcccccttggcttgactggaaacaaggtcgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtag

SEQ ID NO: 9506 - protein, 471 aa, Zea mays
MDPVATWGLTPPAGADPEIYDLLEREKRRQRRGIELIASENFTSFAVMEALGSALTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 9507 - DNA, 1554 bp, Brassica napus
  CDS (1)..(1554)
atggcgatggctatggctcttcggaggctttcttcttcagttgacaaacctattcgtcctcttatcagatcatcttcatgctacatgtcttctttaccaagtgaagctgttgatgacaaggagaggtctcgtgtcacttggccaaaacagcttaacgcatctttggaggaagttgatcctgagattgctgacattattgagcatgagaaagctagacaatggaagggacttgaactcattccatctgagaatttcacatctgtctcggtgatgcaagctgttggctctgtgatgactaacaagtacagtgaagggtaccctggtgctagatactatggaggaaatgagtacatagacatggcagagactttatgccaaaagcgcgctcttgaggctttcagattagatcctgaaaagtggggagtgaatgtgcaacccttgtctggatctcctgccaacttccatgtctacactgcattgctcaaacctcatgagagaatcatggcacttgatcttcctcatggtggtcatctttctcatggttatcagactgacaccaagaagatatctgctgtgtctatcttctttgagacaatgccttatcgcttggacgagagcactggctacattgactatgatcagatggagaaaagtgctactcttttcaggccaaaactgattgttgctggtgcgagtgcttatgctcgattgtatgactatgcccgcatccgaaaggtgtgtaacaagcaaaaagctgtgatgctagcagatatggcacacatcagtggtttggttgctgctggtgtaatcccttcaccgttcgactatgcagatgttgtgaccaccacaactcacaagtcacttcgtggaccccgtggagccatgattttctacagaaagggtgttaaggaaattaacaaacaagggaaagaggttttgtatgattttgaagacaagataaatcaagctgtcttccctggtcttcaaggtggtccacataaccacactattacaggactagctgttgctttaaaacaggcaactacttcagagtacaaagcataccaagagcaagtcctgagtaactctgcaaagttcgctcagactctgatggagaaaggttatgaacttgtttctggtggaaccgacaaccatctggttctagtgaacctgaagcccaagggaattgatggatctagagttgagaaagtgttggaagctgttcacattgcatcaaacaaaaacactgttcctggagatgtttctgccatggttcctggtggaatcagaatgggtacacctgctctcacttccagaggctttgttgaggaagactttgctaaagtagctgaatactttgacaaagctgtaacgttggctctcaaagtcaaatctgaagctcaagggaccaagctgaaagactttgtgtcagcaatggaagcttcttcaaccattcaatcagagattgctaagctgcgccatgaagttgaggaatttgctaaacagtttccaacaattgggtttgagaaagaaaccatgaagtacaagaactaa

SEQ ID NO: 9508 - protein, 517 aa, Brassica napus
MAMAMALRRLSSSVDKPIRPLIRSSSCYMSSLPSEAVDDKERSRVTWPKQLNASLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAAGVIPSPFDYADVVTTTTHKSLRGPRGAMIFYRKGVKEINKQGKEVLYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVTLALKVKSEAQGTKLKDFVSAMEASSTIQSEIAKLRHEVEEFAKQFPTIGFEKETMKYKN

SEQ ID NO: 9509 - DNA, 1530 bp, Brassica napus
  CDS (1)..(1530)
atggcgttggctcttcgcagactctcctcttccctcaagaagcccatcttctccaatggcggttccttccgttctatgtcgtctacgccagcctcggagagatctcgttccacttggataagccaactcaacgcacctctggaagaaatcgatcccgaaatcgcagatatcatcgagctcgagaaggctaggcaatggaagggatttgagcttataccgtcagagaacttcacatctgcctcggtgatggaagctgtgggctctgttatgactaacaagtatagtgaaggttaccctggtgctagatactatggaggcaatgagtacattgacatggctgagtcattatgtcaaaaacgcgcacttgaagcttttcacttagatccttccaaatggggagtcaatgtgcagtctttatcaggatcaccagctaacttccaagtttacactgcattgctgaagcctcacgaaagaatcatggcacttgacttgcctcatggtggccatctttctcatggttatcagactgacacgaagaaaatatctgctgtatccatcttttttgagacaatgccatacagattggacgagaacactggttacattgattatgatcagctagagaaaagtgccgtgcttttcagacctaaactgattgttgcaggtgcaagtgcttatgctcgtctatatgactatgcacgtattcgtaaggtctgtgacaagcaaaaggcggatatgctggctgacatggctcatattagtgggttggttgctgctggtgtgataccttctcctttcgagtatgcagatgttgttaccactacaactcacaaatcgcttcgtggtccaagaggggctatgatattctttacgaaggggttgaaagaggttaacaaacaaggaaaagaggtcatgtatgactatgaagacagaattaacgcagctgtttttcctggactgcaaggtggtccacataatcacacaataacaggtctagcagttgctctgaagcaggtgaaaacaccagagtataaggcctaccaggatcaagttctccgcaactgctcaaagtttgcagagactttgctatcaaaaggatatgacttagtatctggaggcactgacaatcatttagtcttggtgaacttgaaaaacaagggaatagatggatcaagagtggaaaaagtattagaatcagtacatattgcagcaaacaaaaacactgttccgggtgacgtttccgctatggttccaggcggcatccgtatgggaacaccagctctcacatcaagaggattcattgaggaagattttgcaaaagtagctgaatacttcgatttagccgtcaagatagccttgaagatcaaggcagagtctcaaggaacaaagctgaaggactttgtagcaacgatgcaatcaaatgagaagttacagtcagagatggcaaagctgcgtgagatggttgaagaatatgctaaacagttcccaaccattgggttcgagaaagagacgatgagatacaaagagtag

SEQ ID NO: 9510 - protein, 509 aa, Brassica napus
MALALRRLSSSLKKPIFSNGGSFRSMSSTPASERSRSTWISQLNAPLEEIDPEIADIIELEKARQWKGFELIPSENFTSASVMEAVGSVMTNKYSEGYPGARYYGGNEYIDMAESLCQKRALEAFHLDPSKWGVNVQSLSGSPANFQVYTALLKPHERIMALDLPHGGHLSHGYQTDTKKISAVSIFFETMPYRLDENTGYIDYDQLEKSAVLFRPKLIVAGASAYARLYDYARIRKVCDKQKADMLADMAHISGLVAAGVIPSPFEYADVVTTTTHKSLRGPRGAMIFFTKGLKEVNKQGKEVMYDYEDRINAAVFPGLQGGPHNHTITGLAVALKQVKTPEYKAYQDQVLRNCSKFAETLLSKGYDLVSGGTDNHLVLVNLKNKGIDGSRVEKVLESVHIAANKNTVPGDVSAMVPGGIRMGTPALTSRGFIEEDFAKVAEYFDLAVKIALKIKAESQGTKLKDFVATMQSNEKLQSEMAKLREMVEEYAKQFPTIGFEKETMRYKE

SEQ ID NO: 9511 - DNA, 1416 bp, Brassica napus
  CDS (1)..(1416)
atggatccagtctcagcctggggaaacacccctcttgtcaccgtcgatccagagatccacgatctcatcgaaaaggagaagcgtcgtcaatgccgcggaatcgaactcatcgcctccgagaacttcacttccttcgccgtcatcgaagctctcggaagcgcactcaccaacaaatactccgaaggcatgcctggcaaccgttactacggaggtaacgagttcatcgaccagatcgagaatctctgccagtcacgcgctctcgaagccttccgtctcgattccgcatcatggggcgtcaatgttcagccctactccggatctccggccaatttcgccgcctacaccgccttgcttcagcctcacgatcgtatcatgggcctcgatctaccttcaggtggtcatctcacgcatggatactatacgtccggtgggaagaagatctctgctacttcgatctactttgagagccttccgtataaggtcaacttcaccactggttacattgattacgataagctcgaggagaaggccatggatttcaggcctaagttgctcatctgtggtggtagtgcctaccctagggattgggattacgctagattgagagctgttgctgataaggttggagctctcttgctctgtgacatggctcacatcagtggactcgttgctgctcaggaagctgcaaacccatttgagtactgtgacgttgtgacaaccacaacccacaagagtttgaggggtccaagggctggtatgatcttctacaggaagggcccaaaaccaccaaagaagggacaacccgagggtgcagtctatgactttgaggacaaaatcaactttgctgtgttccctgcgcttcaaggtggtcctcacaaccaccagatcggtgctctagctgttgcgttgaagcaggctaacactcctggtttcaaggtctatgcgaaacaggtgaaagccaatgctgttgcccttgcaaactacctgatgggtaagggatacagtatcgtaaccggtggaactgagaaccaccttgttctttgggatcttcgccctcttggattgaccggtaacaaggttgagaagctttgcgatctgtgcaacattactttgaacaagaatgctgtctttggagacagcagtgctcttgctcctggaggtgtaagaatcggtactcctgcgatgacatcaaggggattggtggagaaggactttgagatgataggagagttcttgagccgatcagtgacactgacattgaacatccagaaggagcatggtaaactgttgaaggacttcaacaagggtttggtgaacaacaaagagatcgaggagctcaaggctgatgtcgagaagttctcagcctcctatgagatgcctggattcctcatgtctgcgatgaagtaccaggattag

SEQ ID NO: 9512 - protein, 471 aa, Brassica napus
MDPVSAWGNTPLVTVDPEIHDLIEKEKRRQCRGIELIASENFTSFAVIEALGSALTNKYSEGMPGNRYYGGNEFIDQIENLCQSRALEAFRLDSASWGVNVQPYSGSPANFAAYTALLQPHDRIMGLDLPSGGHLTHGYYTSGGKKISATSIYFESLPYKVNFTTGYIDYDKLEEKAMDFRPKLLICGGSAYPRDWDYARLRAVADKVGALLLCDMAHISGLVAAQEAANPFEYCDVVTTTTHKSLRGPRAGMIFYRKGPKPPKKGQPEGAVYDFEDKINFAVFPALQGGPHNHQIGALAVALKQANTPGFKVYAKQVKANAVALANYLMGKGYSIVTGGTENHLVLWDLRPLGLTGNKVEKLCDLCNITLNKNAVFGDSSALAPGGVRIGTPAMTSRGLVEKDFEMIGEFLSRSVTLTLNIQKEHGKLLKDFNKGLVNNKEIEELKADVEKFSASYEMPGFLMSAMKYQD

SEQ ID NO: 9513 - DNA, 1590 bp, Brassica napus
  CDS (1)..(1590)
atgcaagcttgttgtggaggtacttcaatggggtctcttcagcaacctgtacgggttcaaagacctgtctttgctccaataacctccccagtgactaaattctcccagcaactgaagctcagtttcccgagaccttgcccttctttgtttctgagaaaaagctcggtctttgaaaggagagcgtcttcagtctcagcacctgatgtggagactaccagcaatgagatcccattcgaggactacggtcgtcgtgaagtggatccagaggtcgatgagataatcaccaaggagaaaaacagacagttcaggagcttggagcttattgcgtccgagaatttcacttctcgagctgttatggagactgttggatcatgccttaccaacaagtactccgagggtcttcctggtaaaaggtactatggtggcaatgagtttatagatcagttggagacactttgccagaaccgtgctttagcaaccttccggttagattctaccaaatggggtgcgaatgatcagccgttatctggttcacctgcaaactttgctgtctacaccgccatactcaagcctcatgatcgtatcatgggtttggatttacctcatggtggacatctatcacatgggttcatgactgccaaaagacgtgtgtctggaacttcgatatactttgagtccatgccttatcggcttgatgaatcaacaggcattgtggactatgatatgctcgagaaaactgctgtactgttccgaccaaagcttataattgcaggagctagtgcgtacagccgagactttgactatcctcgcatgaggaagatcgcagactcagttggtgcttttctgatgatggatatggctcacatcagtggacttgtggctgcttctgtggtagctgatccttttgagtattgtgatattgttacaacaaccactcacaagtctttgagaggtccaagaggtggaatgatcttcttcaagaaggatccagttaatggggttgaacttgaatctgcaattaacaacgctgtcttccctggtctgcagggtggacctcataaccacacaattggaggattagcagtctgcttgaaacacgcacagtcgccagaattcaaggcttaccagaaaagagttgtggctaactgtagagctctagctaaccgattggttgaactcgggtttaagctggtttctggtggcagcgacaaccacctggtcctcgtggatcttagaccattgggaatggatggtgcacgggtcgagaaaatcttagacatggcatctattacactcaacaagaactctgtccctggggacaagagtgcgttggttccagggggaataaggataggaacgcctgcaatgacgacaagaggactgtcagagaaagactttgtggtggttgctgacttgatcaaggaaggtgtggagataacaatggaagccaagaagctggtttcaggaacaaagcttggagagttcaccaagcttgtgacatctcctgagttcccattgagagagaaagtggagactctcaaggagagaggcgaatcattcacccatcgtttccccattcctggagtgtga

SEQ ID NO: 9514 - protein, 529 aa, Brassica napus
MQACCGGTSMGSLQQPVRVQRPVFAPITSPVTKFSQQLKLSFPRPCPSLFLRKSSVFERRASSVSAPDVETTSNEIPFEDYGRREVDPEVDEIITKEKNRQFRSLELIASENFTSRAVMETVGSCLTNKYSEGLPGKRYYGGNEFIDQLETLCQNRALATFRLDSTKWGANDQPLSGSPANFAVYTAILKPHDRIMGLDLPHGGHLSHGFMTAKRRVSGTSIYFESMPYRLDESTGIVDYDMLEKTAVLFRPKLIIAGASAYSRDFDYPRMRKIADSVGAFLMMDMAHISGLVAASVVADPFEYCDIVTTTTHKSLRGPRGGMIFFKKDPVNGVELESAINNAVFPGLQGGPHNHTIGGLAVCLKHAQSPEFKAYQKRVVANCRALANRLVELGFKLVSGGSDNHLVLVDLRPLGMDGARVEKILDMASITLNKNSVPGDKSALVPGGIRIGTPAMTTRGLSEKDFVVVADLIKEGVEITMEAKKLVSGTKLGEFTKLVTSPEFPLREKVETLKERGESFTHRFPIPGV

SEQ ID NO: 9515 - DNA, 1554 bp, Brassica napus
  CDS (1)..(1554)
atggcgatggccatggctcttcggagactttcttcttcagttgacaaacctattcgtcctcttatcagatcaactacatgctacatgtcatctctgcccagtgaagctgttgatgacaaggagagatctcgtgtcacttggccaaaacagcttaacgcatctttggaggaggttgatcctgagattgctgacattattgagcatgagaaagctagacaatggaagggacttgaactcattccatctgagaatttcacatctgtctcggtgatgcaagctgttggctctgtgatgactaacaagtacagtgaagggtaccctggtgctagatactatggaggaaatgagtacatagacatggcagagactttatgccaaaagcgcgctcttgaggctttcagattagatcctgaaaagtggggagtgaatgtgcaacccttgtctggatctcctgccaacttccatgtctacactgcattgctcaaacctcatgagagaatcatggcacttgatcttcctcatggtggtcatctttctcatggttatcagactgacaccaagaagatatctgctgtgtctatcttctttgagacaatgccttatcgcttggacgagagcactggctacattgactatgatcagatggagaaaagtgctactcttttcaggccaaaactgattgttgctggtgcgagtgcttatgctcgattgtatgactatgcccgcatccgaaaggtgtgtaacaagcaaaaagctgtgatgctagcagatatggcacacatcagtggtttggttgctgctggtgtaatcccttcaccgttcgactatgcagatgttgtgaccaccacaactcacaagtcacttcgtggaccccgtggagccatgattttctacagaaagggtgttaaggaaattaacaaacaagggaaagaggttttgtatgattttgaagacaagataaatcaagctgtcttccctggtcttcaaggtggtccacataaccacactattacaggactagctgttgctttaaaacaggcaactacttcagagtacaaagcataccaagagcaagtcctgagtaactctgcaaagttcgctcagactctgatggagaaaggttatgaacttgtttctggtggaaccgacaaccatctggttctagtgaacctgaagcccaagggaattgatggatctagagttgagaaagtgttggaagctgttcacattgcatcaaacaaaaacactgttcctggagatgtttctgccatggttcctggtggaatcagaatgggtacacctgctctcacttccagaggctttgttgaggaagactttgctaaagtagctgaatactttgacaaagctgtaacgttggctctcaaagtcaaatctgaagctcaagggaccaagctgaaagactttgtgtcagcaatggaagcttcttcaaccattcaatcagagattgctaagctgcgccatgaagttgaggaatttgctaaacagtttccaacaattgggtttgagaaagaaaccatgaagtacaagaactaa

SEQ ID NO: 9516 - protein, 517 aa, Brassica napus
MAMAMALRRLSSSVDKPIRPLIRSTTCYMSSLPSEAVDDKERSRVTWPKQLNASLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAAGVIPSPFDYADVVTTTTHKSLRGPRGAMIFYRKGVKEINKQGKEVLYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVTLALKVKSEAQGTKLKDFVSAMEASSTIQSEIAKLRHEVEEFAKQFPTIGFEKETMKYKN

SEQ ID NO: 9517 - DNA, 1554 bp, Brassica napus
  CDS (1)..(1554)
atggcgatggctatggctcttcggaggctttcttcttcagttgacaaacctattcgtcctcttatcagatcatcttcatgctacatgtcttctttaccaagtgaagctgttgatgacaaggagaggtctcgtgtcacttggccaaaacagcttaacgcatctttggaggaagttgatcctgagattgctgacatcattgagcatgagaaagctagacaatggaagggacttgaactcattccatctgagaatttcacatctgtctcggtgatgcaagctgttggctctgtgatgactaacaagtacagtgaagggtaccctggtgctagatactatggaggaaatgagtacatagacatggcggaaaccttgtgccagaagcgtgctcttgaagctttccggttagaccctgagaagtggggagtgaatgtgcaacctttgtctggatcacctgccaacttccatgtgtacactgcattgttgaagcctcatgagagaatcatggcacttgatcttcctcatggtggtcatctttctcatggttaccagactgacaccaagaagatatctgctgtgtctatcttttttgaaactatgccctaccgcttggacgagagcactggcttcatcgactacgaccagatggagaagagtgctactcttttcaggccaaaactgattgttgctggtgcaagtgcttatgctcgattgtatgactatgcccgcatccgaaaggtgtgtaacaagcaaaaagctgtgatgctagcagatatggcacacataagcggtttggttgcagctggtgtaatcccttcaccgttcgaatatgcagatgttgtaaccaccacaactcacaagtcacttcgtggacctcgtggtgccatgattttctacagaaagggtgttaaggaaattaacaaacaagggaaagaggttatgtatgattttgaagacaagatcaatcaagctgtcttccctggtcttcaaggtggtccacacaaccacactattacaggactagctgttgctttaaaacaggcaactacttcagagtacaaagcataccaagagcaagtcctcagtaactctgcaaagtttgctcagactctgatggagaaaggttatgaacttgtttctggtggaactgacaaccatctggttctagtgaacctgaagcccaagggaattgatggatctagagttgagaaagtactggaagctgttcacattgcatccaacaaaaacactgttcctggagatgtttctgccatggttcctggtggaatcagaatgggtactcctgctctcacttccagaggctttgttgaggaagactttgccaaagtagctgagtactttgacaaagctgtgaagttggctctcaaagtcaaatctgaagctcaaggaaccaaactgaaagattttgtgtcagcaatggaatcatcttcagccattcaatcagagattgccaagctgcgccacgacgtggaggagttcgctaagcagttcccaactattgggtttgagaaagaaaccatgaagtacaagaactga

SEQ ID NO: 9518 - protein, 517 aa, Brassica napus
MAMAMALRRLSSSVDKPIRPLIRSSSCYMSSLPSEAVDDKERSRVTWPKQLNASLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGFIDYDQMEKSATLFRPKLIVAGASAYARLYDYARIRKVCNKQKAVMLADMAHISGLVAAGVIPSPFEYADVVTTTTHKSLRGPRGAMIFYRKGVKEINKQGKEVMYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVKLALKVKSEAQGTKLKDFVSAMESSSAIQSEIAKLRHDVEEFAKQFPTIGFEKETMKYKN

SEQ ID NO: 9519 - DNA, 1584 bp, Glycine max
  CDS (1)..(1584)
atgcaggcttgtacaacgatgagttctttgcagcaacaacctatttggaccaaagggttaaatttccctgcaaaagggtatggcagcaataacgggtttctacctcaggtgaggttctgcaatattaagccatccaaagcttctcatgttgaagcaagtttagtcactgggaagccgtcatctgtgcctttctctgtgcctgaaattggaggcgacggaagtagcttcctggactatggcttgagtgaagctgatcctgatgttcgtgcaattattgacaaggaaaaggaccgacaatttaaaagtcttgagcttattgcttctgagaattttacatctagagcagtgatggaagcagttgggtcgtgcctcacaaacaagtactcagaaggattgccgggtaaaaggtactatggtggcaatgagtacattgatgagcttgaaatcctatgtcaacaaagggcactggctgcatttcatgtagatgaaaacaaatggggtgttaatgttcaaactttatctggttcccctgctaattttgcagtatacactgcagttcttaaaccacatgatcggataatgggtttggacttgcctcacggaggacatttgtctcatggattcatgacacccaaaaaacgtgtatcagccacatcaatttattttgaatctatgccttatcgacttgatgaatcaacaggtcttattgattatgatatgctggagaaaactgctactctgtttcgtccaaaactcattgttgctggtgctagtgcttatcctcgggacattgactaccctcgtatgagaaaaattgcagatgaagtaggtgcttttcttatgatggatatggctcatataagtgggcttgttgctgcatctgtactttctaatccctttgagtattgtgatattgtgaccaccacaacccacaagtctttacgaggtccaagaggtggtatgatattcttcaagaaagatactgtgcatggggttgatttggagcctgccattaacaatgctgtttttcctggtctacaggggggtcctcataaccacacaattggaggactagcagtttgcttgaagtatgctcagtctccagaatttaaaaattatcaaaatcaggtggttgctaactgtagagctcttgctaagcgattaattgagcatggatataaactggtttctggtggtagtgacaatcacctggttcttgtcgatctaaggccatctggtcttgatggtgctcgggtggagaaaattcttgacttggcttctataaccctcaacaaaaattcagtgcctggtgataagagtgccctagttccaggaggcattcgcattggggcaccagcaatgacaacaagaggacttggtgagaaagaattttcactcattgctgatttcattcatgagggtgtgcaaataagtcttgaagccaaaagtttggtctcaggaacgaagctccaagattttttgaagtttgtaacatcttctgaatttcctttgggagagaaggtatcagagttgcgtaggaaagttgaagctcttactactcagtatccaatacccggagtctaa

SEQ ID NO: 9520 - protein, 527 aa, Glycine max
MQACTTMSSLQQQPIWTKGLNFPAKGYGSNNGFLPQVRFCNIKPSKASHVEASLVTGKPSSVPFSVPEIGGDGSSFLDYGLSEADPDVRAIIDKEKDRQFKSLELIASENFTSRAVMEAVGSCLTNKYSEGLPGKRYYGGNEYIDELEILCQQRALAAFHVDENKWGVNVQTLSGSPANFAVYTAVLKPHDRIMGLDLPHGGHLSHGFMTPKKRVSATSIYFESMPYRLDESTGLIDYDMLEKTATLFRPKLIVAGASAYPRDIDYPRMRKIADEVGAFLMMDMAHISGLVAASVLSNPFEYCDIVTTTTHKSLRGPRGGMIFFKKDTVHGVDLEPAINNAVFPGLQGGPHNHTIGGLAVCLKYAQSPEFKNYQNQVVANCRALAKRLIEHGYKLVSGGSDNHLVLVDLRPSGLDGARVEKILDLASITLNKNSVPGDKSALVPGGIRIGAPAMTTRGLGEKEFSLIADFIHEGVQISLEAKSLVSGTKLQDFLKFVTSSEFPLGEKVSELRRKVEALTTQYPIPGV

SEQ ID NO: 9521 - DNA, 1557 bp, Glycine max
  CDS (1)..(1557)
atggcgatggcaatggcgcttcgcaggctttcatcttcaattgacaagcctctgcgccctctcttcaatgccggttccctctactacaagtcgtctttgcctgatgaagctgtttacgacaaggagcgacccggagttacatggccgaagcagttgaatgctccacttgaggtcgtggatcctgagattgctgatattattgagcttgagaaagctaggcaatggaaggggctagaattgataccgtcagagaatttcacctctgtgtctgtgatgcaagcggttggatcggttatgaccaacaaatacagtgaggggtaccctggtgcaagatattatggtggaaatgagtatattgacatggctgaaacactgtgccaaaagcgtgccctagaagcttttagattggatcccgctaaatggggagtgaacgtgcagcctctgtcagggtctcctgcaaatttccacgtttacactgcattgcttaaacctcatgaaagaatcatggcacttgatcttcctcatggtggccatctttctcacggatatcagactgataccaaaaagatatctgcagtctcgatattttttgagacaatgccatatcgattgaatgaaagtacaggatacatcgactatgaccagatggagaaatctgctacactcttcaggccaaaattaattgttgctggagctagcgcttatgcacgtctctatgattatgaacgtgtacgcaaggtttgcgataaacagaaagctatactattggcagatatggcacacatcagtggattggttgcagctggtgtcatcccatcaccttttgattatgctgatgtagttactaccacaactcacaagtcacttcgaggaccacgtggagctatgatattctacagaaaaggggttaaagaaattaacaaacaaggaaaagaggtattgtatgactacgaagacaaaatcaaccaagctgttttccctggactgcaaggtggccctcacaaccacactattactggtttagctgttgcgttgaagcaggccactactcccgaatatagagcatatcaagagcaagttctcagcaacagctttaaatttgcacaggctctgagtgagagaagctatgagcttgtctctggtggaaccgagaatcacctggttttggtgaatctgaagaataagggtattgatggctccagagttgagaaggtgttggaagcagttcatattgcagctaataaaaacactgttcctggagatgtgtctgccatggttcctggtggcatcaggatgggaacccctgctcttacttctagaggatttgttgaggaggattttgtcaaggtagcagagttttttgatgcagcagtgaagatagctgtgaagattaagggagagagcaaaggaacaaagctgaaggacttcttggccacaattgagtcatcttctacctttcaatcggagatagcaaagctccgccttgatgttgaggagtatgcaaaacaatttccaaccattggttttgataaagcaaccatgaagcacaagaattga

SEQ ID NO: 9522 - protein, 518 aa, Glycine max
MAMAMALRRLSSSIDKPLRPLFNAGSLYYKSSLPDEAVYDKERPGVTWPKQLNAPLEVVDPEIADIIELEKARQWKGLELIPSENFTSVSVMQAVGSVMTNKYSEGYPGARYYGGNEYIDMAETLCQKRALEAFRLDPAKWGVNVQPLSGSPANFHVYTALLKPHERIMALDLPHGGHLSHGYQTDTKKISAVSIFFETMPYRLNESTGYIDYDQMEKSATLFRPKLIVAGASAYARLYDYERVRKVCDKQKAILLADMAHISGLVAAGVIPSPFDYADVVTTTTHKSLRGPRGAMIFYRKGVKEINKQGKEVLYDYEDKINQAVFPGLQGGPHNHTITGLAVALKQATTPEYRAYQEQVLSNSFKFAQALSERSYELVSGGTENHLVLVNLKNKGIDGSRVEKVLEAVHIAANKNTVPGDVSAMVPGGIRMGTPALTSRGFVEEDFVKVAEFFDAAVKIAVKIKGESKGTKLKDFLATIESSSTFQSEIAKLRLDVEEYAKQFPTIGFDKATMKHKN

SEQ ID NO: 9523 - DNA, 1416 bp, Glycine max
  CDS (1)..(1416)
atggatccagtgagcgtgtggggtaacacgcccttggcgacggtggatcccgagatccatgacctcatcgagaaggagaagcaccgccaatgccgcggcatcgagctcatcgcctccgagaacttcacctccttcgcagtcatcgaggccctcggcagcgccctcaccaacaaatactccgagggcatgcccggcaaccgctactacggcggcaacgaattcatcgaccagatcgaaaacctctgccgctcacgcgccctccaggccttccacctcgacgcccaatcctggggcgtcaatgtgcagccctactccggctcccctgccaacttcgccgcctacaccgccgtcctcaacccccacgaccgcatcatggggctggatctcccctccggcggccacctcacccacggctactacacctccggcggcaagaagatctccgccacctccatttacttcgagagcctcccttacaaagtaaactccaccaccggctacatcgactacgaccgcttggaggaaaaagccctagacttcaggcccaaattgataatctgcggtggcagcgcttaccctcgcgattgggactacaaacgcttcagggaaattgcggataagtgcggggcattgcttctctgcgacatggcgcacactagcggccttgtggccgcgcaggaagtgaacagccccttcgagtattgcgacattgtgaccaccaccacgcataagagcttgcggggtccacgggcggggatgatcttttaccggaagggcccgaagccgccgaagaaggggcagccggagaacgcggtttatgatttcgaggacaagatcaactttgcggtgttcccttcgctgcagggtgggccccacaaccaccagatcggggctcttgccgtggcgctgaagcaggccgcgtcgcccgggtttaaggcctacgccaagcaggttaaggccaacgccgttgcgcttgggaattacttgatggggaaagggtacagtcttgtcactggaggcacggagaaccatcttgtcttgtgggatctcagacctcttggattgactgggaataaggtggagaaactctgtgatctctgcaacattactgttaataagaacgcagtttttggtgatagcagtgccttggcccccggtggagtgcgaattggggcccctgccatgacttctaggggtttggttgaaaaggactttgagcagattggtgagttccttcaccgtgctgtgactctcacactggagatccagaaggagcatggcaaacttctcaaggatttcaacaagggcctcgtcaacaacaaggccattgaagatctcaaagctgatgttgagaagttctctgccacatttgacatgcctggcttcctggtatctgaaatgaagtacaaggattag

SEQ ID NO: 9524 - protein, 471 aa, Glycine max
MDPVSVWGNTPLATVDPEIHDLIEKEKHRQCRGIELIASENFTSFAVIEALGSALTNKYSEGMPGNRYYGGNEFIDQIENLCRSRALQAFHLDAQSWGVNVQPYSGSPANFAAYTAVLNPHDRIMGLDLPSGGHLTHGYYTSGGKKISATSIYFESLPYKVNSTTGYIDYDRLEEKALDFRPKLIICGGSAYPRDWDYKRFREIADKCGALLLCDMAHTSGLVAAQEVNSPFEYCDIVTTTTHKSLRGPRAGMIFYRKGPKPPKKGQPENAVYDFEDKINFAVFPSLQGGPHNHQIGALAVALKQAASPGFKAYAKQVKANAVALGNYLMGKGYSLVTGGTENHLVLWDLRPLGLTGNKVEKLCDLCNITVNKNAVFGDSSALAPGGVRIGAPAMTSRGLVEKDFEQIGEFLHRAVTLTLEIQKEHGKLLKDFNKGLVNNKAIEDLKADVEKFSATFDMPGFLVSEMKYKD

SEQ ID NO: 9525 - DNA, 1416 bp, Glycine max
  CDS (1)..(1416)
atggatccagtaagcgtgtggggtaacacgcccttggcgacggtggatcccgagatccatgacctcatcgagaaggagaagcgccgtcaatgccgcggaatcgagctcatcgcctccgagaacttcacctccttcgccgtcatcgaggccctcggcagcgctctcacgaacaaatactccgagggcatgccgggcaaccgctactacggcggcaatgaatacatcgaccagatcgaaaacctctgccgctcacgcgccctccaagccttccacctcgacgcccaatcctggggcgtcaacgtccagccctactccggctcccctgccaacttcgccgcctacaccgccgtcctcaacccccacgaccgcatcatggggctggatctcccctccggcggccacctcacccacggctactacacctccggcggcaagaagatctccgccacctccatttacttcgagagcctcccttacaaagtaaactccaccaccggctacatcgactacgaccgcttggaggaaaaagccctagacttcaggcccaaattgataatctgcggtggcagcgcttaccctcgcgattgggactacaaacgcttcagggaaattgcggataagtgcggggcattgcttctctgcgacatggcgcacactagcggccttgtggccgcgcaggaagtgaacagccccttcgagtattgcgacattgtgaccaccaccacgcataagagcttgcggggtccacgggcggggatgatcttttaccggaagggcccgaagccgccgaagaaggggcagccggagaacgcggtttatgatttcgaggacaagatcaactttgcggtgttcccttcgctgcagggtgggccccacaaccaccagatcggggctcttgccgtggcgctgaagcaggccgcgtcgcccgggtttaaggcctacgccaagcaggttaaggccaacgccgttgcgcttgggaattacttgatggggaaagggtacagtcttgtcactggaggcacggagaaccatcttgtcttgtgggatctcagacctcttggattgactgggaataaggtggagaaactctgtgatctctgcaacattactgttaataagaacgcagtttttggtgatagcagtgccttggcccccggtggagtgcgaattggggcccctgccatgacttctaggggtttggttgaaaaggactttgagcagattggtgagttccttcaccgtgctgtgactctcacactggagatccagaaggagcatggcaaacttctcaaggatttcaacaagggcctcgtcaacaacaaggccattgaagatctcaaagctgatgttgagaagttctctgccacatttgacatgcctggcttcctggtatctgaaatgaagtacaaggattag

SEQ ID NO: 9526 - protein, 471 aa, Glycine max
MDPVSVWGNTPLATVDPEIHDLIEKEKRRQCRGIELIASENFTSFAVIEALGSALTNKYSEGMPGNRYYGGNEYIDQIENLCRSRALQAFHLDAQSWGVNVQPYSGSPANFAAYTAVLNPHDRIMGLDLPSGGHLTHGYYTSGGKKISATSIYFESLPYKVNSTTGYIDYDRLEEKALDFRPKLIICGGSAYPRDWDYKRFREIADKCGALLLCDMAHTSGLVAAQEVNSPFEYCDIVTTTTHKSLRGPRAGMIFYRKGPKPPKKGQPENAVYDFEDKINFAVFPSLQGGPHNHQIGALAVALKQAASPGFKAYAKQVKANAVALGNYLMGKGYSLVTGGTENHLVLWDLRPLGLTGNKVEKLCDLCNITVNKNAVFGDSSALAPGGVRIGAPAMTSRGLVEKDFEQIGEFLHRAVTLTLEIQKEHGKLLKDFNKGLVNNKAIEDLKADVEKFSATFDMPGFLVSEMKYKD

SEQ ID NO: 9527 - DNA, 1767 bp, Zea mays
  CDS (1)..(1767)
atggatctctcgcggcccacatcgtcggacctctcgctcgggctccactctcacggtcacgcccacgcccacgctcgcaggcacgcggtagccgcgccgctgcgcctgttcgacgacgcggaggagccgaagccggagcgcgtcgtggccggagaggccgacgcggagagggatgacgaggacgggggcgaccagcacttctccctcctcgggcactccctcttcgtcaagcgcccgcgccgcgccggcaacggcggcgggggcggagagacgtcatcctgctcgtccacgtccgcggcgcttcgccctgccaagcgacaggcgacgggggagggcagcggcgcagatctggagacccgccgcgccgcggtccgcgcctggggcaatcagtcgctggcggaggccgacccggacgtgcactcgctgatggagcaggagttggaccgccaggtgcgaggcatcgagctcatagcgtcggaaaacttcgtctgccgcgcggtgctcgatgcactcggcagccacctcactaacaagtactccgagggggccccgggtgctcgctactacggcgggaatcagcacatcgacgccatcgaacggctctgccatgagcgcgctctcaccgccttcggtctcgaccctgcctgctggggcgtcaacgtgcagccctactcgtgcacgtctgccaacttggctgtctacactgggctccttcaacccaaggaccgcatcatggggctggagccaccgtcgggcggccatgttagccatggttactacacgcccagtggcaagaaggtgtcaggtgcctctattttcttcgagagcatgtcgtacaaggtgaacccacagactgggtatattgattacgacaagcttgaagaaagagcaatggatttccaccctaaaattctcatctgtggtgggagctcttaccccagagagtgggactttgcacggatgagattgattgctgataagtgtggtgcggtgcttctttgcgacatggcacatatcagtgggcttgtcgcagcaaaggaatgccgtagccctttcgactactgtgatgttgttacgtcaactactcacaagaatcttaggggccctagaggtggtataatattcttcaggaaagggaaaaatttaaggaaacgagctggatctttttctcaaggagatgagaatgaatatgacttcgaggataggataaattttggtgttttcccttcaatgcaaggagggccccataataatcatattgctggcttggctataactctgaagcaggtagcaacttctgaatataaagcatacattcaacaagtcaagaaaaatgctcaggctttggcatcagctttgatcagaagaaaatgcagattggttacaggtggcacagataatcacttggtactttgggacctcagaactcttggcttgactggcaagatcttcgagaaggtttgtgaggcatgccacatatctgtcaacaagacaccaatttatggagataatggctcgatatcgccaggtggtgtgcggattggaacacctgcaatgactactagaggttgcttagaagaggacttcgaggtgattgcagacttcctcataagggctactcaaattgctaacaatgttctgaaagaacatggcaaagtgcaaaaggagtttctaagaggcctacagaacaataatgatgttatagaactccgaaatcaggttgaggcatttgcgtcacagtttgcgatgccaggttttgatgtatga

SEQ ID NO: 9528 - protein, 588 aa, Zea mays
MDLSRPTSSDLSLGLHSHGHAHAHARRHAVAAPLRLFDDAEEPKPERVVAGEADAERDDEDGGDQHFSLLGHSLFVKRPRRAGNGGGGGETSSCSSTSAALRPAKRQATGEGSGADLETRRAAVRAWGNQSLAEADPDVHSLMEQELDRQVRGIELIASENFVCRAVLDALGSHLTNKYSEGAPGARYYGGNQHIDAIERLCHERALTAFGLDPACWGVNVQPYSCTSANLAVYTGLLQPKDRIMGLEPPSGGHVSHGYYTPSGKKVSGASIFFESMSYKVNPQTGYIDYDKLEERAMDFHPKILICGGSSYPREWDFARMRLIADKCGAVLLCDMAHISGLVAAKECRSPFDYCDVVTSTTHKNLRGPRGGIIFFRKGKNLRKRAGSFSQGDENEYDFEDRINFGVFPSMQGGPHNNHIAGLAITLKQVATSEYKAYIQQVKKNAQALASALIRRKCRLVTGGTDNHLVLWDLRTLGLTGKIFEKVCEACHISVNKTPIYGDNGSISPGGVRIGTPAMTTRGCLEEDFEVIADFLIRATQIANNVLKEHGKVQKEFLRGLQNNNDVIELRNQVEAFASQFAMPGFDV

SEQ ID NO: 9529 - DNA, 1542 bp, Zea mays
  CDS (1)..(1542)
atggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgctggaagaggtcgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagcgaggggtaccctggcgcaagatactacgggggaaatgagtttattgatatggcagagtccttgtgtcagaaacgtgctttggaggctttccgtttggacccggcgaaatggggagtgaatgtgcaacctctatccggttcgcccgccaacttccatgtatacactgcactcttgaagccacatgaaaggatcatggctttggatcttcctcacggtggacatctttctcatggttaccagactgacactaagaagatatctgcaacttcaatattttttgagacaatgccttacagattggatgaaagcactggattgattgattacgatcagttggagaaaagcgctgttctttttaggccaaagttgatcattgctggtgcaagtgcatatgctcggctatatgattatgaccgtatgcggaagatatgcaacaagcagaaggcaatacttctagcagacatggcacatattagtgggcttgttgcagctggtgttgttccatctccttttgattatgcagatgtagtgactaccactactcacaaatcactccgtgggccacgtggagccatgatcttttacaggaagggagtcaaagaaataaataaacaaggaaaagaggttatgtatgattttgaggacaaaatcaatgctgctgtctttcctggtctgcaaggtgggcctcataaccataccattactggcttggctgttgcgctcaaacaggcaactactccagaatacagagcttaccaagagcaagttatcagtaattgtgctaaatttgcgcagagcctgatttcaaaaggatatgaactcgtctctggtgggactgacaaccatttagttctggtgaatctcaagaataaggggatagatggttcaagggtggagaaggttttagaaagtgtgcatattgcagcaaacaagaacacagttcctggtgatgtttcagctatggtgccaggaggcatcaggatgggaaccccagcccttacgtcgagaggatttgttgaagaagatttcgctaaagttgctgacttcttcgatgcagcagtgaatctggccttgaagattaaggctgcaacgacaggtggaacaaagctgaaggactttgttgccactttgcaatctgatagcatccaagttgagattgcaaagcttcgccatgatgtagaggaatttgcaaaacaattcccaacaattggatttgagaaagagaccatgaaatacaagaactaa

SEQ ID NO: 9530 - protein, 513 aa, Zea mays
MAMATALRKLSANALRRQPLSRITPLYYMASLPATEERSGITWTKQLNAPLEEVDPEIADIIEHEKARQWKGLELIPSENFTSVSVMQAVGSVMTNKYSEGYPGARYYGGNEFIDMAESLCQKRALEAFRLDPAKWGVNVQPLSGSPANFHVYTALLKPHERIMALDLPHGGHLSHGYQTDTKKISATSIFFETMPYRLDESTGLIDYDQLEKSAVLFRPKLIIAGASAYARLYDYDRMRKICNKQKAILLADMAHISGLVAAGVVPSPFDYADVVTTTTHKSLRGPRGAMIFYRKGVKEINKQGKEVMYDFEDKINAAVFPGLQGGPHNHTITGLAVALKQATTPEYRAYQEQVISNCAKFAQSLISKGYELVSGGTDNHLVLVNLKNKGIDGSRVEKVLESVHIAANKNTVPGDVSAMVPGGIRMGTPALTSRGFVEEDFAKVADFFDAAVNLALKIKAATTGGTKLKDFVATLQSDSIQVEIAKLRHDVEEFAKQFPTIGFEKETMKYKN

SEQ ID NO: 9531 - DNA, 1416 bp, Zea mays
  CDS (1)..(1416)
atggacaacgtggaggagtgggggctgaggccgctggccgaggtcgacccggaggtgtacgacctaatcgagcgcgagaagcggcggcagcgagcgggtatcgagctcatcgcatcggagaacttcacctcgctcgctgtcatggaggcgctgggctccccgctcaccaacaagtactcggagggcatgccgggggcgcgctactacggcggcaacgaggtcatcgacgaaatcgaggagctctgccggacccgcgcgctcgccgccttccacctcgaccccgcccgctggggcgtcaacgtgcagccctactcggggtcccccgccaatttcgcggcatacacggggctgctccagccgaacgacaggatcatggggctcgacctgccgtccgggggccacctcacccacgggtactacacggcgagtggaaagaagatttctgcaacctccatctacttccagagcctgcccgataaggggagctccgacaccgggtacgtcgactacgataagctggaggaaaaggccatggatttccgccccaagcttatcatctgtggcggtagtgcatgccctcgggagtgggattacgccaggttcagggccatcgcagacaagtgcggggccatgttgctctgcgacatggctcatatcagtggtctcgttgctgcgcaggaggctttgaatccttttgaattctctgatgtggttaccactacgacccacaaaagtcttcgagggccaaggtctggtatgattttctacaggaagggcccaaagcctccaaaaaaaggccagcctgagggtgctctgtatgactacgaggacaagatcaactttgctgtgttcccgtcactccagggggggcctcacaatcaccaaattgctgctctagctgtagccttgaaacaggccatgtcacctggattcaaggcctatatccagcaggtcaaggcaaacacagtttcccttggtaaccatttgatgagtaagggctacaagttggttactgatggaacagagaaccaccttgttctctgggatctgcgccctcttggcttgactggcaataaagttgagatgctatgtgacctatgcaacattacactgaacaaaaatgctgtctttggtgacagcagtgcattatcacctggcggtgtgcgcattggtacacctgctatgacctcaaggggtttggttgagaaggacttcgtgcagattgccgagtaccttcaccgagctgtgaccatctgcttgagcatccaggcggagcatggcaagattctcaaggacttcaagaagggcttggtgcaaaacaaggacatagagaacctgagggcggaggtcgagaagttcgccacttcatttgacatgcctggcttcagggtgtctgacatgaagtacacagactag

SEQ ID NO: 9532 - protein, 471 aa, Zea mays
MDNVEEWGLRPLAEVDPEVYDLIEREKRRQRAGIELIASENFTSLAVMEALGSPLTNKYSEGMPGARYYGGNEVIDEIEELCRTRALAAFHLDPARWGVNVQPYSGSPANFAAYTGLLQPNDRIMGLDLPSGGHLTHGYYTASGKKISATSIYFQSLPDKGSSDTGYVDYDKLEEKAMDFRPKLIICGGSACPREWDYARFRAIADKCGAMLLCDMAHISGLVAAQEALNPFEFSDVVTTTTHKSLRGPRSGMIFYRKGPKPPKKGQPEGALYDYEDKINFAVFPSLQGGPHNHQIAALAVALKQAMSPGFKAYIQQVKANTVSLGNHLMSKGYKLVTDGTENHLVLWDLRPLGLTGNKVEMLCDLCNITLNKNAVFGDSSALSPGGVRIGTPAMTSRGLVEKDFVQIAEYLHRAVTICLSIQAEHGKILKDFKKGLVQNKDIENLRAEVEKFATSFDMPGFRVSDMKYTD

SEQ ID NO: 9533 - DNA, 1581 bp, Zea mays
  CDS (1)..(1581)
atgtgcacacgcgcccacctcccgtccaccaccgctatatatcccggcgccccttcctccctcccccgtccttccctccgcctccgcctccgcccccgcccccgcccacgcccactcctcgctgccaccactcctgtcacctcttcccgcgccgacgcagccgccatggaccccgtcgccacatgggggctaaccccgctcgcgggcgccgacccggagatctacgacctcctggagcgcgagaagcggcgccagcgtcgcggcatcgagctcatcgcctccgagaacttcacctccttcgccgtcatggaggcgctcggctccgcgctcactaacaagtactccgagggcatgcccggcgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccgccacctcgatctactttgagagcctgccgtacaaggtgagcgccgcaacggggtacatcgactacgagaagctcgaggagaaggcacttgacttccgccccaagctcatcatctgcggtggcagtgcgtacccgagggactgggattacgccaagctcagggccgtcgccgacaaggtcggggccctgctgctctgcgacatggcgcacatcagcgggctcgtcgccgcgcaggaagctgcaaatccttttgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgcccccttggcttgactggaaacaaggtcgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtag

SEQ ID NO: 9534 - protein, 526 aa, Zea mays
MCTRAHLPSTTAIYPGAPSSLPRPSLRLRLRPRPRPRPLLAATTPVTSSRADAAAMDPVATWGLTPLAGADPEIYDLLEREKRRQRRGIELIASENFTSFAVMEALGSALTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 9535 - DNA, 1773 bp, Zea mays
  CDS (1)..(1773)
atggatctctcgcggcccacatcgtcagacctctcgctcgggctccactcgcacggtcacgcccacgcccacgctcgcaggcacgcggcagccgcgccgctgcgcctgttcgacgacgcggaggagccgaagccggagcgcctcggggccggagaggccgacgcggagagggacgacgaggacgggggcgaccagcacttctccctcctcgggcactccctctgcgtcaagcgcccgcgccgcgccggcaacggcggcgggggtgggggcggagagacgtcatcctgctcgtccacgtccccggcgctgcgccccgccaagcgacaggcgacgggggaagacagcggcgcagatctggagacccgccgcgccgcggtccgcgcctggggcaaccagtcgctggcggaggccgacccggacgtgcactcgctgatggagcaggagctggaccgccaggtgcgaggcatcgagctcatagcgtcggaaaacttcgtctgccgcgcggtgctcgatgcactcggcagccacctcaccaacaagtactccgagggggccccgggtgctcgctactacggcgggaatcagcacatcgacgccatcgaacggctctgccatgagcgcgccctcaccgccttcggtctcgaccctgcctgctggggcgtcaacgtgcagccctactcgtgcacgtctgccaacttggctgtctacactgggctccttcaacccaaggaccgcatcatggggctggagccaccgtcgggcggccatgttagccatggttactacacgcccagtggcaagaaggtgtcaggtgcctctattttcttcgagagcatgtcgtacaaggtgaacccacagactgggtatattgattacgacaagcttgaagaaagagcaatggatttccaccctaaaattctcatctgtggtgggagctcttaccccagagagtgggactttgcacggatgagattgattgctgataagtgtggtgcggtgcttctttgcgacatggcacatatcagtgggcttgtcgcagcaaaggaatgccgtagccctttcgactactgtgatgttgttacgtcaactactcacaagaatcttaggggccctagaggtggtataatattcttcaggaaagggaaaaatttaaggaaacgagctggatctttttctcaaggagatgagaatgaatacgacttcgaggataggataaattttggtgttttcccttcaatgcaaggagggccccataataatcatattgctggcttggctataactctgaagcaggtagcaacttctgaatataaagcatacattcaacaagtcaagaaaaatgctcaggctttggcatcagctttgatcagaagaaaatgcagatgggtaacaggtggcacagataatcacttagtactttgggacctcagaactcttggcttgactggcaagatcttcgagaaggtttgcgaggcatgccacatatctgtcaacaagacaccaatttatggagataatggctcgatatcgccaggtggtgtgcggattggaacacctgcaatgactactagaggttgcttagaagaggacttcgaggtgattgcagacttcctcataagggctactcaaattgctaacaatgttctgaaagaacatggcaaagtgcaaaaggagtttctaagaggcctacagaacaataatgatgttatagaactccgaaatcaggttgaggcatttgcgtcacagtttgcgatgccaggttttgatgtatga

SEQ ID NO: 9536 - protein, 590 aa, Zea mays
MDLSRPTSSDLSLGLHSHGHAHAHARRHAAAAPLRLFDDAEEPKPERLGAGEADAERDDEDGGDQHFSLLGHSLCVKRPRRAGNGGGGGGGETSSCSSTSPALRPAKRQATGEDSGADLETRRAAVRAWGNQSLAEADPDVHSLMEQELDRQVRGIELIASENFVCRAVLDALGSHLTNKYSEGAPGARYYGGNQHIDAIERLCHERALTAFGLDPACWGVNVQPYSCTSANLAVYTGLLQPKDRIMGLEPPSGGHVSHGYYTPSGKKVSGASIFFESMSYKVNPQTGYIDYDKLEERAMDFHPKILICGGSSYPREWDFARMRLIADKCGAVLLCDMAHISGLVAAKECRSPFDYCDVVTSTTHKNLRGPRGGIIFFRKGKNLRKRAGSFSQGDENEYDFEDRINFGVFPSMQGGPHNNHIAGLAITLKQVATSEYKAYIQQVKKNAQALASALIRRKCRWVTGGTDNHLVLWDLRTLGLTGKIFEKVCEACHISVNKTPIYGDNGSISPGGVRIGTPAMTTRGCLEEDFEVIADFLIRATQIANNVLKEHGKVQKEFLRGLQNNNDVIELRNQVEAFASQFAMPGFDV

SEQ ID NO: 9537 - DNA, 1416 bp, Zea mays
  CDS (1)..(1416)
atggaccccgtcgccacatgggggctaaccccgctcgcgggcgccgacccggagatctacgacctcctggagcgcgagaagcggcgccagcgtcgcggcatcgagctcatcgcctccgagaacttcacctccttcgccgtcatggaggcgctcggctccgcgctcactaacaagtactccgagggcatgcccggcgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccgccacctcgatctactttgagagcctgccgtacaaggtgagcgccgcaacggggtacatcgactacgagaagctcgaggagaaggcacttgacttccgccccaagctcatcatctgcggtggcagtgcgtacccgagggactgggattacgccaagctcagggccgtcgccgacaaggtcggggccctgctgctctgcgacatggcgcacatcagcgggctcgtcgccgcgcaggaagctgcaaatccttttgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgttgctctacagcaaactatgtcgcctggcttcaaggcctatgcaaagcaagtgaaggccaatgctgttgcaattggaaactatctcatgagcaagggctacaagatggtgactgatggaactgagaaccaccttgttctctgggatctccgcccccttggcttgactggaaacaaggtcgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtag

SEQ ID NO: 9538 - protein, 471 aa, Zea mays
MDPVATWGLTPLAGADPEIYDLLEREKRRQRRGIELIASENFTSFAVMEALGSALTNKYSEGMPGARYYGGNDVIDEIENLCRSRALAAFHLDAASWGVNVQPYSGSPANFAAYTALLNPHDRIMGLDLPSGGHLTHGYYTAGGKKISATSIYFESLPYKVSAATGYIDYEKLEEKALDFRPKLIICGGSAYPRDWDYAKLRAVADKVGALLLCDMAHISGLVAAQEAANPFEYCDVVTTTTHKSLRGPRAGMIFYRKGPKPPKKGQPEGAVYDYEDKINFAVFPSLQGGPHNHQIAALAVALQQTMSPGFKAYAKQVKANAVAIGNYLMSKGYKMVTDGTENHLVLWDLRPLGLTGNKVEKLCDLCHITLNKNAVFGDSSALSPGGVRIGAPAMTSRGLLEKDFEQIGEFLHQAVTICLNIQKEYGKLLKDFNKGLVNNKDIENLKVQVEKFADSFDMPGFTLESMKYKE

SEQ ID NO: 9539 - DNA, 1767 bp, Zea mays
  CDS (1)..(1767)
atggatctctcgcggcccacatcgtcggacctctcgctcgggctccactctcacggtcacgcccacgcccacgctcgcaggcacgcggtagccgcgccgctgcgcctgttcgacgacgcggaggagccgaagccggagcgcgtcggggccggagaggccgacgcggagagggatgacgaggacgggggcgaccagcacttctccctcctcgggcactccctctgcgtcaagcgcccgcgccgcgccggcaacggcggcgggggcggagagacgtcatcctgctcgtccacgtccgcggcgcttcgccctgccaagcgacaggcgacgggggagggcagcggcgcagatctggagacccgccgcgccgcggtccgcgcctggggcaatcagtcgctggcggaggccgacccggacgtgcactcgctgatggagcaggagctggaccgccaggtgcgaggcatcgagctcatagcgtcggaaaacttcgtctgccgcgcggtgctcgatgcactcggcagccacctcactaacaagtactccgagggggccccgggtgctcgctactacggcgggaatcagcacatcgacgccatcgaacggctctgccatgagcgcgctctcaccgccttcggtctcgaccctgcctgctggggcgtcaacgtgcagccctactcgtgcacgtctgccaacttggctgtctacactgggctccttcaacccaaggaccgcatcatggggctggagccaccgtcgggcggccatgttagccatggttactacacgcccagtggcaagaaggtgtcaggtgcctctattttcttcgagagcatgtcgtacaaggtgaacccacagactgggtatattgattacgacaagcttgaagaaagagcaatggatttccaccctaaaattctcatctgtggtgggagctcttaccccagagagtgggactttgcacggatgagattgattgctgataagtgtggtgcggtgcttctttgcgacatggcacatatcagtgggcttgtcgcagcaaaggaatgccgtagccctttcgactactgtgatgttgttacgtcaactactcacaagaatcttaggggccctagaggtggtataatattcttcaggaaagggaaaaatttaaggaaacgagctggatctttttctcaaggagatgagaatgaatacgacttcgaggataggataaattttggtgttttcccttcaatgcaaggagggccccataataatcatattgctggcttggctataactctgaagcaggtagcaacttctgaatataaagcatacattcaacaagtcaagaaaaatgctcaggctttggcatcagctttgatcagaagaaaatgcagattggttacaggtggcacagataatcacttagtactttgggacctcagaactcttggcttgactggcaagatcttcgagaaggtttgcgaggcatgccacatatctgtcaacaagacaccaatttatggagataatggctcgatatcgccaggtggtgtgcggattggaacacctgcaatgactactagaggttgcttagaagaggacttcgaggtgattgcagacttcctcataagggctactcaaattgctaacaatgttctgaaagaacatggcaaagtgcaaaaggagtttctaagaggcctacagaacaataatgatgttatagaactccgaaatcaggttgaggcatttgcgtcacagtttgcgatgccaggttttgatgtatga

SEQ ID NO: 9540 - protein, 588 aa, Zea mays
MDLSRPTSSDLSLGLHSHGHAHAHARRHAVAAPLRLFDDAEEPKPERVGAGEADAERDDEDGGDQHFSLLGHSLCVKRPRRAGNGGGGGETSSCSSTSAALRPAKRQATGEGSGADLETRRAAVRAWGNQSLAEADPDVHSLMEQELDRQVRGIELIASENFVCRAVLDALGSHLTNKYSEGAPGARYYGGNQHIDAIERLCHERALTAFGLDPACWGVNVQPYSCTSANLAVYTGLLQPKDRIMGLEPPSGGHVSHGYYTPSGKKVSGASIFFESMSYKVNPQTGYIDYDKLEERAMDFHPKILICGGSSYPREWDFARMRLIADKCGAVLLCDMAHISGLVAAKECRSPFDYCDVVTSTTHKNLRGPRGGIIFFRKGKNLRKRAGSFSQGDENEYDFEDRINFGVFPSMQGGPHNNHIAGLAITLKQVATSEYKAYIQQVKKNAQALASALIRRKCRLVTGGTDNHLVLWDLRTLGLTGKIFEKVCEACHISVNKTPIYGDNGSISPGGVRIGTPAMTTRGCLEEDFEVIADFLIRATQIANNVLKEHGKVQKEFLRGLQNNNDVIELRNQVEAFASQFAMPGFDV

SEQ ID NO: 9541 - DNA, 23 bp, Artificial sequence
  primer
atgccttacactctatccgacgc

SEQ ID NO: 9542 - DNA, 23 bp, Artificial sequence
  primer
ttacacagccaatgggtattcgc

SEQ ID NO: 9543 - protein, 506 aa, Artificial sequence
  consensus sequence
  Variant (2)..(4): Xaa in position 2 to 4 is any amino acid
  Variant (5)..(25): Xaa in position 5 to 25 is any or no amino acid
  Variant (27)..(28): Xaa in position 27 to 28 is any amino acid
  Variant (31)..(34): Xaa in position 31 to 34 is any amino acid
  Variant (42)..(43): Xaa in position 42 to 43 is any amino acid
  Variant (45)..(46): Xaa in position 45 to 46 is any amino acid
  Variant (48)..(49): Xaa in position 48 to 49 is any amino acid
  Variant (51)..(51): Xaa in position 51 is any amino acid
  Variant (54)..(55): Xaa in position 54 to 55 is any amino acid
  Variant (60)..(60): Xaa in position 60 is any amino acid
  Variant (66)..(66): Xaa in position 66 is any amino acid
  Variant (72)..(75): Xaa in position 72 to 75 is any amino acid
  Variant (77)..(78): Xaa in position 77 to 78 is any amino acid
  Variant (80)..(80): Xaa in position 80 is any amino acid
  Variant (82)..(84): Xaa in position 82 to 84 is any amino acid
  Variant (86)..(89): Xaa in position 86 to 89 is any amino acid
  Variant (91)..(95): Xaa in position 91 to 95 is any amino acid
  Variant (96)..(99): Xaa in position 96 to 99 is any or no amino acid
  Variant (104)..(104): Xaa in position 104 is any amino acid
  Variant (107)..(108): Xaa in position 107 to 108 is any amino acid
  Variant (109)..(110): Xaa in position 109 to 110 is any or no amino acid
  Variant (113)..(114): Xaa in position 113 to 114 is any amino acid
  Variant (116)..(117): Xaa in position 116 to 117 is any amino acid
  Variant (119)..(121): Xaa in position 119 to 121 is any amino acid
  Variant (123)..(123): Xaa in position 123 is any amino acid
  Variant (125)..(127): Xaa in position 125 to 127 is any amino acid
  Variant (129)..(130): Xaa in position 129 to 130 is any amino acid
  Variant (132)..(133): Xaa in position 132 to 133 is any amino acid
  Variant (138)..(138): Xaa in position 138 is any amino acid
  Variant (141)..(154): Xaa in position 141 to 154 is any amino acid
  Variant (155)..(166): Xaa in position 155 to 166 is any or no amino acid
  Variant (168)..(175): Xaa in position 168 to 175 is any amino acid
  Variant (176)..(176): Xaa in position 176 is any or no amino acid
  Variant (179)..(184): Xaa in position 179 to 184 is any amino acid
  Variant (186)..(189): Xaa in position 186 to 189 is any amino acid
  Variant (192)..(192): Xaa in position 192 is any amino acid
  Variant (194)..(195): Xaa in position 194 to 195 is any amino acid
  Variant (197)..(197): Xaa in position 197 is any amino acid
  Variant (201)..(204): Xaa in position 201 to 204 is any amino acid
  Variant (206)..(209): Xaa in position 206 to 209 is any amino acid
  Variant (211)..(211): Xaa in position 211 is any amino acid
  Variant (215)..(216): Xaa in position 215 to 216 is any amino acid
  Variant (219)..(219): Xaa in position 219 is any amino acid
  Variant (221)..(222): Xaa in position 221 to 222 is any amino acid
  Variant (227)..(228): Xaa in position 227 to 228 is any amino acid
  Variant (231)..(231): Xaa in position 231 is any amino acid
  Variant (233)..(233): Xaa in position 233 is any amino acid
  Variant (235)..(238): Xaa in position 235 to 238 is any amino acid
  Variant (240)..(245): Xaa in position 240 to 245 is any amino acid
  Variant (246)..(246): Xaa in position 246 is any or no amino acid
  Variant (249)..(249): Xaa in position 249 is any amino acid
  Variant (254)..(254): Xaa in position 254 is any amino acid
  Variant (262)..(262): Xaa in position 262 is any amino acid
  Variant (264)..(273): Xaa in position 264 to 273 is any amino acid
  Variant (274)..(293): Xaa in position 274 to 293 is any or no amino acid
  Variant (295)..(297): Xaa in position 295 to 297 is any amino acid
  Variant (301)..(301): Xaa in position 301 is any amino acid
  Variant (306)..(307): Xaa in position 306 to 307 is any amino acid
  Variant (309)..(309): Xaa in position 309 is any amino acid
  Variant (311)..(313): Xaa in position 311 to 313 is any amino acid
  Variant (317)..(319): Xaa in position 317 to 319 is any amino acid
  Variant (321)..(324): Xaa in position 321 to 324 is any amino acid
  Variant (327)..(327): Xaa in position 327 is any amino acid
  Variant (329)..(331): Xaa in position 329 to 331 is any amino acid
  Variant (333)..(334): Xaa in position 333 to 334 is any amino acid
  Variant (337)..(350): Xaa in position 337 to 350 is any amino acid
  Variant (351)..(366): Xaa in position 351 to 366 is any or no amino acid
  Variant (368)..(368): Xaa in position 368 is any amino acid
  Variant (372)..(373): Xaa in position 372 to 373 is any amino acid
  Variant (375)..(376): Xaa in position 375 to 376 is any amino acid
  Variant (378)..(378): Xaa in position 378 is any amino acid
  Variant (381)..(386): Xaa in position 381 to 386 is any amino acid
  Variant (387)..(388): Xaa in position 387 to 388 is any or no amino acid
  Variant (390)..(393): Xaa in position 390 to 393 is any amino acid
  Variant (394)..(395): Xaa in position 394 to 395 is any or no amino acid
  Variant (397)..(400): Xaa in position 397 to 400 is any amino acid
  Variant (402)..(403): Xaa in position 402 to 403 is any amino acid
  Variant (407)..(408): Xaa in position 407 to 408 is any amino acid
  Variant (410)..(410): Xaa in position 410 is any amino acid
  Variant (412)..(415): Xaa in position 412 to 415 is any amino acid
  Variant (416)..(420): Xaa in position 416 to 420 is any or no amino acid
  Variant (422)..(422): Xaa in position 422 is any amino acid
  Variant (424)..(424): Xaa in position 424 is any amino acid
  Variant (426)..(426): Xaa in position 426 is any amino acid
  Variant (429)..(429): Xaa in position 429 is any amino acid
  Variant (431)..(431): Xaa in position 431 is any amino acid
  Variant (434)..(460): Xaa in position 434 to 460 is any amino acid
  Variant (461)..(497): Xaa in position 461 to 497 is any or no amino acid
  Variant (499)..(504): Xaa in position 499 to 504 is any amino acid
  Variant (505)..(505): Xaa in position 505 is any or no amino acid
DXXXXXXXXXXXXXXXXXXXXXXXXEXXRQXXXXELIASENXXSXXVXXAXGSXXTNKYXEGYPGXRYYGGXXXXDXXEXLXXXRXXXXFXXXXXXXXXNVQPXSGXXXXANXXVXXAXXXPXDXXXGXXLXXGGHLXHGXXXXXXXXXXXXXXXXXXXXXXXXXXYXXXXXXXXXDYXXXXXXAXXXXPKXIXXGXSAYXXXXDXXXXRXIADXXGAXLXXDMAHXXGLXAXGXXXXPXXXXXXXVTXTTHKXLRGPRGGXIXXXXXXXXXXXXXXXXXXXXXXXXXXXXXXNXXXFPGXQGGPXXHXIXXXAVAXXXAXXXXFKXYXXXVXXNAXXXXXXXXXXXXXXXXXXXXXXXXXXXXXXVXGGTXXHXXLXDLXXXXXXXXGXXXXXXLXXXXIXXNKNXXPXDXXXXXXXXXGXRXGXPAXTXRGXXXXXXXXXXXXXXXXXXXXXXXXXXXXXXXXXXXXXXXXXXXXXXXXXXXXXXXXXXXXXXXXVXXXXXXXP

SEQ ID NO: 9544 - protein, 37 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(7): Xaa in position 7 is any amino acid
  Variant (8)..(9): Xaa in position 8 to 9 is any or no amino acid
  Variant (11)..(11): Xaa in position 11 is Ala, Cys or Val
  Variant (12)..(14): Xaa in position 12 to 14 is any amino acid
  Variant (15)..(15): Xaa in position 15 is Asp, Gly, Asn or Ser
  Variant (17)..(17): Xaa in position 17 is any amino acid
  Variant (18)..(18): Xaa in position 18 is Phe, Ile, Leu, Met or Val
  Variant (19)..(20): Xaa in position 19 to 20 is any amino acid
  Variant (22)..(22): Xaa in position 22 is any amino acid
  Variant (25)..(26): Xaa in position 25 to 26 is any amino acid
  Variant (28)..(28): Xaa in position 28 is Leu, Met or Val
  Variant (29)..(29): Xaa in position 29 is Ala, Ile or Val
  Variant (30)..(30): Xaa in position 30 is Ala, Ser or Val
  Variant (31)..(35): Xaa in position 31 to 35 is any amino acid
  Variant (36)..(36): Xaa in position 36 is Asp, Gly, Asn, Gln, Ser or Thr
  Variant (37)..(37): Xaa in position 37 is Ala, Pro or Ser
DXXXXRXXXIXXXXXAXXXXDXAHXXGXXXXXXXXXX

SEQ ID NO: 9545 - protein, 32 aa, Artificial sequence
  protein pattern
  Variant (2)..(3): Xaa in position 2 to 3 is any or no amino acid
  Variant (5)..(9): Xaa in position 5 to 9 is any amino acid
  Variant (11)..(15): Xaa in position 11 to 15 is any amino acid
  Variant (16)..(16): Xaa in position 16 is Asp, Glu, Gly or Ser
  Variant (17)..(18): Xaa in position 17 to 18 is any amino acid
  Variant (19)..(19): Xaa in position 19 is Ile, Leu, Met or Val
  Variant (20)..(20): Xaa in position 20 is Ala, Gly or Ser
  Variant (21)..(21): Xaa in position 21 is Phe, Leu or Met
  Variant (22)..(22): Xaa in position 22 is any amino acid
  Variant (23)..(23): Xaa in position 23 is Leu or Met
  Variant (24)..(25): Xaa in position 24 to 25 is any amino acid
  Variant (29)..(29): Xaa in position 29 is Ile or Leu
  Variant (30)..(30): Xaa in position 30 is Ser or Thr
AXXNXXXXXAXXXXXXXXXXXXXXXGGHXXHG

SEQ ID NO: 9546 - protein, 39 aa, Artificial sequence
  protein pattern
  Variant (3)..(3): Xaa in position 3 is any or no amino acid
  Variant (5)..(5): Xaa in position 5 is any or no amino acid
  Variant (10)..(11): Xaa in position 10 to 11 is any amino acid
  Variant (13)..(13): Xaa in position 13 is any amino acid
  Variant (15)..(15): Xaa in position 15 is Ala, Gly, Ser or Thr
  Variant (16)..(16): Xaa in position 16 is Ala or Gly
  Variant (17)..(17): Xaa in position 17 is any amino acid
  Variant (19)..(19): Xaa in position 19 is any amino acid
  Variant (20)..(20): Xaa in position 20 is Ala, Cys, Gly or Ser
  Variant (21)..(21): Xaa in position 21 is Phe or Leu
  Variant (22)..(28): Xaa in position 22 to 28 is any amino acid
  Variant (29)..(29): Xaa in position 29 is Phe, Trp or Tyr
  Variant (30)..(38): Xaa in position 30 to 38 is any amino acid
  Variant (39)..(39): Xaa in position 39 is Gly or Asn
FPXGXQGGPXXHXIXXXAXXXXXXXXXXXXXXXXXXXXX

SEQ ID NO: 9547 - protein, 16 aa, Artificial sequence
  protein pattern
  Variant (2)..(2): Xaa in position 2 is Ser or Thr
  Variant (7)..(7): Xaa in position 7 is Ser or Thr
  Variant (13)..(13): Xaa in position 13 is any or no amino acid
  Variant (15)..(15): Xaa in position 15 is any amino acid
  Variant (16)..(16): Xaa in position 16 is Ile, Leu, Met or Val
TXTTHKXLRGPRXGXX

SEQ ID NO: 9548 - protein, 13 aa, Artificial sequence
  protein pattern
  Variant (2)..(2): Xaa in position 2 is Ile, Leu or Val
  Variant (4)..(4): Xaa in position 4 is Phe, Ile, Leu, Met or Val
  Variant (6)..(6): Xaa in position 6 is Ala, Cys, Ser or Thr
  Variant (9)..(9): Xaa in position 9 is any amino acid
  Variant (11)..(12): Xaa in position 11 to 12 is any amino acid
GXRXGXPAXTXXG

SEQ ID NO: 9549 - protein, 15 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (7)..(7): Xaa in position 7 is Asp, Glu or Lys
  Variant (8)..(8): Xaa in position 8 is Cys, Asp, Asn, Ser, Thr or Val
  Variant (10)..(11): Xaa in position 10 to 11 is any amino acid
  Variant (13)..(13): Xaa in position 13 is any amino acid
  Variant (14)..(14): Xaa in position 14 is Asp, Asn or Ser
  Variant (15)..(15): Xaa in position 15 is Phe, Leu, Met or Val
VXXGXTXXHXXLXXX

SEQ ID NO: 9550 - protein, 11 aa, Artificial sequence
  protein pattern
  Variant (2)..(2): Xaa in position 2 is any amino acid
  Variant (3)..(3): Xaa in position 3 is Ile, Leu, Met or Val
  Variant (4)..(4): Xaa in position 4 is Ile or Leu
  Variant (5)..(5): Xaa in position 5 is Ile, Leu or Val
  Variant (6)..(6): Xaa in position 6 is Ala, Cys, Gly, Thr or Val
  Variant (8)..(8): Xaa in position 8 is any amino acid
  Variant (9)..(9): Xaa in position 9 is Ser or Thr
PXXXXXGXXAY

SEQ ID NO: 9551 - DNA, 1788 bp, Saccharomyces cerevisiae
  CDS (1)..(1788)
atgcctaccgtctccgtgaacaagcagcaattatttgatcttctaggcaaaaactacacttcccaagagttcgatgaattatgttttgaattcggtatggaaatggacgaagacaccacagaggaggccttgaaaaccggggaggagccggaattgaagcttgatatcagtgccaatcgttacgatttgctttgtatcgaaggtatttcacagtcgctgaacgaatacttggaacgtaaagaaagacctgactataaattaagcaagccaaccactaagttgatcatcgacaaatcaacggagcaaattagaccttttgctaccgctgctgtattgagaaatatcaagcttaacgaaaaatcttacgcttcttttattgccttgcaagataaattacatgccaatctatgtagaaacagaagcttggttgccatgggtactcacgatttagattcaattgaaggtccattccattacagagctctaccaccaaaggacatcaagttcgtaccattgaatcaaacccaagagtttactggtgacaaattgatcgagttttataaatctccagaacagaaaaacaacatagggagatacgttcacattattgaggattctccagtcttcccagttattatggacagcaaagatcgtgtttgctccctgccaccattaatcaatagtgaacattcgaagatctctgtgaacacccgtaacattttgattgatataaccgccaccgataagaccaaagccgagatcgttttgaacatattaactacaatgttctcacgttattgtgacgaaccattcacggttgagcctgtagaaattgtctctgaacacaatggccaatcccgtttggcgccaaacttcaacgatagaattatggatgtctccattaagtacatcaactcctgtcttggcctagatcaatccgctgatgaaattgctcattgtctaaagaagatgtcgttgcatgccgttcaatcaaaggaagacaaggacatcttgcacgttgacattccggtaactagacctgatattttgcacgcttgtgatataatggaagatgccgctgtcggttatggtttcaataatttgccaaagggtgagaaattatccaatgccaacttcattgccaaaccattaccaatcaacaaggtttctgatattttcagagttgcatcctctcaagccacgtgggttgaggttttaccattgaccttatgttcgcacgatgaaaactttaaatttctaagacaatccgacaatggtgatttagctgtcaaattggccaacccaaagactttggaataccaagttgttagaaccactttattgcctggtatcttaaagacagtcaaggaaaacagaaaacattccttgccaatcaaagtctttgaaaccggtgacgttgtatttaaagacgacaaactagaaaggaaggcgtacaatgaacgtcactgggctgccatctacgtgggtaagaattctgggtttgaaatcattcaagggttattgggtaaaatcatgcaaacttttagaacagagtggattgcagactacggtgctgctgcttctggcagaggttactggattgaagaagacgattctgtgaaaacctacttcccaggtagaggtgccaaggtcatgttcagatccaaagaaggcgctgagccaaagcaaatcggccacttgggtgtcttgcatcctgaagtcatgatgaatttcgacgttccattcgctgcatcctttgtagaggttaatgccgaagtcttcctataa

SEQ ID NO: 9552 - protein, 595 aa, Saccharomyces cerevisiae
MPTVSVNKQQLFDLLGKNYTSQEFDELCFEFGMEMDEDTTEEALKTGEEPELKLDISANRYDLLCIEGISQSLNEYLERKERPDYKLSKPTTKLIIDKSTEQIRPFATAAVLRNIKLNEKSYASFIALQDKLHANLCRNRSLVAMGTHDLDSIEGPFHYRALPPKDIKFVPLNQTQEFTGDKLIEFYKSPEQKNNIGRYVHIIEDSPVFPVIMDSKDRVCSLPPLINSEHSKISVNTRNILIDITATDKTKAEIVLNILTTMFSRYCDEPFTVEPVEIVSEHNGQSRLAPNFNDRIMDVSIKYINSCLGLDQSADEIAHCLKKMSLHAVQSKEDKDILHVDIPVTRPDILHACDIMEDAAVGYGFNNLPKGEKLSNANFIAKPLPINKVSDIFRVASSQATWVEVLPLTLCSHDENFKFLRQSDNGDLAVKLANPKTLEYQVVRTTLLPGILKTVKENRKHSLPIKVFETGDVVFKDDKLERKAYNERHWAAIYVGKNSGFEIIQGLLGKIMQTFRTEWIADYGAAASGRGYWIEEDDSVKTYFPGRGAKVMFRSKEGAEPKQIGHLGVLHPEVMMNFDVPFAASFVEVNAEVFL

SEQ ID NO: 9553 - DNA, 1779 bp, Candida albicans
  CDS (1)..(1779): transl_table=12
atgccaactattcctgtagacaaagaagaccttttcaagttattgggtagatcatatactacagaagaatttgacgagttatgtttccaatttggtattgagttagatgaggataccactgaagatgtcaaaggtacagacgaaagaccacaattgaaaattgaagttcctgccaacagatacgatatgttatgtattgagggtattgctcaagctttaaatgaatttttaggtaacacatcagcaccaaattacaaattgagtcctagcaaaccagagatttctttgactattaaagaatcaacctacccaattcgtcaatatgctgccagtgcgattttgagaaacgtgaaactcgatgaaagagcctatgactcttttatttccttacaagataaattacatgcaaatttatgtcgtaacagaactttagtggctattggtactcatgatttagatactttgacaccaccatttacctatgaagccttggcacctaaagatattgttttcaaaccattaaatcaaactaaagaaatcaatggtgaagaattaatggagttctatgaaaaagataagaatattggtaagttcttgcatattattaaggattcgccagtttatcctgtcatgcttgatgccaatagaacagttgcttcgctcccaccaatcatcaatagtgatcactccaaaatcactttaaacaccaagaatgtttggattgatgtcaccggtactgatagaaccaaaactgaaattgttataaaccaattagtggccatgttttcacgttattgtaaggaaccttttgaaattgaaccaattcaaatcatttctgaacacaataatgaaactcgtgtatgtccaaatatcactccaagaacagctaaggctgagatttcatacatcaattcctgtgtaggattggattactcaggtgaagaaatctcaaagttgttgaaaaaaatgtcattagatgctaccccatctactgaagagagagacatactcgatgtgaaaatcccaataacaagatctgatatcttgcaccaatgtgatattatggaggatgtcgctattgggtacgggtacgataatttgaagaagaccaaacctaaggctgaaagtttagttgctgccccattacctgtaaataaagttgctgatattttaaggttggcaagttctcaagctggttatttagaagtcatgcctttgactttatcttctcacgatgagaattttgcttggttgaaacagaaggatgatggtaccaaagctgttaaattggaaaatccaaagacaattgaataccaagttgttagaactactttattacctggtattttaaaaaccgttaaagaaaacagaaaacactcgttaccaatcaaagtatttgaatgtggtgatattgttttgaagaatccagaattagaaagaggtgcttttaaccaacgtaattgggctgccttgtccgtaggtcagacttctggtttcgaaatggtccaaggtttattaggaaagatcatgcaaaccatgagaactccttggttagaaaatccttctaaggatcaaagaagaggttactggatagaggaagacaaagaaaacacaactttcttcccaggaagaggagccaagatttatttcagaaatgccgataatgctgaagccaaagctattggaagcattggtgttttgcatccagaagtaatgaataactttgacattccttatgcagcatcgtctgttgaaataaacgctgaagtatttttgtaa

SEQ ID NO: 9554 - protein, 592 aa, Candida albicans
MPTIPVDKEDLFKLLGRSYTTEEFDELCFQFGIELDEDTTEDVKGTDERPQLKIEVPANRYDMLCIEGIAQALNEFLGNTSAPNYKLSPSKPEISLTIKESTYPIRQYAASAILRNVKLDERAYDSFISLQDKLHANLCRNRTLVAIGTHDLDTLTPPFTYEALAPKDIVFKPLNQTKEINGEELMEFYEKDKNIGKFLHIIKDSPVYPVMLDANRTVASLPPIINSDHSKITLNTKNVWIDVTGTDRTKTEIVINQLVAMFSRYCKEPFEIEPIQIISEHNNETRVCPNITPRTAKAEISYINSCVGLDYSGEEISKLLKKMSLDATPSTEERDILDVKIPITRSDILHQCDIMEDVAIGYGYDNLKKTKPKAESLVAAPLPVNKVADILRLASSQAGYLEVMPLTLSSHDENFAWLKQKDDGTKAVKLENPKTIEYQVVRTTLLPGILKTVKENRKHSLPIKVFECGDIVLKNPELERGAFNQRNWAALSVGQTSGFEMVQGLLGKIMQTMRTPWLENPSKDQRRGYWIEEDKENTTFFPGRGAKIYFRNADNAEAKAIGSIGVLHPEVMNNFDIPYAASSVEINAEVFL

SEQ ID NO: 9555 - DNA, 1791 bp, Oryza sativa (japonica cultivar-group)
  CDS (1)..(1791)
atgccgacggtgagcgtcggccgggaccgcttcttcgtcgccctcggaaggacatacacgcaggaggagttcgaggtgctctgcttcgagttcggcatcgagctcgatgacgtgaccacggagaaggccatcatccggaaggagaagcacctggaggatgatgacggcgaggtggatggtgatgacgacgaggtcatctacaagatcgaggtcgccgccaataggtatgatttgttatgtcttgaaggattggcaagggccctccgcattttcactgggactgaagcgacccctatgtacaaaatttcttgcatccctcgcgattcaatgcttctgatgcatgttaaacctcagacttcacaaataaggccctatgtggtctgtgctgtccttagaggggtaactttcgatgaagcaagatataacagcttcatcgatcttcaagacaaactccatcaaaatatttgcaggaagagaactctggtggccataggtacccacgatcttgacactctgaaaggacccttttcatatgaggctctaccaccacaagagatcaactttgtcccattaaagcaggaggaaagcttcagggctgataaactgatggaattctataaatcagacatgaagttgaagaagttcctgcatataattgagaattcgccagtatacccagttatttatgatagcaacaggaccgtattgtctttaccaccaatcatcaatggtgcacattctgctatcactctgaagacaaggaatgtgtttattgagtgtaccgctactgaccttacaaaagcaaagattgttctcaatacaatggtcacaatgttctctgagtactgcgaaaacaagtttgaagtggaaccagttgaagttgtgtcacatgatggaagcaaaaccatttaccctgacctttcatgctataaaatggaggtctcactatctgaggttgttggacccattggcatctccctagatgagacaaaggttatttcccttctgaacaaaatgcagttgcaagctgaaagttgtccatcaaaaggggaaccacgtatttcagtttctgtccctccaacaagaagtgacattctgcatgctcgtgatttggtggaggatgttgctatagcttatggttacaacaatgtgccaaaatcaaagccaaagtgtatgacaataggaggaaggcaaccattaaaccgtttctctgataaacttcgtgctgaggttgcaagagctggttatatggaggtgctcacatttaccttgtgttcacgtgaagaaaactttgacatgttaaataggacacaggatgtaaataaagcagttattattgcgaatccacgcacttctgaatttgaggtggttcgaaccagtctgatgtcatgtttattgaaaactttgaagcataacatagaccatccaagacccataaagatatttgaagttggtgatgtagtgacattggatgggtcacgtgatgttggtgcttctaataatcgtcgactcgcagctttgtactgtaataagcagtctgggtttgaggaaattatgggtttggtagatagaatcgtgaatgttgtgagagctccccacatcaaatttggccagaattactatgttcctacaaatgaacctgaattctttccgaaaagacaatgcaaaattgttatgagtgatggaaagcagattggctacttaggaattgtgcatgccgaggtcctaaggaaattcggcattccagacccctgcactttcgttgagattgacgttgaggctttgttatag

SEQ ID NO: 9556 - protein, 596 aa, Oryza sativa (japonica cultivar-group)
MPTVSVGRDRFFVALGRTYTQEEFEVLCFEFGIELDDVTTEKAIIRKEKHLEDDDGEVDGDDDEVIYKIEVAANRYDLLCLEGLARALRIFTGTEATPMYKISCIPRDSMLLMHVKPQTSQIRPYVVCAVLRGVTFDEARYNSFIDLQDKLHQNICRKRTLVAIGTHDLDTLKGPFSYEALPPQEINFVPLKQEESFRADKLMEFYKSDMKLKKFLHIIENSPVYPVIYDSNRTVLSLPPIINGAHSAITLKTRNVFIECTATDLTKAKIVLNTMVTMFSEYCENKFEVEPVEVVSHDGSKTIYPDLSCYKMEVSLSEVVGPIGISLDETKVISLLNKMQLQAESCPSKGEPRISVSVPPTRSDILHARDLVEDVAIAYGYNNVPKSKPKCMTIGGRQPLNRFSDKLRAEVARAGYMEVLTFTLCSREENFDMLNRTQDVNKAVIIANPRTSEFEVVRTSLMSCLLKTLKHNIDHPRPIKIFEVGDVVTLDGSRDVGASNNRRLAALYCNKQSGFEEIMGLVDRIVNVVRAPHIKFGQNYYVPTNEPEFFPKRQCKIVMSDGKQIGYLGIVHAEVLRKFGIPDPCTFVEIDVEALL

SEQ ID NO: 9557 - DNA, 1674 bp, Encephalitozoon cuniculi GB-M1
  CDS (1)..(1674)
atgccgacgctggtggcagagaaaaagaggatacaagacctacttggcatggaccttggggatcgtcgctttgaaaagattctgtttgactttggactggagcttgacgatgtagtggaggaggaagggaaaaccatgtacagaatagagatccctgccaaccgatacgatctcctctgtgccgaggggctctgctatgcactgagggcgtttctctcgatggagacatacgaggatatagatgttgaggagggggaggttgttgtctacaagactggaggggaggaaagaccgtgcatagcatgcgcagttatcaagggcgtggatcttctgtctgaaggagcctataaaagcttcattgactaccaagataagcttcacctgacgattggaaggaacagggcattggtctcgatggggacccatgatctcgacaagattaaggggcctgtcttctacaaaagcgagacgcccgagcgaatcggattcaagcccttgaatgcagaaagagaggtgaatggaaaggagctaggttctcgctttccgcctggaagcaagatcggaaggtacatgaggcttattgagaagaacgagaagtatcccctctttgaagactctatgggaacgattatgtccttgccgccgataataaactctgatgcaactaaaataagccctgggaccaagaatgtgtttgttgaaatgacaggaaccgatttccacagggttaatacggcgctgaagttgctcctagggtgttttcgaggaaggaagatagagagtgttgagattcggaatggaaacgagaggaccagaacgccggtcatgcataatcgctcgtatgtgatggggctgggggaaattaacaggagccttgggctggatctgtcgttgtcagcagcaaagtcatacatggagagaatgatgcatagcgtcgacacgattgatgaaagcactctcagggttagggtgcatgacatcaggtcggacgttcttcacaagtgcgaccttattgaggacattgctattgcacacggattcaacaacttcaggagagagctgccatcgttcttcacagccgggtctgagattcctctaaacaagttttcggacaagctccggactgaactctccattatgggctttgacgaagccttaacactcacactcctgtcccgtgaggagaatgtgattgacggagaccaagcagttgtgcttatgaacccgaagtcggctagctacgaggtttgcagaacctctctcattccagggctaatgaagacagtggcctcgaacctgcacatgaaaatcccattcaggctgtttgaagtctcagatgtcgtccttttagacaaggagaatgagtgtggggcatcaaattcaaggagactggcagccatgtactgcggacacactccatgtcttgaggaagtccagggctctctgtctcttcttctgaagaaatgtggagtgcgccattcatacagcacccacaacgactccgctaggtatcttaagaaccaaagtgccctggtgattgtagaagatgctgccatcggatcgataggcgtatgcaacccggagatatgcaagacgttcagagttccgtatgcagcatcattctttgagatagatgtcgagaagctcctttcgatctatatggccaggacctga

SEQ ID NO: 9558 - protein, 557 aa, Encephalitozoon cuniculi GB-M1
MPTLVAEKKRIQDLLGMDLGDRRFEKILFDFGLELDDVVEEEGKTMYRIEIPANRYDLLCAEGLCYALRAFLSMETYEDIDVEEGEVVVYKTGGEERPCIACAVIKGVDLLSEGAYKSFIDYQDKLHLTIGRNRALVSMGTHDLDKIKGPVFYKSETPERIGFKPLNAEREVNGKELGSRFPPGSKIGRYMRLIEKNEKYPLFEDSMGTIMSLPPIINSDATKISPGTKNVFVEMTGTDFHRVNTALKLLLGCFRGRKIESVEIRNGNERTRTPVMHNRSYVMGLGEINRSLGLDLSLSAAKSYMERMMHSVDTIDESTLRVRVHDIRSDVLHKCDLIEDIAIAHGFNNFRRELPSFFTAGSEIPLNKFSDKLRTELSIMGFDEALTLTLLSREENVIDGDQAVVLMNPKSASYEVCRTSLIPGLMKTVASNLHMKIPFRLFEVSDVVLLDKENECGASNSRRLAAMYCGHTPCLEEVQGSLSLLLKKCGVRHSYSTHNDSARYLKNQSALVIVEDAAIGSIGVCNPEICKTFRVPYAASFFEIDVEKLLSIYMART

SEQ ID NO: 9559 - DNA, 1755 bp, Arabidopsis thaliana
  CDS (1)..(1755)
atgccaaccatcagtgttggcagagaccgtttgttcgctgctcttggagaatcctatactcaggaaaaattcgaggaactgtgtttcagtttcggtatcgagcttgacgatgtgactactgaaaaggcaataatcagaaaagagaagcacatcgatgaagaagctgatgatgatgaagaaatcatctacaagattgaaattcctgccaacagacctgatttgctttgcctcgaagggcttgctcaatctcttcgcgttttcatcgagaaacaggagataccaacgtatactcttgctgacattagcaaagacaagatccttcaaatgaatgttaaacctgagacatcgaagattcgtccatttgttgtatgtgctgttttaagaggtgtaacctttgacgaggctcgttacaacagcttcattgatcttcaggataagttacatcagaatatttgcaggcgaaggtccttggttgctattggaactcatgaccttgatacattgcagggtcctttcacatacgaggctttgccgccaacggatataaattttgtacctttgaagcaaacaaagagcttcagggctgacgaacttattgaattctacaagtctgatatgaagctgaaaaagtttctacacataatcgagaattcacccgtcttccctgttttatacgacagtaagagaactgtgctgtcattgccacctattatcaatggtgcacattcagcaattaccttacagacaaagaatgtcttcattgaatgtactgcaactgatttgacgaaggccaagattgttttgaatacaatggttacaaccttctcagaattttgtgccagaaaatttgagattgagcctgttgaagttacatacgacgatggaaagtcatacatctatccggatttagctgtctatgatatggaagttcctctctctttcattacagactcaattggagtctctttaaaggtggaacaggttacaagtctgctgacccgaatgcagctgcaagctgagcaagcaaaatctagtgataaccagtgtgccatcaaagtacatgtaccccccagcaggagcgacgttctccacccttgtgatgttatggaggatgttgccattgcctatggtttcaataacattccaacaagaaagcctgcttcgataaaaccactgactttgaatgagctcactgatcttctaagaatagagattgcgatgtgtgtgtacacggaggtggtaacgtggctactatgctcacataaggaaaactttgcgatgctaaatagagaggatgttaattcagccgtcatagttgggaacccgcggtctgctgattttgaggccatgaggagggctctcatgcccggattattgaagacagttggtcacaacaataaataccctaaaccaattaagatttttgaaatcagtgatgtggtcatgttggatgagagcaaagacgttggtgcatccaatcgtcgccatctcgctgcactatactgtggtgctacttctggatttgagcttatccatggcctggtcgataggatcatggaagtgatggcaataccatttctaacaatccatgaaaataacgtaccaatcaatgaaaaagacggatactatgtaaagctctcccaagaacccgagtttctaccgggcaggcaagctagcatcattgtcagagggaaacatattggtaactttggaatcgtgcatcctgagtttccatcaggttttgaacaactttga

SEQ ID NO: 9560 - protein, 584 aa, Arabidopsis thaliana
MPTISVGRDRLFAALGESYTQEKFEELCFSFGIELDDVTTEKAIIRKEKHIDEEADDDEEIIYKIEIPANRPDLLCLEGLAQSLRVFIEKQEIPTYTLADISKDKILQMNVKPETSKIRPFVVCAVLRGVTFDEARYNSFIDLQDKLHQNICRRRSLVAIGTHDLDTLQGPFTYEALPPTDINFVPLKQTKSFRADELIEFYKSDMKLKKFLHIIENSPVFPVLYDSKRTVLSLPPIINGAHSAITLQTKNVFIECTATDLTKAKIVLNTMVTTFSEFCARKFEIEPVEVTYDDGKSYIYPDLAVYDMEVPLSFITDSIGVSLKVEQVTSLLTRMQLQAEQAKSSDNQCAIKVHVPPSRSDVLHPCDVMEDVAIAYGFNNIPTRKPASIKPLTLNELTDLLRIEIAMCVYTEVVTWLLCSHKENFAMLNREDVNSAVIVGNPRSADFEAMRRALMPGLLKTVGHNNKYPKPIKIFEISDVVMLDESKDVGASNRRHLAALYCGATSGFELIHGLVDRIMEVMAIPFLTIHENNVPINEKDGYYVKLSQEPEFLPGRQASIIVRGKHIGNFGIVHPEFPSGFEQL

SEQ ID NO: 9561 - DNA, 1665 bp, Methanococcus maripaludis S2
  CDS (1)..(1665): transl_table=11
gtgcctacaattaacgtgaataaagtagatttggaacgattgagcaatatttcgctttcggacaaattaatagaagatagattcccaatgatgggtgttgaagtagaagaaatattcgaagaagtcgataaaaacgggaaaaaacagaacatggtgcagttttcaataaatcctgataggccagattatttaagtgttgaaggccttgcaagaggttttagaggatttatgggaattactacaggaatccaagaatttgaagtacttgattcagacattaaagtaactgttgaagaaaatgaaacaagaccttatgttgcatttgcacttgttaaaaatgttttaatggatgaattcgtccttgaaagcatgattaaccttcaggaaaagttgcactgggcaattggaagagatagaaagaaacttgcaattggaattcacgactttgataaagtaaaagctccatttacttacaaagaaatcaaaggggatgaaattaaatttgttcctttaggttatgaagacgaagaaatgactccaagagaaattattgaaaaacacgaaaaaggaataaaatacgctcatttaattcaaaacgataaattcccaattattctcgatgcaaatggcgaagttctatccctcccaccaataatcaatggaactttaacaaaagtaactccaacatctaaaaacttacttatcgacattactggaactgaaaaggaagctgttgaagaaacattaaacattatagtctgtgcacttgtagaaagacgcggaaccattgtttcagttaatgttaacgggaaaaaatacccggatttgactccaaaatcaagaataatttctgtcgaatcaattaataaaaaattaggactaaatttaaatcctggagaaataattcaggcacttaaaaaatcaggaatggatgcactctacgaagatggaaacttaattgtaaaaattcctgcgtacagaaatgatatcctacaaaacgttgatttaaaagaagaaattgctataaactacggatatgaaaaattcgacggaaaattgccatcagttgcaactactggctcaaaagatcctgttgagaaaaaatgtagtgcaatgtctgatttaatgattggacttggattctacgaagttatgaatttaaccctttcaaatcaggatactttgtttgaaaagatgaatttaaaagtagatgaaaaagactacatcgaagttttaaaacctgcttcaatcgaacacagggttcttagaacttcaattttaccacttcttttagaaacgctctacattaacaaacacaacgctcttcctcaaaaaatatttgaagttggtgactgtgtagttatcgatgaagaagatactgaaactgatacaaagtgtaaaaatatcaagaaaattgcgggtgcaataacacatcctttaacgaactttaacgaaataaaaagctcaactgaagcacttctaagggaattttttgaaggttttgaatttgaaaactatgaacacccagcattcatacctggaagatgtgcaaaaatacttaaaagtggaaaagaagttggattctttggggaaatacaccctgaagttattttaaacttcgaactcgaacatccagtagttggatttgaaataacaattgaataa

SEQ ID NO: 9562 - protein, 554 aa, Methanococcus maripaludis S2
MPTINVNKVDLERLSNISLSDKLIEDRFPMMGVEVEEIFEEVDKNGKKQNMVQFSINPDRPDYLSVEGLARGFRGFMGITTGIQEFEVLDSDIKVTVEENETRPYVAFALVKNVLMDEFVLESMINLQEKLHWAIGRDRKKLAIGIHDFDKVKAPFTYKEIKGDEIKFVPLGYEDEEMTPREIIEKHEKGIKYAHLIQNDKFPIILDANGEVLSLPPIINGTLTKVTPTSKNLLIDITGTEKEAVEETLNIIVCALVERRGTIVSVNVNGKKYPDLTPKSRIISVESINKKLGLNLNPGEIIQALKKSGMDALYEDGNLIVKIPAYRNDILQNVDLKEEIAINYGYEKFDGKLPSVATTGSKDPVEKKCSAMSDLMIGLGFYEVMNLTLSNQDTLFEKMNLKVDEKDYIEVLKPASIEHRVLRTSILPLLLETLYINKHNALPQKIFEVGDCVVIDEEDTETDTKCKNIKKIAGAITHPLTNFNEIKSSTEALLREFFEGFEFENYEHPAFIPGRCAKILKSGKEVGFFGEIHPEVILNFELEHPVVGFEITIE

SEQ ID NO: 9563 - DNA, 1830 bp, Gibberella zeae PH-1
  CDS (1)..(1830)
atgcctaccatctccgtcgacaagtacaagctttacgaagccctcggtcaaaaattcacaaccgaggaattcgaggacctctgcttcgagttcggcattgagctggacgaggatacggaaaacgatgagcgtcccattgtgaacggcgagcaagagcctccccagctcaagattgagattcccgccaaccgatatgacatgctctgcttcgagggtattgtttccaacctcaatgtcttccgcggcaagactgagccccccaaataccgccttgtcgatccctctagcggcaagctagagtcaatcactgtcaagcccgaagccgaacaggtccgaccatacgtctctggtgccatcctgcgcaacatcaaattcgacaagagcagatacgagtctttcattgctctacaagataagcttcaccagaacctggcccgaaaccgaacgctcgtttccattggtacccatgattacgatactatcaagggtcctttcacctatgaggctctgcctcccaaggatatcaagttcacccccttgaaccagaccaaggagatggattctgctgagctgatgagcttctatgagaacgacaagcacctgggtcgtttcctccacatcattcgcgactctcctgtctaccctgccatttacgactcaaaccgtgtcgtctgctctctcccccctatcatcaacggcgaccactccaagatcacacttgacaccacaaatgtgttcattgagatcaccgccactgaccttaccaagctcgatatcgtcaccgacatcatggtcactatgttctccatgtactgctccgagcctttcaccgttgagcctgtccagatcaactctgaccacaacaaccagacccgtatcactcctaacctgaagcccagagttgctgaggttgagattgattacctcaacagctgcaccggccttaacgagtccccagagagcctgtgcaagctcctctccaagatgtcatacacttctaccccttcatcaaaagacgcaaacatcctcgaggttgctatccccccaaccagagccgatgttctccaccaatgcgatgttatggaggatcttgctgtgtgctacggctacaacaacctgcctcgtactgcgccctcacgaagtgctaccgttggtgcgcctctacctgtcaacaagctcagcgatattattcgaatcgagacggctgttgctggctggagtgaggtcatgcctttgatcctctgcagtcacgacgagaactttgcttggctcaaccgtaaagatgatggtaacactgtcgtgcgcctggccaaccccaagactgccgagtatcaagtcgtacgatcaagccttctccctggtcttctcaagaccatccgcgagaacaagggccacagcgtccccatgaagatcttcgaggtctcggatgttgttttcaaggatgagacccaagagcgcaaggctcgcaacgagcgacattttgctgctgcctggtacggccgaaccagtgggtttgaggtagtccatggccttcttgaccgtatcctgctcatgctccgcacatccttccttacccatgaggaaggcctgtccggtaagagtattgatttcgaggttaaggagaaccccagcaagcccgatggctactggatcgaggagctcgatgatgctacattcttcgctggccacgctgcctctgtgtacctccgtctcggtggaaaggagagacgcgtgggcgagtttggtattctgcaccctagcgtgttggagaagtttgatttgaaataccctgttagcactctcgagattaaccttgaggttttcctgtaa

SEQ ID NO: 9564 - protein, 609 aa, Gibberella zeae PH-1
MPTISVDKYKLYEALGQKFTTEEFEDLCFEFGIELDEDTENDERPIVNGEQEPPQLKIEIPANRYDMLCFEGIVSNLNVFRGKTEPPKYRLVDPSSGKLESITVKPEAEQVRPYVSGAILRNIKFDKSRYESFIALQDKLHQNLARNRTLVSIGTHDYDTIKGPFTYEALPPKDIKFTPLNQTKEMDSAELMSFYENDKHLGRFLHIIRDSPVYPAIYDSNRVVCSLPPIINGDHSKITLDTTNVFIEITATDLTKLDIVTDIMVTMFSMYCSEPFTVEPVQINSDHNNQTRITPNLKPRVAEVEIDYLNSCTGLNESPESLCKLLSKMSYTSTPSSKDANILEVAIPPTRADVLHQCDVMEDLAVCYGYNNLPRTAPSRSATVGAPLPVNKLSDIIRIETAVAGWSEVMPLILCSHDENFAWLNRKDDGNTVVRLANPKTAEYQVVRSSLLPGLLKTIRENKGHSVPMKIFEVSDVVFKDETQERKARNERHFAAAWYGRTSGFEVVHGLLDRILLMLRTSFLTHEEGLSGKSIDFEVKENPSKPDGYWIEELDDATFFAGHAASVYLRLGGKERRVGEFGILHPSVLEKFDLKYPVSTLEINLEVFL

SEQ ID NO: 9565 - DNA, 1788 bp, Candida glabrata CBS 138
  CDS (1)..(1788)
atgcctaccgtttctgtgaataagcagcagttgtttgatctgctgggcaagaactacaccaatgatgagtttgatgagttgtgtttcgagttcggtattgaactggatgaagataccactgaggaagcattgaaaaccggtgaagaaccagagctaaagattgaaattggtgccaaccgttatgatctgttgtgtattgaaggtattgcccaatctttgaacgagtaccttggtagaagctccactcctacttacaagttgactgcgccaaccacaaagctatacatagaaaagtccactgagcaagttagaccatacgcaactgctgcgatcctaagaaacttcaagttcacagagaagaactacgcttctttcatcgccctgcaggataaattgcactccaacttgtgtagaaacagatcgttggttgccatcggtacccacaatttagattctattcaaggaccattttactacaagggtctagcaccaaaggagattaacttcattcctctaaaccaaactaagaagttcaatggtgaagaattgattgaattttacaaaaccccagaacaaaagaacaacattggtagatttgtgcatatcattgagaactcaccagtctacccagttatcctagactccaacgatgtcgtctgctctttgcctccattgatcaactctgaacattctaagatcaacttggagaccaagaacattttcattgaaattaccgccaatgataagaccaaggctgagatcgttctaaaccaaatggtagccatgttttctcgctactgtgacgaaccatttaccgtggaaccagttgaaattgtctctgaacacaacggtgagtcccgtatggctcctgatttctctgagagaaagatggatgtttccattccatacataaactcagctctaggtctgcaacaaacaccagaagaaatcattcaatgcataaagaagatgtctctacatggtgaagcatccaagacagacgaggctgttttacacgtcactatcccaatcacaagaccagatgtcctgcatccatgtgacatcatggaagatgctgccattggttatggttacaacaacttgccaaagggtgaaaagctatcaaatgctaacttcattgcttctccactacctattaacaagatttcagatattttccgtgtggcttcttcccaagcttcatggttagaagttcttccactaactctatgttctcatgacgaaaacttcaagtttttgagactagaagacgacggtaagcaagtggtaaaactagagaaccctaagacacttgagtaccaggtcgttagaacaactttactaccaggtatactgaaaacagttaaagaaaacagaaagcactctttacctatcaaggtcttcgagactggtgatgtagttttcaagaatgaggctctagagagaaagtcatacaacgagcgtcactggggtgctatttacgccggtaagaactccggtttcgaaatcattcaaggtcttctaggtaagatcatgcaaactttccgcacccagtgggttgccgactacggtaaggcttccaccggcagaggttactggattgagcaagatgataccttggctacatacttcccaggcagaggtgccaagatcatgttccgcagcaaagaaggtgagcaagctaaacaaatcggtcacttgggtgtcctacatccagaggtcatgagcaactttgaggtcccatacgctgcatcctacgttgaattgaacgctgaagttttcttgtaa

SEQ ID NO: 9566 - protein, 595 aa, Candida glabrata CBS 138
MPTVSVNKQQLFDLLGKNYTNDEFDELCFEFGIELDEDTTEEALKTGEEPELKIEIGANRYDLLCIEGIAQSLNEYLGRSSTPTYKLTAPTTKLYIEKSTEQVRPYATAAILRNFKFTEKNYASFIALQDKLHSNLCRNRSLVAIGTHNLDSIQGPFYYKGLAPKEINFIPLNQTKKFNGEELIEFYKTPEQKNNIGRFVHIIENSPVYPVILDSNDVVCSLPPLINSEHSKINLETKNIFIEITANDKTKAEIVLNQMVAMFSRYCDEPFTVEPVEIVSEHNGESRMAPDFSERKMDVSIPYINSALGLQQTPEEIIQCIKKMSLHGEASKTDEAVLHVTIPITRPDVLHPCDIMEDAAIGYGYNNLPKGEKLSNANFIASPLPINKISDIFRVASSQASWLEVLPLTLCSHDENFKFLRLEDDGKQVVKLENPKTLEYQVVRTTLLPGILKTVKENRKHSLPIKVFETGDVVFKNEALERKSYNERHWGAIYAGKNSGFEIIQGLLGKIMQTFRTQWVADYGKASTGRGYWIEQDDTLATYFPGRGAKIMFRSKEGEQAKQIGHLGVLHPEVMSNFEVPYAASYVELNAEVFL

SEQ ID NO: 9567 - DNA, 1788 bp, Kluyveromyces lactis NRRL Y-1140
  CDS (1)..(1788)
atgcctaccatttcagttaacaagaggcaattgtttgaggccttgggcaaaaactacaccaatgaagaattcgatgaattatgttttgaatttggtgttgaattagatgaagataccactgaagaagctttgaagacaggcgaggaaccagaattgaaaattgaaatcggtgccaaccgttacgatttactgtgtatcgaaggtatcgctcaatctttgaatgaatttttgggtaacgttgaagctccagagtataagttgagcaaaccaactaccaagttaatcattgaagaatctacaactcaaattagaagttacgcttgtgctgccatcttaagaaatgttacattcaccgaagccaactatgcatcgttcatttctcttcaagataagttacactcaaacttgtgtagaaacagaactttagttgccattggtacacacgatttggataccattaaaggtcctttccactacagagctgaaaagccaactgacatcaagtttgtgcccttaaatcaaagtaaggaatacgatggtgcagagttaatcgaattgtacaaacaaccagaacaaaagaacaacttgggccgtttcgttcacattatcgaagattcccctgtttttcctgtcatctacgatgacaataatgtcgtttgttctctgcctcctttgattaactctgaacactctaaaatttctctgaacaccaagaatatttttatcgaagttactgcaaccgatagaaccaagtccgaagttgtcttggaccaaatcgttgctatgttctcccgttattgtgaagaccaattcaccgtggagccagtggaaattgtttctgaacacaacaatcaatctagagtaaccccaaatttcactccaaaaattatggacgtcaaggtcgattacatcaattcttgtctaggcctaaccttatccccagaagagatctcaaagaacttgaaaaagatgtcgttgaaagctacaccttcctctgacgaccaaaacatcttacatgttgaaattccaattacgagatctgatattttacatccttgtgatatcatggaagacgctgctatcggttacggttacaacaacttaccaaaaggcaatcaattgtctaatgctaacttcgttgcatctgcgttacctatcaacaaaatttcagacattctaaggattgcttcctctcaggcttcatggttggaagttttgccattgaccttatgctctcatgatgaaaactttaaattcctaaggatggaagatgataacacaaaggctgtaaaattagctaacccaaagactttggaataccaagttgtcagaactagtttattgccaggtattctaaaaactgttaaggaaaatagaaagcactctttacctatcaaagtttttgaagccggtgatgttgttttcaagaatgataaactagaaagaagagcattcaaccaacgtcattgggccgccgcttatgtcggaaaaactgcctcatttgaaattattcaaggtttactagggaaaattatgcagactttcagaactcaatggctacctgattatggtgcgggatccactggcagaggttactggattgaaaaagatgataccctcactacctacttcccgggtagaggtgcaaagatcatgttcagacacaaagaaggagaagaagctaggcagatcggtcatattggtgttttacatcctgaagtaatgtccaacttcgacattccatatgccggttcttacgttgaaatcaattcagaagctttcttatag

SEQ ID NO: 9568 - protein, 595 aa, Kluyveromyces lactis NRRL Y-1140
MPTISVNKRQLFEALGKNYTNEEFDELCFEFGVELDEDTTEEALKTGEEPELKIEIGANRYDLLCIEGIAQSLNEFLGNVEAPEYKLSKPTTKLIIEESTTQIRSYACAAILRNVTFTEANYASFISLQDKLHSNLCRNRTLVAIGTHDLDTIKGPFHYRAEKPTDIKFVPLNQSKEYDGAELIELYKQPEQKNNLGRFVHIIEDSPVFPVIYDDNNVVCSLPPLINSEHSKISLNTKNIFIEVTATDRTKSEVVLDQIVAMFSRYCEDQFTVEPVEIVSEHNNQSRVTPNFTPKIMDVKVDYINSCLGLTLSPEEISKNLKKMSLKATPSSDDQNILHVEIPITRSDILHPCDIMEDAAIGYGYNNLPKGNQLSNANFVASALPINKISDILRIASSQASWLEVLPLTLCSHDENFKFLRMEDDNTKAVKLANPKTLEYQVVRTSLLPGILKTVKENRKHSLPIKVFEAGDVVFKNDKLERRAFNQRHWAAAYVGKTASFEIIQGLLGKIMQTFRTQWLPDYGAGSTGRGYWIEKDDTLTTYFPGRGAKIMFRHKEGEEARQIGHIGVLHPEVMSNFDIPYAGSYVEINSEAFL

SEQ ID NO: 9569 - DNA, 1773 bp, Debaryomyces hansenii CBS767
  CDS (1)..(1773)
atgcctactattccagttgataaacaagatcttttcgatctattaggtagatcatatactactgaagaattcgacgaattatgttttgaattcggtattgaattggatgaagacactactgaagagtgtaagggtgatgaaagacctcagtttaagattgaagttccagcaaatagatatgatatgttatgtatcgaaggtattgctcaagctttgaatgaatttttgggtaagaaactgtccccaggtttcaaatacaacccatcgaagccagaaatttctttgaccattcacaagtcaaccgaacaggtgcgtccatacgcagcctctgccattttgagaaatgttcaacttgatgaaagacgttatgattcgttccttgctttacaggataaattgcataccaacttatgtcgtaatagaactttggtggctataggtacccatgatttggatacacttactcctccattcacatacgaagctttaccaccttcggaaattaactttatcccattaaaccaagagaaagagatggatggtaaccagttaatggaattctacgaaaaggataagcacttaggaaaatacttacatatcattaaggactcaccagtatatcctgttatcttggatgcaaacagaaccgtttgttcattaccacctattatcaattctaatcactcaaagatttcggcccaaacaagaaacatcttcatcgatgtcaccggtactgatagaaccaagactgagattgtcattaatcaattagtcgctatgtttgccggttactgtaaggtaccatttgaaatagaacctattgaaataaaatctgagcataataagcaagaccgtataacaccagatatctcagcaagaccttttgaagctgaaatcccatatatcaattcttgtttaggtttagatttaactggccaagaaatctccgacttgttgaaaagaatgtctttacatgccaaaccttcgtctaagaaagacttaattgacattggaattccaataaccagacctgacattttgcatcaatgtgatatcatggaagacgcggctattgcttacggttacaacaacttaaccaagacaaaagccaagggtgactccttagttgctgcaccattgccagtgaataagatcggtgatatattaagaatagccagtgctcaagccgggtacttggaagtattacctttaacattatgttcgcacgatgaaaacttcaaattcttaagaaccaaagacgacaacactactgctgtcaaattagaaaatccaaagacaattgagtaccaagtcgtcagaaccactttagtacctggtcttttgaagactattaaggaaaacagaaagcactctttaccaatcaaggtttttgaagctggtgatatcgttttaaagaaccctgagttagaaagaggtgccttcaaccaacgtaattggagtgccatctacgctggaaaaacttccgggtttgaatttgttcaaggtttattaggtaaaatcatgcaaaccatgagaacctcctggttagaaaacccaaaggagtccaccgaaagaggttactggatcgagcaagatgacgaaaatccaaccttcttccctggaagaggtgccaaggttttcttcagagccggtgatgggtccaaagaacaacatattggtgctattggtgtcttgcatccagaagtcatggcaaatttcgaaattccatacgccgcttcttctgttgaaatcaacgccgaagtattcttgtaa

SEQ ID NO: 9570 - protein, 590 aa, Debaryomyces hansenii CBS767
MPTIPVDKQDLFDLLGRSYTTEEFDELCFEFGIELDEDTTEECKGDERPQFKIEVPANRYDMLCIEGIAQALNEFLGKKLSPGFKYNPSKPEISLTIHKSTEQVRPYAASAILRNVQLDERRYDSFLALQDKLHTNLCRNRTLVAIGTHDLDTLTPPFTYEALPPSEINFIPLNQEKEMDGNQLMEFYEKDKHLGKYLHIIKDSPVYPVILDANRTVCSLPPIINSNHSKISAQTRNIFIDVTGTDRTKTEIVINQLVAMFAGYCKVPFEIEPIEIKSEHNKQDRITPDISARPFEAEIPYINSCLGLDLTGQEISDLLKRMSLHAKPSSKKDLIDIGIPITRPDILHQCDIMEDAAIAYGYNNLTKTKAKGDSLVAAPLPVNKIGDILRIASAQAGYLEVLPLTLCSHDENFKFLRTKDDNTTAVKLENPKTIEYQVVRTTLVPGLLKTIKENRKHSLPIKVFEAGDIVLKNPELERGAFNQRNWSAIYAGKTSGFEFVQGLLGKIMQTMRTSWLENPKESTERGYWIEQDDENPTFFPGRGAKVFFRAGDGSKEQHIGAIGVLHPEVMANFEIPYAASSVEINAEVFL

SEQ ID NO: 9571 - DNA, 1782 bp, Yarrowia lipolytica CLIB122
  CDS (1)..(1782)
atgcctaccatctccgtggacaaagaggacctgtacaaggccattggaaagacctacacgaccgaagagttcgacgagctctgtttcgagtttggaatcgagctggacgaggacaccaccaacgactgcgttggagatgagcgtccccagctcaagattgagatccccgccaaccgatacgacatgctgtgcatcgagggtattgcgcaggctctcaatgtgttccttggccgggccgaggtgcccgagatcaagcttactaagccctccaagatgcttgagctcaccattcaccccgagaccgcggaggttcgaccctacgctgctgccgccattctgcgaaacgtgaccctcgaccagcgaaagtacgagtccttcatttctctgcaggagaagctgcactccaacatttgtcgaggacgacagctggtggccattggtacccacgactttgacaagatggtccaggatggcccctacgcttacaaggccttcaagcccaacgaccccaagatgtccttcgtgcctctcaaccagaccaaggagctcaccggagagggagtcatggagttctatgagaaggacaagaacctcggaaagttcctctacattatcaaggacgcccccgtctacccttacattgtcatgggcgacgacaacactgtctgctctctgccccccatcatcaactccgacaagaccaaggtttctcccgacaccaagaacattttcattgaggtgactggaaccgataagacccgtctggagattgttctgtctcagattgtcgctgctttctccgagtactgcgccgagcccttcaccgtcgaacctctcaaggttgtctccgagcacaatggtgagactcgaatcacccctgagatgacacctcgagtcatgcaggccgagattccctacatcaagtcgtgcttgggtctggatctgtctgccgacgacattatcaagctgctggcaaagatgtcgcttcaggcttccaagacttccaaccccgatgtgcttgacgtggctatcccccccacccgatccgacattctgcatcagtgcgatatcatggaggacgctgccattggttacggcttcaacagtctgcctaagaccctccccatgaagtctgccaccgtcggtaagccccagctcatcaacaaggtgtccgacattgttcgacgagaggtggccatgagcggctgggccgaggtgatgcctctgaccctgtgctcgcacgacgagaactttgccttcctcaaccgaaaggacgagggccaggccgtgcaccttgccaaccccaaaacacaggagtaccaggtgatccgaacctcgcttctccccggtattctcaagactatcagagagaacaagaagcactcgctgcccattaaggtgtttgagaccggtgatgttgttttcaaggacgagtccctcgagcgaaagtcgtacaaccagcgaaacttcggagccgtctactccggaaagacctccggtttcgagactgtgcacggccttcttggccgactgatgcagatgctgcgagtttcgtggatcgagaaccccaaggagtccacttcccgaggctactggatcgaggagtcgcactctgagaccttcttccccggccgaggcgccaccatccacctgcgaaccaaggacggagccgaggccaaggtaattggagagatgggcattctgcatcccaatgtcctggccaagtttgagattccttatgcttcctccagcatcgagttcaacattgaacctttcatgtag

SEQ ID NO: 9572 - protein, 593 aa, Yarrowia lipolytica CLIB122
MPTISVDKEDLYKAIGKTYTTEEFDELCFEFGIELDEDTTNDCVGDERPQLKIEIPANRYDMLCIEGIAQALNVFLGRAEVPEIKLTKPSKMLELTIHPETAEVRPYAAAAILRNVTLDQRKYESFISLQEKLHSNICRGRQLVAIGTHDFDKMVQDGPYAYKAFKPNDPKMSFVPLNQTKELTGEGVMEFYEKDKNLGKFLYIIKDAPVYPYIVMGDDNTVCSLPPIINSDKTKVSPDTKNIFIEVTGTDKTRLEIVLSQIVAAFSEYCAEPFTVEPLKVVSEHNGETRITPEMTPRVMQAEIPYIKSCLGLDLSADDIIKLLAKMSLQASKTSNPDVLDVAIPPTRSDILHQCDIMEDAAIGYGFNSLPKTLPMKSATVGKPQLINKVSDIVRREVAMSGWAEVMPLTLCSHDENFAFLNRKDEGQAVHLANPKTQEYQVIRTSLLPGILKTIRENKKHSLPIKVFETGDVVFKDESLERKSYNQRNFGAVYSGKTSGFETVHGLLGRLMQMLRVSWIENPKESTSRGYWIEESHSETFFPGRGATIHLRTKDGAEAKVIGEMGILHPNVLAKFEIPYASSSIEFNIEPFM

SEQ ID NO: 9573 - DNA, 1779 bp, Candida albicans SC5314
  CDS (1)..(1779): transl_table=12
atgccaactattcctgtagacaaagaagaccttttcaagttattgggtagatcatatactacagaagaattcgacgagttatgtttccaatttggtattgagttagatgaggatactactgaagatgtcaaaggtacagacgaaagaccacaattgaaaattgaagttcctgccaacagatacgatatgttatgtattgagggtattgctcaagctttaaatgaatttttaggtaacacatcagcaccaaattacaaattgagtcctagcaaaccagagatttctttgactattaaagaatcaacctacccaattcgtcaatatgctgccagtgcgattttgagaaacgtgaaactcgatgaaagagcctatgactcttttatttccttacaagataaattacatgcaaatttatgtcgtaacagaactttagtggctattggtactcatgatttagatactttgacaccaccatttacctatgaagccttggcacctaaagatattgttttcaaaccattaaatcaaactaaagaaatcaatggtgaagaattaatggagttctatgaaaaagataagaatattggtaagttcttgcatattattaaggattcgccagtttatcctgtcatgcttgatgccaatagaacagttgcttcgctcccaccaatcatcaatagtgatcactccaaaatcactttaaacaccaagaatgtttggattgatgtcaccggtactgatagaaccaaaactgaaattgttataaaccaattagtggccatgttttcacgttattgtaaggaaccttttgaaattgaaccaattcaaatcatttctgaacacaataatgaaactcgtgtatgtccaaatatcactccaagaacagctaaggctgagatttcatacatcaattcctgtgtaggattggattactcaggtgaagaaatctcaaagttgttgaaaaaaatgtcattagatgctaccccatctactgaagagagagacatactcgatgtgaaaatcccaataacaagatctgatatcttgcaccaatgtgatattatggaggatgtcgctattgggtacgggtacgataatttgaagaagaccaaacctaaggctgaaagtttagttgctgccccattacctgtaaataaagttgctgatattttaaggttggcaagttctcaagctggttatttagaagtcatgcctttgactttatcttctcacgatgagaattttgcttggttgaaacagaaggatgatggtaccaaagctgttaaattggaaaatccaaagacaattgaataccaagttgttagaactactttattacctggtattttaaaaaccgttaaagaaaacagaaaacactcgttaccaatcaaagtatttgaatgtggtgatattgttttgaagaatccagaattagaaagaggtgcttttaaccaacgtaattgggctgccttgtacgtaggtaagacttctggtttcgaaatggtccaaggtttattaggaaagatcatgcaaaccatgagaactccttggttagaaaatccttctaaggatcaaagaagaggttactggatagaggaagacaaagaaaacacaactttcttcccaggaagaggagccaagatttatttcagaaatgccgataatgctgaagccaaagctattggaagcattggtgttttgcatccagaagtaatgaataactttgacattccttatgcagcatcgtctgttgaaataaacgctgaagtatttttgtaa

SEQ ID NO: 9574 - protein, 592 aa, Candida albicans SC5314
MPTIPVDKEDLFKLLGRSYTTEEFDELCFQFGIELDEDTTEDVKGTDERPQLKIEVPANRYDMLCIEGIAQALNEFLGNTSAPNYKLSPSKPEISLTIKESTYPIRQYAASAILRNVKLDERAYDSFISLQDKLHANLCRNRTLVAIGTHDLDTLTPPFTYEALAPKDIVFKPLNQTKEINGEELMEFYEKDKNIGKFLHIIKDSPVYPVMLDANRTVASLPPIINSDHSKITLNTKNVWIDVTGTDRTKTEIVINQLVAMFSRYCKEPFEIEPIQIISEHNNETRVCPNITPRTAKAEISYINSCVGLDYSGEEISKLLKKMSLDATPSTEERDILDVKIPITRSDILHQCDIMEDVAIGYGYDNLKKTKPKAESLVAAPLPVNKVADILRLASSQAGYLEVMPLTLSSHDENFAWLKQKDDGTKAVKLENPKTIEYQVVRTTLLPGILKTVKENRKHSLPIKVFECGDIVLKNPELERGAFNQRNWAALYVGKTSGFEMVQGLLGKIMQTMRTPWLENPSKDQRRGYWIEEDKENTTFFPGRGAKIYFRNADNAEAKAIGSIGVLHPEVMNNFDIPYAASSVEINAEVFL

SEQ ID NO: 9575 - DNA, 1866 bp, Ustilago maydis 521
  CDS (1)..(1866)
atgcctaccgttggcgtcgacaaggagcacttttacaaggcgcttgggcgcacgtatacaacgcaggagttcgacgaactgtgctttcaattcggtatcgaactcgacgatgacaccactgaagaagtggccaaagctggactgggcgagcgtgctcagctcaagatcgacatccccgccaacaggtacgatcttctctgccacgaagggatctcgcgtgcgctcaacgtgttcctaggcaacattgctcagcctcaaatcaagctcagccagccggaaaacatgatcgagatcaaactcagcaaagacgtagcgcgcatccgaccatactttgccggcgccgtgttgagaaacgtgagcttcactgcggagagctacgcccactttatcgatctgcaggacaagctgcatcaaaacctagctcgtcgtaggacactggtcgctatcggtacgcacgacttggataccatctcggctcccttctcgtacgaggcgcttccgcccaagcacatcaagtttgcaccactcaacaaggagcaagagtacgacgctagccagctgatggagctgtacgagtcggataagcacctgtcgcgctacctgcacatcatccgtgacagcccagtgtatccgatcatctacgattccaaccgacaggttctctcgatgccgccgatcatcaactcgaaccacagcaagatcacgctcgatacgaaaaacgtctttatcgacaccaccgcgattgacgaaaccaagctgggcattgtgatcaacatcatcgtcgccatgttctcccagtactgtgcagagccgttcactgtggagcctgtcaaagtagtatacccggatggcaaggttaaggtgacgccggatctgagcaacgtgcgcttgccggcttcggtcgactacatcaaccgatgcaccggtctgcagctttctccgcaacagatgatcgagtatttgaaaaaaatgggtcactcggccacggtagatgcggacgctcccactgagaagctcatcgtagatgttcctccgacacgaccggatattctgcacgagtgcgatctcatggaagacgtcgcggtggcgttcggcttcgacaatctgcccaagacgttccctgcgaccaacacggttgctgctcctctgccgatcaacaagctggccgacattgttcgacgcgaatgtgcgtattccgggtggatcgaggtgcttccgctcatcctgtgttcgcacgatgagaactttggctggttgaagcgcaaagatgatggcacaagtgcgattgtgctcgagaatcccaagacggccgaatatcaagtggttcgaacgagccttttgccggggctcctcaagacggtgcgagagaaccgcaagcacgcgttgccattgcgaacgtttgaagtctcggatattgccttgaaggatgccgacgagctcgagcggtgtgctcgcaatcagcgacatgtcggagccgtgtactgcgacaagacggcgagtttcgaggtggtgcacggcctgttggaccggttgatgttgagcttggacattgcgcgcatcccagcctgctcgaccgtagccgataaaggctactggatccagcaagacgtcgataaccccacattcctacccggtcgagccgccacgatccacgtccgtctaccggcaaccacgtacaaccctggctctgcaacgcaccacgcgcatgctctcgacaccatcaagcatgacctcgaatcctcgctcccctcccacaccgatcacgtcctaggccacatcggcgtccttcacccacacgtcctcaacaacttttccatcgactacccctgctccgccctcgaattcatcctcgaccccctcctctaa

SEQ ID NO: 9576 - protein, 621 aa, Ustilago maydis 521
MPTVGVDKEHFYKALGRTYTTQEFDELCFQFGIELDDDTTEEVAKAGLGERAQLKIDIPANRYDLLCHEGISRALNVFLGNIAQPQIKLSQPENMIEIKLSKDVARIRPYFAGAVLRNVSFTAESYAHFIDLQDKLHQNLARRRTLVAIGTHDLDTISAPFSYEALPPKHIKFAPLNKEQEYDASQLMELYESDKHLSRYLHIIRDSPVYPIIYDSNRQVLSMPPIINSNHSKITLDTKNVFIDTTAIDETKLGIVINIIVAMFSQYCAEPFTVEPVKVVYPDGKVKVTPDLSNVRLPASVDYINRCTGLQLSPQQMIEYLKKMGHSATVDADAPTEKLIVDVPPTRPDILHECDLMEDVAVAFGFDNLPKTFPATNTVAAPLPINKLADIVRRECAYSGWIEVLPLILCSHDENFGWLKRKDDGTSAIVLENPKTAEYQVVRTSLLPGLLKTVRENRKHALPLRTFEVSDIALKDADELERCARNQRHVGAVYCDKTASFEVVHGLLDRLMLSLDIARIPACSTVADKGYWIQQDVDNPTFLPGRAATIHVRLPATTYNPGSATHHAHALDTIKHDLESSLPSHTDHVLGHIGVLHPHVLNNFSIDYPCSALEFILDPLL

SEQ ID NO: 9577 - DNA, 1899 bp, Cryptococcus neoformans var. neoformans B-3501A
  CDS (1)..(1899)
atgcctaccatcaccgtcgacaaggccgagctctataggcggttggagaaggagtactcccacgaagagtttgatgaactatgtttcgagtttggtattgaactcgacgaggacaccaccattcaagtcgaagaagctcgtaaaagaggacttcctactccaccccctcagctcaagattgagattccagccaatcgatacgacttgctctgtattgaaggcctcgctagggccttgaggatcttcttgcaaaaggatataccccccagctacaagctcgatatccccgagaaattgcaagaagtttatgtcgaagcttctactgctccccttcgaccctactttgcctcagccgttcttcgtcttgcccgacccatgaaccaactcgaatacgaatctttcattgatcttcaagacaagcttcaccaaaacctttgtcgaatgaggaagttcgttgctatcggcacgcatgatttggacactatcgagggacctttcagatacatgtgcaaggaccctaaacaaatcaagtttgcaccacttaacagggatacggagcacactgccgaggaattgatgaccatatacgaggccgatagacatctcgccaagcacttgcacctcattagggatgccccagcgtatcccatcatctacgacagcaaggaccgagtattatccatgccccctatcattaattctcagcgctctaagatcgtacctggcaagacaaccaacatcttcattgacacaaccgccactgacaagaccaaacttgacattgtcattaatatggtttgcgccatgtttgctgagtactgcagagttcctttctatatcgagcctgtcagagtccacatgcctgacggcacttcccacataactccgcctctggaaccacgtgccaccacagcttcttcctcttacatcaatgccgctaccggtcttgccttgtcccgccaggagatttgcacgctccttacccgtatgtctctctctgccaccccgtcgccttcaaacgaggatctcctcgacgttcttgttccttgcaccaggccagacattctacacgaatgtgacatcatggaagacgcggcgattgcctacggcttcaacaaattgccgagagagatgccgactacgaatactgtggctaaggcattccctgtgaataaattgggcgatatcatcagaaaggaatgtgcgatggctggctgggttgaggctttgcctttgattttgtgctctcacgacgaaaacttcgcctggctcaaccgtcctgatcctggtcactacgctgtccaccttgccaacccgaagtcactcgagtaccaggtcgtccgtacttctctcttgcccggtatgcttaaaactgctcgcgaaaacaaggctttgcctttgcccatgaagattttcgaagtttccgacgttgccatccaggactccaccgaggaaaggcaggctaggaactacagaaggctttgtgcggtctatatggacagaaaggccggctttgaggtcgctcatggattgttggacagggtgatgcagattttaggagttcctctcttggaaaggaaggaaaatgagggaaactacgggtactatattgcttctgcagatgatcttacgtatctccctggcagggcggctcacgttttctatcgacccaaacctactgtccagccttctgaacccaccccctcagctcctccatccaatcccattcaatcgtttacttctgacctcaaggcagctttgcacgcggagaagggatcctcatgggagagggatatcgatattggctctttgggtatcctgcaccccagtgtacttgacaactttgagttgatcagaccttgttccgctttggagatcgacgtggaacctttattgtaa

SEQ ID NO: 9578 - protein, 632 aa, Cryptococcus neoformans var. neoformans B-3501A
MPTITVDKAELYRRLEKEYSHEEFDELCFEFGIELDEDTTIQVEEARKRGLPTPPPQLKIEIPANRYDLLCIEGLARALRIFLQKDIPPSYKLDIPEKLQEVYVEASTAPLRPYFASAVLRLARPMNQLEYESFIDLQDKLHQNLCRMRKFVAIGTHDLDTIEGPFRYMCKDPKQIKFAPLNRDTEHTAEELMTIYEADRHLAKHLHLIRDAPAYPIIYDSKDRVLSMPPIINSQRSKIVPGKTTNIFIDTTATDKTKLDIVINMVCAMFAEYCRVPFYIEPVRVHMPDGTSHITPPLEPRATTASSSYINAATGLALSRQEICTLLTRMSLSATPSPSNEDLLDVLVPCTRPDILHECDIMEDAAIAYGFNKLPREMPTTNTVAKAFPVNKLGDIIRKECAMAGWVEALPLILCSHDENFAWLNRPDPGHYAVHLANPKSLEYQVVRTSLLPGMLKTARENKALPLPMKIFEVSDVAIQDSTEERQARNYRRLCAVYMDRKAGFEVAHGLLDRVMQILGVPLLERKENEGNYGYYIASADDLTYLPGRAAHVFYRPKPTVQPSEPTPSAPPSNPIQSFTSDLKAALHAEKGSSWERDIDIGSLGILHPSVLDNFELIRPCSALEIDVEPLL

SEQ ID NO: 9579 - DNA, 1701 bp, Borrelia garinii PBi
  CDS (1)..(1701): transl_table=11
atgccaaaggtagaaatttacaaaaatctttttttagataaaataggaaaaaattttacaaatttagagatttcagaattacttgaaccatttaaagcagaatttgatggctttgatgaaaattcaggaaaaatcaaaatagaatttaatgatacaaatagaccagatttatggtcttatactggacttgctcgtcaaataaaaacgtatctttttggagaaattccttattatgattttttttcaaaaaaaggagatttcaaaaagtgctatggtgaaattttagtggacaataaaatgtcccaaataagaccgtttatttttggatttttagcaaaaggattgattattaatgatagaatgcttgaagcactaattcaatttcaggaaaaactttgtcaaagttatggacaaaagagaagaagagttgcaatggggatgtataattctaattttattaaatttccaatcagttatgttgcttcgtctcctaatcataagtttgttcctttgggaatggattgtgagctttctcttttagaaataaatgaaaagcatcccaaagggttggaatattcctatattgtcaaaaattttgataagtatcctttattattagataataataataacgtagtctcgtaccccccaataattaattctaacaatattggatctttaaaggttggtgatactgagttatttgttgaggttacaggtatcgattttgaagcaactttgttagcgttatctatagtagcttgtgatttttatgatatgggttttgaaattttgcccgtaaaaactgtgtttaaagacccttttggtttagattttgaagaattagtatgcccttattattttcaagaagaagtagagtttgatgttaaaaatgttaatagactgcttggaaataatttaacattagagcgtatttgccttaatttaaaaaaaatgggagtaagttcttattctagagattttaaaaattatattgttccgcccttttatagaaatgactttcttcatgaggttgatgtaattgaagatgtaatgataggggagggtcttgcaagtttttatccagagcttcccaaggcctttacaataggaaggcttagtgctttggaagagttttcaaggaatgttagaaatttaatgatgggtatgggattccaagagatgatttataattatatgggctctaggaaagattttattgatagaatgaatattaatgatcaaaattttttaaaagtatctaatccaatgacagagaattatgaatatattagagcatcaataatacctaatttattaaaatcagaaagcgttagttctaattttccttatccacataaaatttttgaggttggcaaggtagctttaaagaatttggatgctgctgaaggaacaagcacttttaccaatttagcttttttaatgtctggcaaagaaatttcttttaatgagattaattcaattgttgcaacgcttttttattatttaaatattgagattattttaagagagtcaaaagctactttttatattaatggcaggggggcagatattttgattgaaggtttcaatgtgggtagctttggtgaaatttcaccttatgttttaaataattttggaatttttattccatgttctgtttttgaggttaatatcaataaacttgtgagtcaatcttaa

SEQ ID NO: 9580 - protein, 566 aa, Borrelia garinii PBi
MPKVEIYKNLFLDKIGKNFTNLEISELLEPFKAEFDGFDENSGKIKIEFNDTNRPDLWSYTGLARQIKTYLFGEIPYYDFFSKKGDFKKCYGEILVDNKMSQIRPFIFGFLAKGLIINDRMLEALIQFQEKLCQSYGQKRRRVAMGMYNSNFIKFPISYVASSPNHKFVPLGMDCELSLLEINEKHPKGLEYSYIVKNFDKYPLLLDNNNNVVSYPPIINSNNIGSLKVGDTELFVEVTGIDFEATLLALSIVACDFYDMGFEILPVKTVFKDPFGLDFEELVCPYYFQEEVEFDVKNVNRLLGNNLTLERICLNLKKMGVSSYSRDFKNYIVPPFYRNDFLHEVDVIEDVMIGEGLASFYPELPKAFTIGRLSALEEFSRNVRNLMMGMGFQEMIYNYMGSRKDFIDRMNINDQNFLKVSNPMTENYEYIRASIIPNLLKSESVSSNFPYPHKIFEVGKVALKNLDAAEGTSTFTNLAFLMSGKEISFNEINSIVATLFYYLNIEIILRESKATFYINGRGADILIEGFNVGSFGEISPYVLNNFGIFIPCSVFEVNINKLVSQS

SEQ ID NO: 9581 - DNA, 1635 bp, Methanosarcina barkeri str. Fusaro
  CDS (1)..(1635): transl_table=11
atgccagtaattaccttacagtacgacgaccttgaaaaactcacaggaaccgataaggaaaccattataaaaagagcgcccatgataggggccgatatcgaaagagttgaagaggaatctatagatatcgagttcttccctgacaggcctgacctttacagtgtggaaggagcagccagggcaatgaggggtttcctggatcttgagaccggactgtcaaagtatgagataaagcctccaaaggtttcgatctcggtcagcgagaagatccttagaatcaggccttttcttgggtgtgcggttgtaaggggcataaaattcacatcctcgtccataaaatcccttatggatcttcaggaagatctgcactgggggcttggaagaaacaggaaaaaagtgtctataggcgtgcacgacctctcaaacgtcaagccgcctttcaggtatatggccgttgaccccggtttcaagttcgtgcccctggactacaccgaaaaaatgagcatgaccgaaatcctggaaaagcacccaaaaggcacaaggtttgcccatcttgtcaggggctttaagaaatatccaataattctggactcagacgataatgtgctgtccttcccgcctattattaacgggacacttacaagtgtgaccgagagcacaaccgacctctttatcgatgttactggacttggagaagccgtttataccgccctgaacattgttgttactgcccttgcggaaagaggtggtcagatcgaattcgtaaaggttgtcaggcccgactctggagaacttatcctgcctgaccttgaaccgaaaaccaggttccttacaaagactgaagtaagggaccttctaggcatggaactctccatagaagaaatcgttaaacagcttgagagaatgcgctttggagcaaaagcccttgacgaagaaaccatcgaggtaaaagtcccggcttacagggccgatattcttcataactacgaccttgtagaagatattgccaaaggttatggatatgaaaatatcaaagtaaagattcctgaaacctataccccaggaaagtctcacccgatttccctgcttcgcgctcccgtaaacgagataatggtagggcttggctactatgaggtcatgccgtttacacttaccagcgaaaaaattaacttcgagaacatgcgcaggcaaaaaacggatgatgttacctatgtgcttcacccgatcagcgaagaccagacaatgatcaggacaaccctgcttccgaacctccttgagattcttgctttaaatcagcacagggaattacctcagaagattttcgagttcggcgaggtcgtaaataacgaaataaccggccagcacgtagctgcagtctcgattcacccgcaggccaactttaccgagatctatgaggttgtagatgctctgatgagggaaatgatgcttccctacgaggtaaaagagtccgaagatcccgcattcctcgaaggcaggcgggctgacgtttatgtcaatggcaaaaaactcggagtctttggagaattccatcctgaggtcataaacaattttgcccttggatacgcagttgtcgggtttgaacttgacctcaatgaccttattggtcaaagttaa

SEQ ID NO: 9582 - protein, 544 aa, Methanosarcina barkeri str. Fusaro
MPVITLQYDDLEKLTGTDKETIIKRAPMIGADIERVEEESIDIEFFPDRPDLYSVEGAARAMRGFLDLETGLSKYEIKPPKVSISVSEKILRIRPFLGCAVVRGIKFTSSSIKSLMDLQEDLHWGLGRNRKKVSIGVHDLSNVKPPFRYMAVDPGFKFVPLDYTEKMSMTEILEKHPKGTRFAHLVRGFKKYPIILDSDDNVLSFPPIINGTLTSVTESTTDLFIDVTGLGEAVYTALNIVVTALAERGGQIEFVKVVRPDSGELILPDLEPKTRFLTKTEVRDLLGMELSIEEIVKQLERMRFGAKALDEETIEVKVPAYRADILHNYDLVEDIAKGYGYENIKVKIPETYTPGKSHPISLLRAPVNEIMVGLGYYEVMPFTLTSEKINFENMRRQKTDDVTYVLHPISEDQTMIRTTLLPNLLEILALNQHRELPQKIFEFGEVVNNEITGQHVAAVSIHPQANFTEIYEVVDALMREMMLPYEVKESEDPAFLEGRRADVYVNGKKLGVFGEFHPEVINNFALGYAVVGFELDLNDLIGQS

SEQ ID NO: 9583 - DNA, 1623 bp, Methanococcoides burtonii DSM 6242
  CDS (1)..(1623): transl_table=11
atgccaataattaccttacaatacgaggatctggaatcactcacaaaagcagacaaggatacgatcatagaccgtgtaccaatgataggtgcggatatagaacgtattgaaaaggaagccatcgacatcgagttcttccccgaccgacctgatctttacagtgtagagggagtagcaagagcaatgagaggttttatgaacatcgagaccggcctttgccagtatgaagtaacgccatctggtgttcatatagaactcgacgaaaaaataaaggaagtgcggcctgtccttggatgtgctattgtaaagggtatcaatttcacatccagttctatcaagtcattgatggatctccaggaagatctgcactggggtcttggaaggaacaggaagaaagtgtctatcggagttcacgatatgacaaacatcgaaccacctttcaaatatcaggcagtcagcccggacttcgagttcgtaccccttgattttactgaaccgatgacaatggatgaggtacttgaaaagcatccaaaaggtgttcgctttgcaaatatactagaagggatggagaaatatcctctgataactgattctgaaggaaaggtgctttcattcccaccaataatcaatggaacccttacaagggtcgaggagagcactacagaccttttcattgatgttacaggtcttggagatgcagtatataccgcacttagcatcgtagtaagtgcacttgctgagaggggcggaaagatagagtcagtaaaggtagtatatcctgatgggaccgagaaggtcacaccggacatgacaccaagaactctcaatgtaccacgctcagatatcgattcactcatcggcataaagcttacagatgacgagatcatcaacgaactaaagagaatgaggttcgatgcaagcgttcttgaggatggagatatgttcgagatcagcgtcccgacatacagagccgacatcctccataatttcgacatcgttgaagatattgccattggatacggctttgataagataaaaagcgaattcccaaaaagtgcaaccattggatgtgcacacccgatctctgttacaagaggtgtcatgcgtgagataatggtgagccttggttactccgaggtcatgccatttacacttacaagccagaaggtacatttcgaatggatgaacagggaggagacagatgatgtgaccttcgtacttcatcccataagcgaagaccagacaatggtacgtaccaccattttgccgaaccttattgaaatattttccctgaaccaacatcatgaactaccacagcgcctctttgaagtaggtgaagtagtcgttaattcaaagaaccgcctgcaccttgcagcagcctccatacacgctcaggctaactttacagagataagagaggtccttgatgcggtcatgagggaacgagatatcgaatatgaggtcgttgtatctgaggacccggcatttatcgaaggcaggcgtgcagatattcttgtcaacggtgaaaaggtcggaatgatgggagagctctatcctgaagtgatcattaacttcggccttggacaacctatcgttggatttgagattgaccttacagaatga

SEQ ID NO: 9584 - protein, 540 aa, Methanococcoides burtonii DSM 6242
MPIITLQYEDLESLTKADKDTIIDRVPMIGADIERIEKEAIDIEFFPDRPDLYSVEGVARAMRGFMNIETGLCQYEVTPSGVHIELDEKIKEVRPVLGCAIVKGINFTSSSIKSLMDLQEDLHWGLGRNRKKVSIGVHDMTNIEPPFKYQAVSPDFEFVPLDFTEPMTMDEVLEKHPKGVRFANILEGMEKYPLITDSEGKVLSFPPIINGTLTRVEESTTDLFIDVTGLGDAVYTALSIVVSALAERGGKIESVKVVYPDGTEKVTPDMTPRTLNVPRSDIDSLIGIKLTDDEIINELKRMRFDASVLEDGDMFEISVPTYRADILHNFDIVEDIAIGYGFDKIKSEFPKSATIGCAHPISVTRGVMREIMVSLGYSEVMPFTLTSQKVHFEWMNREETDDVTFVLHPISEDQTMVRTTILPNLIEIFSLNQHHELPQRLFEVGEVVVNSKNRLHLAAASIHAQANFTEIREVLDAVMRERDIEYEVVVSEDPAFIEGRRADILVNGEKVGMMGELYPEVIINFGLGQPIVGFEIDLTE

SEQ ID NO: 9585 - DNA, 1782 bp, Phaeosphaeria nodorum
  CDS (1)..(1782)
atgcccactatcggggtcgacaaggcagcgctcttcaaagagctcggccgcgagtacacaacggaagagttcgacgagctatgtttcgaattcggaatcgaactggatgaggacacaagtcagagcaccaagcctgaggatctggcacaacctccgcagctcaagatcgagatccccgccaaccgatatgacatgctgtgcttcgagggcattgccatgaacctgaaggtcttcttggaacaacaaaagctgccaaagtggagcttgacggcgccaaaggacggggagctgcaggtgctggacatcaagaaggagacggagcagatacggccgctgtgctcgggtgtcattctgaggaacatcgagtttacacaagagcgatatgactcgttcattgcgctacaagacaagctgcacgcgaatttggcgcgcaaccggacgctggtgtcgattggaacacatgatctggacacgataaagggccccttctcatacgaggcgcttgcaccggagcagattgagttcatccctctgaaccagaccaagaagatgaacggcaaggagctcatggagttttacgacaaagacaagcatctcggtcgcttcctccacatcattcgcgattcgccagtctaccccgtcatctacgactcgaaccgcaccgtcctctcgctcccgcccatcatcaacggcgaccacagcaagatcactctcaacaccaagaacgtcctcatcgagatcactgcgctggacaagacaaaggtcgagatcgtgaaccacatgctcgtagccatgttcgcaggctatgcagagtcaatagaggcgctcaagatcaactctccgcacaacaacgagtcaagagaagcgcccgatctctcaccacgcgagatgcaagccgaagtcgattacctcaaccaagtcaccggcctgagcctccagcccgaagaaatctcaaaactcctgtccaaaatgggccacgacgtcaagccctccacctccgaccccaacatcctcgacgtctccgtgcccgtaacgcgcgcagacatcctccaccaagcagacatcatggaagactacgctatcgcctacggcttcaataagctgcctcgcgtataccccaacaaaaccgccgctgtctccgccccgctgcccatcaacaagctcgctgatatcgtgcggctcgaatccgccgccgcaggctggacggaagtcatgccgctgatcctgtgctcgcacgaagaaaactttgaatggttgaaccgcgtcgacgacggcaagaccgctgtcaagctggcgaatcccaagacagcagagtaccagcttgttcgcacgagtttgctacccggcctgctgaagacgatcaacagcaacaagcatcacgccgtgccgatgaaaatcttcgaggtgagtgacgtgggattcattgatttggagcaggagcgtaagagccggaacgagagacatttcgcggccgcgattatgggcaagacgagtgggttcgaacaggttcatgggctgttggatagggttatgttgatgctaaggagcgcgttcattacgcgcgaggatggcatgaagaatgataagcttgaggggtattggattgaggaggtcgatgatccgaccttcttgcccggtcacgcggccgccatcaaactcaacctcggcggcaagaaccacacgattggtgtttttggcattctgcatccgagtgtgttgggcaagtttgagttgccatacccggtcagcacggtcgaaatcaacctcgaggtcttcttgtag

SEQ ID NO: 9586 - protein, 593 aa, Phaeosphaeria nodorum
MPTIGVDKAALFKELGREYTTEEFDELCFEFGIELDEDTSQSTKPEDLAQPPQLKIEIPANRYDMLCFEGIAMNLKVFLEQQKLPKWSLTAPKDGELQVLDIKKETEQIRPLCSGVILRNIEFTQERYDSFIALQDKLHANLARNRTLVSIGTHDLDTIKGPFSYEALAPEQIEFIPLNQTKKMNGKELMEFYDKDKHLGRFLHIIRDSPVYPVIYDSNRTVLSLPPIINGDHSKITLNTKNVLIEITALDKTKVEIVNHMLVAMFAGYAESIEALKINSPHNNESREAPDLSPREMQAEVDYLNQVTGLSLQPEEISKLLSKMGHDVKPSTSDPNILDVSVPVTRADILHQADIMEDYAIAYGFNKLPRVYPNKTAAVSAPLPINKLADIVRLESAAAGWTEVMPLILCSHEENFEWLNRVDDGKTAVKLANPKTAEYQLVRTSLLPGLLKTINSNKHHAVPMKIFEVSDVGFIDLEQERKSRNERHFAAAIMGKTSGFEQVHGLLDRVMLMLRSAFITREDGMKNDKLEGYWIEEVDDPTFLPGHAAAIKLNLGGKNHTIGVFGILHPSVLGKFELPYPVSTVEINLEVFL

SEQ ID NO: 9587 - DNA, 1806 bp, Medicago truncatula
  CDS (1)..(1806)
atgcctaccatcagtgtagggcgggatcgtctgtttgcggctctaggaaaaacttacacacaagaggaatttgaagacctatgtttcagttttgggattgagctcgacgatgttactacagaaaaagcaattgtgagaaaagaaaagcatttggaaaaagaagctgatgaggatgaagaaattatctacaaaattgaaattcctgctaacagatatgatctactctgcctcgaaggattggctcaagccctccgagttttctgtgggttccaggaaatccccacttacatattgtctgacattagtaaggatgcaatgcttaaaatgcatgtgaagccagagacatctctgattcgtccccatgttgtttgtgccgtactaagaggtttaacttttgataaagtgagatacaacagcttcattgacctccaggacaaattgcaccaaaatatttgtaggcgaagaacccttgttgccattggcactcatgatctggataaactggagggtccttttacctatgaggctttaccaccttcaagtattaactttacgccactaaaacaggaaaggagcttcagggctgatgagctcatggagttctacaaatcagatttgaaactgaagaaattcttgcatataattgaggactctcccgtttatcctgttatatatgatagtaagagaactgttttatctttacccccaattatcaatggtgcacattcggccatcactctggatacaaagaacgtatttattgaatgcacagctactgatctgacaaaggcgaagattgttttaaatacaatggtaacagccttcgcggaatattgtgaaaataagtttgtcattgaaccagttgaagtgatttcttctgatggaaaatctcacatataccctgatttatctgtctacaatatggaagtttctttatcttacattactggattgattggagtatcattggaggcagaagaggttaccaagttcttaaaccggatgcaattgcacgccaagcaatctacatccgacaataaacagtgcaactttattgtatctgtacctcctactagaagtgatgttcttcatccatgtgatgttatggaggatgttgcaatagcttatggattcaatgctatcaaggatcaagcaatagtcgataataaggggtcaaagagattagctgcttccttgacactacttcctctgaatgaactgagcgatcttatcagaaaagaggttgcaatgattgggttcacggaggttttgacttttatactctgctctaaaaaagaaaacttttccatgctaaaccgcaaagatgacaaatccaaagcggttatcattggaaaccctaggtcttcagacttcgaggctgtccggactagtcttatgcctggcattttgaaaactgttgctcacaacaaggaccacccaaagcccataaagatttttgaagtgggtgatatagcaattttggatgacaatgatgttggtgcaaaaaatctccgccaacttgctgcactttattgtggtgctaatgcaggatttgagataattcatggattggtggacaaagtaatggaaaagaatgggattacctttgtttcacctggcgataaatcagggtattatattgagcggtcagatgagcccgagtttcttgctggtagacaagccagaattatttacaagggaaagcaagttgggactttcggcattgttcatccagaggtattaaacagcttcgacattcctgatccctgctcctttgtagaactcaacattgaaagtttcttgtaa

SEQ ID NO: 9588 - protein, 601 aa, Medicago truncatula
MPTISVGRDRLFAALGKTYTQEEFEDLCFSFGIELDDVTTEKAIVRKEKHLEKEADEDEEIIYKIEIPANRYDLLCLEGLAQALRVFCGFQEIPTYILSDISKDAMLKMHVKPETSLIRPHVVCAVLRGLTFDKVRYNSFIDLQDKLHQNICRRRTLVAIGTHDLDKLEGPFTYEALPPSSINFTPLKQERSFRADELMEFYKSDLKLKKFLHIIEDSPVYPVIYDSKRTVLSLPPIINGAHSAITLDTKNVFIECTATDLTKAKIVLNTMVTAFAEYCENKFVIEPVEVISSDGKSHIYPDLSVYNMEVSLSYITGLIGVSLEAEEVTKFLNRMQLHAKQSTSDNKQCNFIVSVPPTRSDVLHPCDVMEDVAIAYGFNAIKDQAIVDNKGSKRLAASLTLLPLNELSDLIRKEVAMIGFTEVLTFILCSKKENFSMLNRKDDKSKAVIIGNPRSSDFEAVRTSLMPGILKTVAHNKDHPKPIKIFEVGDIAILDDNDVGAKNLRQLAALYCGANAGFEIIHGLVDKVMEKNGITFVSPGDKSGYYIERSDEPEFLAGRQARIIYKGKQVGTFGIVHPEVLNSFDIPDPCSFVELNIESFL

SEQ ID NO: 9589 - DNA, 1890 bp, Haloquadratum walsbyi
  CDS (1)..(1890): transl_table=11
atgccaattgtcgatatcaatatggacgaactgcggagtcttaccgctcatgatgaaaaatcagatgcagagtttaaatctgacctcttcgagcttgggcttgaattcgagggtaaaactgacacagatcttcttcaatttgaattcggtcctgaccgccttgatcgtctctctgttgagggtgttgcacgatcgctgcgatatcactacggtgatgaccgtggcatcgcggttccgtcaacaaacaaccctgagttccaatttattgttactgatactgttcccaccagacgaccctatgtcaccggcgctatcgctcgtggcgtaagtcttgataagcatgcgcttgattcactgatccaattgcaggaaaaacttcatgcaacgatgggtcggaaacgtgcaaaaggagcaattggaattcacgacctcacaatgttgaagggtcgcacacttgatgacagcggtgtcgatattactggtggaggcgagatggttgatactgctactgactctagacctaccgcagatcgtgaaacaaatacttctgcgactgactctccaacacattcgattacatacaccggcattgaaccaacaggtgataccttcgtgccacttgattcgaatcgtgaactaacacctgctgcagtccttgatgagcacccaacgggcgaaacatatgcggatatcattgcggattatgaccgatatccggctatctatgatgaacttggactgttctcgttccccccagtaatcaacggccgccgaacggaggtgacaacggactcacggaatctcctaattgagctgaccggaactgatcagtggacgattgaccggatgtgcacgattatctgctatgcactcacagcgcgtggtgcgacaatcgagtctgttaatattgaatatcctgaacagaccctctcccgacctgacctcacagtcgacacaaaacacatctcgcatgaccgtattgagacgattctcggcgtttcatttgacacagctgagatcatcgacttattcgaacgtgctggacttgctgcgactaccactgatacgactgatacagcagtaacatcaaatgtggatattgatgggtccaataattctcctgtatatgtcgtttcaattcccccataccgcgttgatgtgctccatccactcgatttaattgacgatgtcggtcgtgcatatggttttgataaacttgaaccacgctaccccgatattgggacagtcggcgggagacatgaacggtcacggcttgaagcggtaactcggacaacactgacaggacttggatttgaggatttattgaacttccatctgacaaataaagctgcagtatacaaccgcatgcgaatgagcccactgtcaccggctacatttaattcaacaaccgatgatatagaccttggctcagcacctcccgctgaaataacagatccatatagcggtgattacaccattcttcgaccatggatccttccatcgctcgtacaagttcttgaaaataatactcatcgtacatatccgcaggatcttgcggaagttggggttgttgctaatcgtgatgactctgtaaacactcatgttgctgaacgccgtcatgttgcaggtgctgttgctcgtcacgatgcaacttatgaagatgcaaaggcagcacttcaagcagtatgtcgtgaattcgatgctacactccagacaccaccaacgacacacccttcattcattgatggacggacagcagccattattatcaatgatacctcagtgggcgtcatcggtgaaatacatcctgaagtacttgttgagcatgatctcgcagtccctgtagctgcatttgagtttgaacttgcagcgcttgcctcggaagcgtaa

SEQ ID NO: 9590 - protein, 629 aa, Haloquadratum walsbyi
MPIVDINMDELRSLTAHDEKSDAEFKSDLFELGLEFEGKTDTDLLQFEFGPDRLDRLSVEGVARSLRYHYGDDRGIAVPSTNNPEFQFIVTDTVPTRRPYVTGAIARGVSLDKHALDSLIQLQEKLHATMGRKRAKGAIGIHDLTMLKGRTLDDSGVDITGGGEMVDTATDSRPTADRETNTSATDSPTHSITYTGIEPTGDTFVPLDSNRELTPAAVLDEHPTGETYADIIADYDRYPAIYDELGLFSFPPVINGRRTEVTTDSRNLLIELTGTDQWTIDRMCTIICYALTARGATIESVNIEYPEQTLSRPDLTVDTKHISHDRIETILGVSFDTAEIIDLFERAGLAATTTDTTDTAVTSNVDIDGSNNSPVYVVSIPPYRVDVLHPLDLIDDVGRAYGFDKLEPRYPDIGTVGGRHERSRLEAVTRTTLTGLGFEDLLNFHLTNKAAVYNRMRMSPLSPATFNSTTDDIDLGSAPPAEITDPYSGDYTILRPWILPSLVQVLENNTHRTYPQDLAEVGVVANRDDSVNTHVAERRHVAGAVARHDATYEDAKAALQAVCREFDATLQTPPTTHPSFIDGRTAAIIINDTSVGVIGEIHPEVLVEHDLAVPVAAFEFELAALASEA

SEQ ID NO: 9591 - DNA, 1770 bp, Aspergillus oryzae
  CDS (1)..(1770)
atgcccaccatttcggtcgacaaggccgcgctcttcaaagagctcggacgggagtacactaccgaggaatttgatgagctgtgcttcgaattcgaccgaccaatcgtggatggagtgcaggagcctcctcagctcaagatcgaaatcccggccaaccgatatgacatgctgtgcttcgagggaattgccctcatgctcaacatcttcttaggtcggaagtctctgcccaactacagactggtcgagcccgcaaatggtgagctgcagaagatcattgttaaggaggatactacgaaaatccgacccttggtctctggtgctatcttgcggaacatcaagttcgatcaagctcgctatgaatccttcatcgccctgcaagacaaacttcaccagaaccttgcaaggcaaagaacgctcgtttcgatcggtactcacgacttggatacgatacaaggacctttcacctacgaggccttgcctcctaaagacatcaaatttgttcctttgaaccagacccaggaaatgaacggagaggagttgatggccttctacgagaaagacaagcacctgggtagataccttcacattattcgcgactcccctgtctaccccgtcatctacgattcgaagcggacagtttgctccctgcctcccatcatcaacggcgaccattctaagatcaccctggacactaagaacgttttcatcgagattactgccctcgacaagacgaaggttgagattgtcaacaagatgatggttgcgatgttctcccaatatacttcggagcctttcacgattgagccagttcaaattgtctccgaccacaacggcgagaccagaatcacgccagatatgtcttctcgtacaactcaggccgaggtctcctaccttaaccagtgctgcggcttgaacctctctgcagaggaaatcgcgaagatcctgacgaagatggcctataccgctagaccctccgcagaatccgccgacctgatcgacgtggacatcccacctactcgtgctgatgtcctccaccaggccgatatcatggaagatgtcgccattgcttacggcttcaataacctcccacggtccttcccaagcaagtctggtaccatcgcccagcccttacctatcaacaagctctcggacatcgtccgaactgaggctgcaatggcgggctggtctgaggtcttgcctctcatcctgtgctcccatgacgagaacttcgcctggctcaaccgcaaggacgatggtaacactgctgttaagctggccaatcccaagacactggagttccaggtcgtccgcacaagcctcctgcctggtcttctgaagaccattcgggaaaacaagcaccacagcgttcccatgaagatcttcgaggtcagcgacgtagcgttcaaggacctttcgctcgagcgtaagagccggaacgagagacactttgccgccgcatggtatggcaagaacagtggtttcgaagtagtccacggtcttctggaccgcgtcatggccatgctcaagagtgcgttcatcaccggtgaggagggtctcgagaaacccggtatgagcgactctcagtactggatcgaggagcttgatgaggcaacctacttccccggccacgccgcttctgttcacctgcgaatcggcggcaaggagcacgtcatcggtgccttcggtatcttgcaccctacggtattggagaagtacgaactgaaataccccgtcagcacgttggagctcaacatcgaggctttcctatga

SEQ ID NO: 9592 - protein, 589 aa, Aspergillus oryzae
MPTISVDKAALFKELGREYTTEEFDELCFEFDRPIVDGVQEPPQLKIEIPANRYDMLCFEGIALMLNIFLGRKSLPNYRLVEPANGELQKIIVKEDTTKIRPLVSGAILRNIKFDQARYESFIALQDKLHQNLARQRTLVSIGTHDLDTIQGPFTYEALPPKDIKFVPLNQTQEMNGEELMAFYEKDKHLGRYLHIIRDSPVYPVIYDSKRTVCSLPPIINGDHSKITLDTKNVFIEITALDKTKVEIVNKMMVAMFSQYTSEPFTIEPVQIVSDHNGETRITPDMSSRTTQAEVSYLNQCCGLNLSAEEIAKILTKMAYTARPSAESADLIDVDIPPTRADVLHQADIMEDVAIAYGFNNLPRSFPSKSGTIAQPLPINKLSDIVRTEAAMAGWSEVLPLILCSHDENFAWLNRKDDGNTAVKLANPKTLEFQVVRTSLLPGLLKTIRENKHHSVPMKIFEVSDVAFKDLSLERKSRNERHFAAAWYGKNSGFEVVHGLLDRVMAMLKSAFITGEEGLEKPGMSDSQYWIEELDEATYFPGHAASVHLRIGGKEHVIGAFGILHPTVLEKYELKYPVSTLELNIEAFL

SEQ ID NO: 9593 - DNA, 1788 bp, Saccharomyces cerevisiae
  CDS (1)..(1788)
atgcctaccgtctccgtgaacaagcagcaattatttgatcttctaggcaaaaactacacttcccaagagttcgatgaattatgttttgaattcggtatggaaatggacgaagacaccacagaggaggccttgaaaaccggggaggagccggaattgaagcttgatatcagtgccaatcgttacgatttgctttgtatcgaaggtatttcacagtcgctgaacgaatacttggaacgtaaagaaagacctgactataaattaagcaagccaaccactaagttgatcatcgacaaatcaacggagcaaattagaccttttgctaccgctgctgtattgagaaatatcaagcttaacgaaaaatcttacgcttcttttattgccttgcaagataaattacatgccaatctatgtagaaacagaagcttggttgccatgggtactcacgatttagattcaattgaaggtccattccattacagagctctaccaccaaaggacatcaagttcgtaccattgaatcaaacccaagagtttactggtgacaaattgatcgagttttataaatctccagaacagaaaaacaacatagggagatacgttcacattattgaggattctccagtcttcccagttattatggacagcaaagatcgtgtttgctccctgccaccattaatcaatagtgaacattcgaagatctctgtgaacacccgtaacattttgattgatataaccgccaccgataagaccaaagccgagatcgttttgaacatattaactacaatgttctcacgttattgtgacgaaccattcacggttgagcctgtagaaattgtctctgaacacaatggccaatcccgtttggcgccaaacttcaacgatagaattatggatgtctccattaagtacatcaactcctgtcttggcctagatcaatccgctgatgaaattgctcattgtctaaagaagatgtcgttgcatgccgttcaatcaaaggaagacaaggacatcttgcacgttgacattccggtaactagacctgatattttgcacgcttgtgatataatggaagatgccgctgtcggttatggtttcaataatttgccaaagggtgagaaattatccaatgccaacttcattgccaaaccattaccaatcaacaaggtttctgatattttcagagttgcatcctctcaagccacgtgggttgaggttttaccattgaccttatgttcgcacgatgaaaactttaaatttctaagacaatccgacaatggtgatttagctgtcaaattggccaacccaaagactttggaataccaagttgttagaaccactttattgcctggtatcttaaagacagtcaaggaaaacagaaaacattccttgccaatcaaagtctttgaaaccggtgacgttgtatttaaagacgacaaactagaaaggaaggcgtacaatgaacgtcactgggctgccatctacgtgggtaagaattctgggtttgaaatcattcaagggttattgggtaaaatcatgcaaacttttagaacagagtggattgcagactacggtgctgctgcttctggcagaggttactggattgaagaagacgattctgtgaaaacctacctcccaggtagaggtgccaaggtcatgttcagatccaaagaaggcgctgagccaaagcaaatcggccacttgggtgtcttgcatcctgaagtcatgatgaatttcgacgttccattcgctgcatcctttgtagaggttaatgccgaagtcttcctataa

SEQ ID NO: 9594 - protein, 595 aa, Saccharomyces cerevisiae
MPTVSVNKQQLFDLLGKNYTSQEFDELCFEFGMEMDEDTTEEALKTGEEPELKLDISANRYDLLCIEGISQSLNEYLERKERPDYKLSKPTTKLIIDKSTEQIRPFATAAVLRNIKLNEKSYASFIALQDKLHANLCRNRSLVAMGTHDLDSIEGPFHYRALPPKDIKFVPLNQTQEFTGDKLIEFYKSPEQKNNIGRYVHIIEDSPVFPVIMDSKDRVCSLPPLINSEHSKISVNTRNILIDITATDKTKAEIVLNILTTMFSRYCDEPFTVEPVEIVSEHNGQSRLAPNFNDRIMDVSIKYINSCLGLDQSADEIAHCLKKMSLHAVQSKEDKDILHVDIPVTRPDILHACDIMEDAAVGYGFNNLPKGEKLSNANFIAKPLPINKVSDIFRVASSQATWVEVLPLTLCSHDENFKFLRQSDNGDLAVKLANPKTLEYQVVRTTLLPGILKTVKENRKHSLPIKVFETGDVVFKDDKLERKAYNERHWAAIYVGKNSGFEIIQGLLGKIMQTFRTEWIADYGAAASGRGYWIEEDDSVKTYLPGRGAKVMFRSKEGAEPKQIGHLGVLHPEVMMNFDVPFAASFVEVNAEVFL

SEQ ID NO: 9595 - DNA, 1965 bp, Arabidopsis thaliana
  CDS (1)..(1797)
atgccaaccatcagtgttggcagagaccgtttgttcgctgctcttggagaatcctatactcaggaaaaattcgaggaactgtgtttcagtttcggtatcgagcttgacgatgtgactactgaaaaggcaataatcagaaaagagaagcacatcgatgaagaagctgatgatgatgaagaaatcatctacaagattgaaattcctgccaacagacctgatttgctttgcctcgaagggcttgctcaatctcttcgcgttttcatcgagaaacaggagataccaacgtatactcttgctgacattagcaaagacaagatccttcaaatgaatgttaaacctgagacatcgaagattcgtccatttgttgtatgtgctgttttaagaggtgtaacctttgacgaggctcgttacaacagcttcattgatcttcaggataagttacatcagaatatttgcaggcgaaggtccttggttgctattggaactcatgaccttgatacattgcagggtcctttcacatacgaggctttgccgccaacggatataaattttgtacctttgaagcaaacaaagagcttcagggctgacgaacttattgaattctacaagtctgatatgaagctgaaaaagtttctacacataatcgagaattcacccgtcttccctgttttatacgacagtaagagaactgtgctgtcattgccacctattatcaatggtgcacattcagcaattaccttacagacaaagaatgtcttcattgaatgtactgcaactgatttgacgaaggccaagattgttttgaatacaatggttacaaccttctcagaattttgtgccagaaaatttgagattgagcctgttgaagttacatacgacgatggaaagtcatacatctatccggatttagctgtctatgatatggaagttcctctctctttcattacagactcaattggagtctctttaaaggtggaacaggttacaagtctgctgacccgaatgcagctgcaagctgagcaagcaaaatctagtgataaccagtgtgccatcaaagtacatgtaccccccagcaggagcgacgttctccacccttgtgatgttatggaggatgttgccattgcctatggtttcaataacattccaacaagaaagcctgcttcgataaaaccactgactttgaatgagctcactgatcttctaagaatagagattgcgatgtgtgtgtacacggaggtggtaacgtggctactatgctcacataaggaaaactttgcgatgctaaatagagaggatgttaattcagccgtcatagttgggaacccgcggtctgctgattttgaggccatgaggagggctctcatgcccggattattgaagacagttggtcacaacaataaataccctaaaccaattaagatttttgaaatcagtgatgtggtcatgttggatgagagcaaagacgttggtgcatccaatcgtcgccatctcgctgcactatactgtggtgctacttctggatttgagcttatccatggcctggtcgataggatcatggaagtgatggcaataccatttctaacaatccatgaaaataacgtaccaatcaatgaaaaagacggatactatgtaaagctctcccaagaacccgagtttctaccgggcaggcaagctagcatcattgtcagagggaaacatattggtaactttggaatcgtgcatcctgaggttttgaacaactttgacatccctgatccatgctcttacttggagttagacatcgaagctatcttatagaaaaagaaaccaaccaaaatgttttcttctctttgtgcaatatcgttatctggattatttgaagttgttgattttgtttggttagaggatctagaacacgcatgtcgagagaattactacaaatatttaactgctctgctgttttttaccccatttgtaagatccagc

SEQ ID NO: 9596 - protein, 598 aa, Arabidopsis thaliana
MPTISVGRDRLFAALGESYTQEKFEELCFSFGIELDDVTTEKAIIRKEKHIDEEADDDEEIIYKIEIPANRPDLLCLEGLAQSLRVFIEKQEIPTYTLADISKDKILQMNVKPETSKIRPFVVCAVLRGVTFDEARYNSFIDLQDKLHQNICRRRSLVAIGTHDLDTLQGPFTYEALPPTDINFVPLKQTKSFRADELIEFYKSDMKLKKFLHIIENSPVFPVLYDSKRTVLSLPPIINGAHSAITLQTKNVFIECTATDLTKAKIVLNTMVTTFSEFCARKFEIEPVEVTYDDGKSYIYPDLAVYDMEVPLSFITDSIGVSLKVEQVTSLLTRMQLQAEQAKSSDNQCAIKVHVPPSRSDVLHPCDVMEDVAIAYGFNNIPTRKPASIKPLTLNELTDLLRIEIAMCVYTEVVTWLLCSHKENFAMLNREDVNSAVIVGNPRSADFEAMRRALMPGLLKTVGHNNKYPKPIKIFEISDVVMLDESKDVGASNRRHLAALYCGATSGFELIHGLVDRIMEVMAIPFLTIHENNVPINEKDGYYVKLSQEPEFLPGRQASIIVRGKHIGNFGIVHPEVLNNFDIPDPCSYLELDIEAIL

SEQ ID NO: 9597 - DNA, 1644 bp, Archaeoglobus fulgidus
  CDS (1)..(1644): transl_table=11
atgccagttgtcacgctttactgggatgaactcgaaaggctcgttggggctgacagggataccattctttcccgcctccccatgcttggatgcgatatcgagagagttgaggatgaccacgttgatgttgagttctttcccaaccgccctgatttgtacagcgtcgagggcgttgcgagggctttgaggggcttcctcggcatagagaaggggctgaaaagctactctgcagtcaaaggagagtggaagattacagttgaggagagcgttcttgcggtgaggccgagaattgttggctgtgttgttaagggcatcaggatgactgatgaggtcatcagaagcctcatggaggttcaggaggacctgcactggacaatagggaggaacaggagaaagatggccatcggagttcatgatttgagcaaggtttacttccccctccgctacaaagctgttgatgcgaacttctcctttgttccccttgactttgacagagaaatgacggttgcggagattctggaggagcatcccaagggaaaggcatacgctttcatactcgaagggaaggacagctatcccatgattgttgactctaaggatgaagtaatctccttccctccgataataaacgctgagaagaccagagtgaccgaagagactacagacctatttatcgacgttacaggcttcgacgagaacgttgacagggccattgccatacttgcctgcatgctcgcagacagaggtggcagaattgaaagtgttgaggtcgtttatcccgaccacgttgagcttacgccaaatcttgacgtcagattcatggaagttgacgttgatgaggtgaactcccttctcggtctgagcttatctgcagaagaaataaaagagtccctcgaaaagatgcgtttttcgtgcgaaattgagggggagaagctgaaggtgggaatccctccctacagggcggacataatgcacgagtgggatgttattgaggatgttgccataggctacggatacgagaacataaccccagaaatccctccaacgctcaccttcggcagaactcatccgtggaacgacatcaggagcctcgcaaaggaaataatgattggccttggatttaccgaggttataaccttcaccttaaccaatgaggcggtgatgtacgaaaagatgaggaggaagggcgagccgtggaaggactacgtgcctgttatgcacccactcacgactgagcacacaattctgcgaacatccctactgccaaagcttcttgagcttctctcctacaacaagcaccacgaaatgccccagatggtgtttgaggtgggagatgttgttgtaaactcgaagaacaggctgcatttggcagcatgcatcacccactcaagagcgaacttttccgaaatcaggagctacgttcaggcggtgatgagggagcttgatttgacatgggaggtaagggagtcggacgatgaagccttcatcgacggcaggagggccgagatagttgttgatggtaaagctgttggagttttcggggaggtacatcctgaggtccttgaaggctttgagcttacaatgcccgtctcagccttcgagattgatttgtcagctttttttgatacaggagagctgctatga

SEQ ID NO: 9598 - protein, 547 aa, Archaeoglobus fulgidus
MPVVTLYWDELERLVGADRDTILSRLPMLGCDIERVEDDHVDVEFFPNRPDLYSVEGVARALRGFLGIEKGLKSYSAVKGEWKITVEESVLAVRPRIVGCVVKGIRMTDEVIRSLMEVQEDLHWTIGRNRRKMAIGVHDLSKVYFPLRYKAVDANFSFVPLDFDREMTVAEILEEHPKGKAYAFILEGKDSYPMIVDSKDEVISFPPIINAEKTRVTEETTDLFIDVTGFDENVDRAIAILACMLADRGGRIESVEVVYPDHVELTPNLDVRFMEVDVDEVNSLLGLSLSAEEIKESLEKMRFSCEIEGEKLKVGIPPYRADIMHEWDVIEDVAIGYGYENITPEIPPTLTFGRTHPWNDIRSLAKEIMIGLGFTEVITFTLTNEAVMYEKMRRKGEPWKDYVPVMHPLTTEHTILRTSLLPKLLELLSYNKHHEMPQMVFEVGDVVVNSKNRLHLAACITHSRANFSEIRSYVQAVMRELDLTWEVRESDDEAFIDGRRAEIVVDGKAVGVFGEVHPEVLEGFELTMPVSAFEIDLSAFFDTGELL

SEQ ID NO: 9599 - DNA, 1701 bp, Borrelia burgdorferi
  CDS (1)..(1701): transl_table=11
atgccaaagttagaaatttataaaaatctttttttagataaaataggaaaaaattttacaaatttagagatttcagaattacttgaaccatttaaggcagaatttgatgggtttgatgagagttcgggaaaaatcaaaatagaatttaatgatacaaataggccagatttgtggtcttatttaggacttgctcgtcagataaaaacgtatttttttggagaaatgccctattatgattttttttcaaaaaagggagattttaagaagttttatggtgaaattttagttgatggcaaaatgtctcaaatcagaccgtttatttttggatttttagcaaaaggattgattattaatgataaaatgcttgagacactaattcaatttcaagaaaaactttgtcagaattatggacaaaagagaagaagaattgcaatggggatgtataattctaattttattaaattcccaataagttatattgcctcatctcctaatcacaagtttgttccctttggaatggattatgagctttctcttttagagataaatgaaaagcatcccaaaggattggaatattcacatattattaaaaattttgataagtttccgttattattagatgataataataatgtagtctcttatcctccaataattaattctaacaatattggatctttaaaggttggtgatactgatttatttgttgaggttacaggtattgattttgaagcaactttgttagcgttatctatagcagcctgtgatttttatgatatgggttttgaaattttgccggtaaaaactgtgtttagagagccttttaatttagattttaaagaattggtatgtccttattattttcaagaagaagtggagtttaatgttgaaaatattaatagactgcttggaagcaatttaacattagagcgtatttgccttagtttaaaaaaaatgggagtaaattcttattccaaagattttaagaattatattgttccacctttttatagaaacgattttcttcatgaggttgatgtaattgaagatgtaatgataggggagggtctttcaagttttaatccggagcttcccaaggcttttgcagtgggaaggcttagtcctttagaagagttttcaaggaatgttagaaatttaatggtgggtatgggatttcaagagatgatttataattatatgggttctaagaaagattttattgacagaatgaatattaatgatcaaaattttttaaaagtatctaatccaatgacagagaattatgaatatattagagcatcaataattcctaatttattaaaatcagaaagtgttagttctaattttccctatccacataaaatttttgaaattggcaaggtggctttaaagaatctggatactaccgaaggaacaagtacttttactaatttagcttttttaatgtctggtaaagaaatttcttttaatgagattaattcaattgttgcaacacttttttattatttaaatattgagattaatttaatagaatcaaaaaccactttttatattaatggcaggggagcggatattgtaattgaaggttttaatataggtggttttggcgaaatttcaccttatgtgttaaataattttggtatttttattccatgttctgtttttgaggttaatataaacaaacttatgagtcgatcttaa

SEQ ID NO: 9600 - protein, 566 aa, Borrelia burgdorferi
MPKLEIYKNLFLDKIGKNFTNLEISELLEPFKAEFDGFDESSGKIKIEFNDTNRPDLWSYLGLARQIKTYFFGEMPYYDFFSKKGDFKKFYGEILVDGKMSQIRPFIFGFLAKGLIINDKMLETLIQFQEKLCQNYGQKRRRIAMGMYNSNFIKFPISYIASSPNHKFVPFGMDYELSLLEINEKHPKGLEYSHIIKNFDKFPLLLDDNNNVVSYPPIINSNNIGSLKVGDTDLFVEVTGIDFEATLLALSIAACDFYDMGFEILPVKTVFREPFNLDFKELVCPYYFQEEVEFNVENINRLLGSNLTLERICLSLKKMGVNSYSKDFKNYIVPPFYRNDFLHEVDVIEDVMIGEGLSSFNPELPKAFAVGRLSPLEEFSRNVRNLMVGMGFQEMIYNYMGSKKDFIDRMNINDQNFLKVSNPMTENYEYIRASIIPNLLKSESVSSNFPYPHKIFEIGKVALKNLDTTEGTSTFTNLAFLMSGKEISFNEINSIVATLFYYLNIEINLIESKTTFYINGRGADIVIEGFNIGGFGEISPYVLNNFGIFIPCSVFEVNINKLMSRS

SEQ ID NO: 9601 - DNA, 1779 bp, Candida albicans
  CDS (1)..(1779): transl_table=12
atgccaactattcctgtagacaaagaagaccttttcaagttattgggtagatcatatactacagaagaatttgacgagttatgtttccaatttggtattgagttagatgaggataccactgaagatgtcaaaggtacagacgaaagaccacaattgaaaattgaagttcctgccaacagatacgatatgttatgtattgagggtattgctcaagctttaaatgaatttttaggtaacacatcagcaccaaattacaaattgagtcctagcaaaccagagatttctttgactattaaagaatcaacctaccctattcgtcaatatgctgccagtgcgattttgagaaacgtgaaccttgatgaaagagcctatgactcttttattgccttacaagataaattacatgcaaatttatgtcgtaacagaactttagtggctattggtactcatgatttagatactttgacaccaccatttacctatgaagccttggcacctaaagatattgttttcaaaccattaaatcaaactaaagaaatcaatggtgaagaattaatggagttctatgaaaaagataagaatattggtaagttcttgcatattattaaggattcgccagtttatcctgtcatgcttgatgccaacagaacagttgcttcgctcccaccaatcatcaatagtgatcactccaaaatcactttaaacaccaagaatgtttggattgatgtcaccggtactgatagaaccaaaactgaaattgttataaaccaattagtggccatgttttcacgttattgtaaggaaccttttgaaattgaaccagttcaaatcatttctgaacacaataatgaaactcgtgtatgtccaaatatcactccaagaacagctaaggctgagatttcatacatcaattcctgtgtaggattgaattactcaggtgaagaaatctcaaagttgttgaaaaaaatgtcattagatgctaccccatctactgaagagagagacatactcgatgtgaaaatcccaataacaagatctgatatcttgcaccaatgtgatattatggaggatgtcgctattgggtacgggtacgataatttgaagaagaccaaacctcaggctgaaagtttagttgctgccccattacctgtaaataaagttgctgatattttaaggttggcaagttctcaagctggttatttagaagtcatgcctttgactttatcttctcacgatgagaattttgcttggttgaaacagaaggatgatggtaccaaagctgttaaattggaaaatccaaagacaattgaataccaagttgttagaactactttgttacctggtattttaaaaaccgttaaagaaaatagaaaacactcgttaccaatcaaagtatttgaatgtggtgatattgttttgaagaatccagaattagaaagaggtgcttttaaccaacgtaattgggctgccttgtacgtaggtaagacttctggtttcgaaatggtccaaggtttattaggaaagatcatgcaaaccatgagaactccttggttagaaaatccttctaaagatcaaagaagagggtactggatagaggaagacaaagaaaacacaactttcttcccaggaagaggagccaagatttatttcagaaatgccgataatgctgaagccaaagctattggaagcattggtgttttgcatccagaagtaatgaataactttgacattccttatgcagcatcgtctgttgaaataaacgctgaagtatttttgtaa

SEQ ID NO: 9602 - protein, 592 aa, Candida albicans
MPTIPVDKEDLFKLLGRSYTTEEFDELCFQFGIELDEDTTEDVKGTDERPQLKIEVPANRYDMLCIEGIAQALNEFLGNTSAPNYKLSPSKPEISLTIKESTYPIRQYAASAILRNVNLDERAYDSFIALQDKLHANLCRNRTLVAIGTHDLDTLTPPFTYEALAPKDIVFKPLNQTKEINGEELMEFYEKDKNIGKFLHIIKDSPVYPVMLDANRTVASLPPIINSDHSKITLNTKNVWIDVTGTDRTKTEIVINQLVAMFSRYCKEPFEIEPVQIISEHNNETRVCPNITPRTAKAEISYINSCVGLNYSGEEISKLLKKMSLDATPSTEERDILDVKIPITRSDILHQCDIMEDVAIGYGYDNLKKTKPQAESLVAAPLPVNKVADILRLASSQAGYLEVMPLTLSSHDENFAWLKQKDDGTKAVKLENPKTIEYQVVRTTLLPGILKTVKENRKHSLPIKVFECGDIVLKNPELERGAFNQRNWAALYVGKTSGFEMVQGLLGKIMQTMRTPWLENPSKDQRRGYWIEEDKENTTFFPGRGAKIYFRNADNAEAKAIGSIGVLHPEVMNNFDIPYAASSVEINAEVFL

SEQ ID NO: 9603 - DNA, 1755 bp, Haloarcula marismortui
  CDS (1)..(1755): transl_table=11
atgccggtcgtcgacgtcgaccccgacgaactgcggtatctgaccggccacagcgagaaagacgacgacgaactcaaatcggacctgttcaacctcggcctcgaattcgagggctggaccgaggacgacgagttccaactggagttcgcgccggaccgactggaccgcctctccgtcgagggggtcgcccggtcgctgcggtatcactacggcgacgaccgcggggtggagattcccaacacgaacagcgctgactggacaattgaggtcgaggaccagcccgacgagcgcccgtatgtcaccggtgctatcgtccgcggtctggatatggacgaggccgcgctggagtcacttatccagctgcaggagaagctccacgcgacgatggggcgcaagcgggcgaaaggcgcgatcggggtccacgacctcaccatgctgaaaggcgactcggtcacggacgagacggggaagtctatcacctacaccagcgccgacccggacgaggcgacgttcgttccgctggacgccgacgcagagatgacccccagcgaggtcatggcgtctcacgaaaccggccagacctacggtgacctcgtggccgacttcgaccgcgtcccggcaatctacgacgcaatcggcctgttctcgttcccgccggtcatcaacggccgccggaccgaggtcagcgtcgactcccgggacctgttcatcgagatgaccgggaccaaccagtggaccatcgaccacatgtgcaacatcgtctgctacgcgctcgccgcccgcggcggccaggtcgaaaaggtcgacgtgtcctacgctgatgacgcgcccggggagtacgccggcaagacgctggaacgaccggacttctcggtccggacgaagacggtcacgcacgaccgtatcgagtccatcctcggcgtctcactggacagccgcgaggtcgtcgactacgccgagcgcgccggcctcgatgcgaccgagactgaatctgacgacggtgtggcatacgacgttgaggtcccgccgtaccgcgtcgatgtcatccacccgctggacatcattgacgacatcggccgggcgctcggattcaacagcctcgaaccgacgtaccccgacgtgtcgacggtcggcggtcggcatgaacggtctcggcttgaggacgccgcccgcgacgcgctcgtcggcctgggcttcgaggacctgctgaacttccacatgacaaacgaggtcgagaacttcgagcggatgaacctctcaacgccggaggccgaagacggaaacgacgcagacactgtcggtctggctgacccggtcaccattcaggagccatacagcgaggactacaccatccttcggacgtgggcgcttccctctatcatgatggtgttggagaacaacacccaccggagctacccgcaggacctcgccgaaatcgggctggccgccggtctcgacgactcggagaacaccggcgtcgccgaacaccgcactgttgccgccgcgctcgcgcgcacagacgcctcatacgaggacgcgaaggcccgactgcaggcgctcgccgacgccttcgacaaggacctcgaaacgccaccaaccacgcatccgtcgttcatcggcggccgcgccgccgaagtggttctcgacggggagtcggtcggcgtcatcggcgagattcatccgaaagtgcttgtcgaacacgatctggagctgccggtcgcagcattcgagttccggctggacgcgctggcgtaa

SEQ ID NO: 9604 - protein, 584 aa, Haloarcula marismortui
MPVVDVDPDELRYLTGHSEKDDDELKSDLFNLGLEFEGWTEDDEFQLEFAPDRLDRLSVEGVARSLRYHYGDDRGVEIPNTNSADWTIEVEDQPDERPYVTGAIVRGLDMDEAALESLIQLQEKLHATMGRKRAKGAIGVHDLTMLKGDSVTDETGKSITYTSADPDEATFVPLDADAEMTPSEVMASHETGQTYGDLVADFDRVPAIYDAIGLFSFPPVINGRRTEVSVDSRDLFIEMTGTNQWTIDHMCNIVCYALAARGGQVEKVDVSYADDAPGEYAGKTLERPDFSVRTKTVTHDRIESILGVSLDSREVVDYAERAGLDATETESDDGVAYDVEVPPYRVDVIHPLDIIDDIGRALGFNSLEPTYPDVSTVGGRHERSRLEDAARDALVGLGFEDLLNFHMTNEVENFERMNLSTPEAEDGNDADTVGLADPVTIQEPYSEDYTILRTWALPSIMMVLENNTHRSYPQDLAEIGLAAGLDDSENTGVAEHRTVAAALARTDASYEDAKARLQALADAFDKDLETPPTTHPSFIGGRAAEVVLDGESVGVIGEIHPKVLVEHDLELPVAAFEFRLDALA

SEQ ID NO: 9605 - DNA, 1704 bp, Halobacterium salinarium
  CDS (1)..(1704): transl_table=11
atgcccgtcgtcgacatcgatcccgacgaactccgccggctcaccggccaccgcagcaaggacgacgacgagctccgccaggacctcttcgggctcggcatcgaatacgagggcgaaaccgaggacggcgacttcaagcttgagttcgaagccgaccgcctcgaccgcctctccgtcgaaggcatcgcgcgcagtctgcgctaccacgccggcgacgaccgcggggtcgacatcccggacaccaacgccccggagtgggcgatcgacgtcaccgacgtccccgcggatcgcccgtacgtcaccggcgccgtgatccggggcgtcgacctcgacgcggacgccctggactcgctcatccagctccaggagaaactgcacgccacgatgggccgcaagcgagcgaagggcgccatcggcatccacgacctcgcgatgctcaaaggcgacaccgtcgacggcgacggcaccgccgcacgctcgctcacgtacacgggcatcgaccccgacggcgacacgttcgtcccgctcgacgacgacgccgaacgcacgcccgccgacgtgctcaccgaacaccccaccggcgagacgtacgccgacctcctggccgaccacgacacctacccagcgatctacgacgacatcgggctgttcagcttcccgccggtcatcaacggccgccgcaccgaggtcaccaccgactcccgggagctgttcgtcgaactcaccggcaccgaccagtggaccatcgaccggatgtgcgccatcatctgttacgcgctggacgcccgtggggcgaccatcgaggacgtcaccgtcgactaccccgaccgcgagctccaccgccccgacttcgcggtccgcaccaaacacgtcagccacgaccggatcgagacgctgctcggcgtcgagttcaccaccgaggcggtcgttgatctcgccgaacgcgccggcctcgacgccaccccgaccgacgacggctacgacgtcgaaatcccgccctaccgcgtcgacgtccgccaccccgtcgatgtcgtcgacgacctcgggcgcgcgtacgacttcaacgacctcacgccccgctatcccgacgtcaacaccatcggcggccgcaccgaatcctcgcgcctcgaacgctcggtgcgacaggcgctcgtcgggctcgggttcgaggatctcctgaacttcaacatgaccagcgaggccgagaacttcgaccgcatgcggctgacccccgaccacgacgcggtcggcgcggcccagccggccaccatcgccgaaccctacagccaggacttcacgatccttcgcacgtgggcgctgccctcgctggcgatggttctggagacgaacacccaccacgcgtatccgcaggacctcgccgaagtcgggttcgccgcccacgccgacggcgacacccagaccggggtcgccgaacgccgcaccgtcgccgccgtgctggcccgcaacgacgcctcctacgaggacgccaaggcccgcctccaggcgctttgcgacgagttcgcggtcgccctcgaaacgccgcccaccactcatccgtcgttcatcgacgggcgcgccgccaccatcgagatcgacggccagccggccggcgtcatcggtgaactccaccccggcgtcatcgtcgaacacgacgtcgaagtgccggtcgccggcttcgagttcgaactcgacgcgctccgttag

SEQ ID NO: 9606 - protein, 567 aa, Halobacterium salinarium
MPVVDIDPDELRRLTGHRSKDDDELRQDLFGLGIEYEGETEDGDFKLEFEADRLDRLSVEGIARSLRYHAGDDRGVDIPDTNAPEWAIDVTDVPADRPYVTGAVIRGVDLDADALDSLIQLQEKLHATMGRKRAKGAIGIHDLAMLKGDTVDGDGTAARSLTYTGIDPDGDTFVPLDDDAERTPADVLTEHPTGETYADLLADHDTYPAIYDDIGLFSFPPVINGRRTEVTTDSRELFVELTGTDQWTIDRMCAIICYALDARGATIEDVTVDYPDRELHRPDFAVRTKHVSHDRIETLLGVEFTTEAVVDLAERAGLDATPTDDGYDVEIPPYRVDVRHPVDVVDDLGRAYDFNDLTPRYPDVNTIGGRTESSRLERSVRQALVGLGFEDLLNFNMTSEAENFDRMRLTPDHDAVGAAQPATIAEPYSQDFTILRTWALPSLAMVLETNTHHAYPQDLAEVGFAAHADGDTQTGVAERRTVAAVLARNDASYEDAKARLQALCDEFAVALETPPTTHPSFIDGRAATIEIDGQPAGVIGELHPGVIVEHDVEVPVAGFEFELDALR

SEQ ID NO: 9607 - DNA, 1647 bp, Methanococcus jannaschii
  CDS (1)..(1647): transl_table=11
atgccaacaataaatgtaaaaaaagctgatttagagagattggttaatatgcccttagaggatgaatttattgaagagaaatttccaatgatgggtgttgaagttgaaggaatctttgaagaagatggagaaaaaattattcagttctcaataaacccaaatagaccagattatttaagtgctgaaggtttagcaagaggttttaggggaattattggaatagaaacaggattaaaaaaatacgacattgagagttcagatgtaaaattatatgttgagaatgttgaaacaagaccatacatagcaatggctttggttaaaggggttattgttgatgattatgttttagagagcataattaaccttcaagaaaagctccactgggttatgggaagagataggaaaaaagtggcaataggaattcatgatgcagataaagttaagcctccattctactacaaagaagttagtggggatgggattaagtttgttccattaaattcagatgaggaaatgacaccaagagagattttagaaaaacatgaaaaaggaataaaatatgctcatttaatcaaagatgataagtttccaataatattagatagtgaaggggatgttttatctatgccaccaataattaatggggaattaacaagagttacaactgaaacaaggaatttattgattgatgttactggaactgataaatatgcagtagaaaaaactctaaatattattgttactgcattggcagagagaaagtatggaaaaatacatgctgttgaagtaattaaagacaatcaaagcactatatatccaaatttaaaagaggatgtcttagaaactacttctgaatacataaacaaggttttaggagccaatctaactcctgggactataataaactacttaagaagatgtagattagacgctcaatttgtagataacaaaataaaggttttcatccctgcctatagagttgatatctttggagagattgacatcgctgaagaagtagctattgcttacggatataataagttctctggagaatatccaattattggaactattggggaacttaaccaattagaaaagaaatgtgactttataagagaaattatggttggatttggattctatgaggttataaatttaatgctttcaaatgatgaggttttatttaaaaagatgagaattgaagacaacaactatatagaagttttaaaaccagcatctatagagcatagaatcgttagaaaaagtatcttaccattgctaatggaaactttgaggataaataaacataaagagttgccacaaaagatttttgagattggagattgtgttgttattgatgaaaatgctgaaacaaaatcaagagttgttaaaaaaatagctggagttattgtagataatgaaacaaactttaatgagataaagagctatgttgaaggtttattgagagagcttaaaattgagtatgagcttgataattttgaacatccatcattcattaaaggaagatgtgctaaaatattgaaagatggcaaaattattggctactttggagagattcatccagaggttattaccaactttgaattagaattcccagttgttggatttgagttagagattgaataa

SEQ ID NO: 9608 - protein, 548 aa, Methanococcus jannaschii
MPTINVKKADLERLVNMPLEDEFIEEKFPMMGVEVEGIFEEDGEKIIQFSINPNRPDYLSAEGLARGFRGIIGIETGLKKYDIESSDVKLYVENVETRPYIAMALVKGVIVDDYVLESIINLQEKLHWVMGRDRKKVAIGIHDADKVKPPFYYKEVSGDGIKFVPLNSDEEMTPREILEKHEKGIKYAHLIKDDKFPIILDSEGDVLSMPPIINGELTRVTTETRNLLIDVTGTDKYAVEKTLNIIVTALAERKYGKIHAVEVIKDNQSTIYPNLKEDVLETTSEYINKVLGANLTPGTIINYLRRCRLDAQFVDNKIKVFIPAYRVDIFGEIDIAEEVAIAYGYNKFSGEYPIIGTIGELNQLEKKCDFIREIMVGFGFYEVINLMLSNDEVLFKKMRIEDNNYIEVLKPASIEHRIVRKSILPLLMETLRINKHKELPQKIFEIGDCVVIDENAETKSRVVKKIAGVIVDNETNFNEIKSYVEGLLRELKIEYELDNFEHPSFIKGRCAKILKDGKIIGYFGEIHPEVITNFELEFPVVGFELEIE

SEQ ID NO: 9609 - DNA, 1638 bp, Methanosarcina mazei
  CDS (1)..(1638): transl_table=11
atgccagtaatcaccttgcattatgaagacctcgagaaactcacgggaacagacaaggaaaccatcataaaaagagtgcccatgataggggccgatattgaaagggttgaagacgaatacgttgacatcgagttcttccctgacaggcctgacctctacagtgtggaaggggcagccagggcaatgcggggttttctggaccttgagaccggacttcccgaatacgagataaagccctataaggtgtccatatccgtaagtgaggatatcctgaaaatcaggcctttccttgggtgcgcggtcgtaaggggagtaaagttcacttcctcttccataaagtccctcatggaccttcaggaagaccttcactggggcctcggtagaaacaggaaaaaagtttctataggagtccacgacctcaaaaatgtgaagccgcctttcaggtatatggcagtggacccggggttcgagttcgtgcctcttgactacacggaaaagatgagcatgacagaaatccttgaaaaacatcccaaaggcacaaggtttgcccatctcgttagcggttttgaaaaatacccgatcatcctggacgcagacgacaatgtgctgtccttccctccaattatcaacggcacactcacatctgtgaccgaagagacaacagaccttttcattgacgttacagggcttggggaagctgtgtatacggctttaaacatcgttgtcacagcccttgccgaaagaggcggagaaattgagtttgtaagggtaatccgccccggaggcgaagagcttgtcctgcctgaccttgagccagaagaaaggctgcttacaacaggcgaggtaaagtccctgataggcatggaactcccggttgaagagatagtaaaacagcttgaaaggatgcgctttggggcatgcgccctggataaggaaactgttgaggtaagggttccggcttacagggcagatatcctgcacaattatgaccttgtggaggacattgccaaaggctatggttacgagaatatcaaggtaaagatccctgagacctataccgcaggcatgtcccacccgatttcccttatgcgggctccggtaaacgaaataatggtcgggctcggttattatgaggttatgcccttcacgcttaccagcgaaaaggtcaactttgaaaacatgtgcagagaaaagactgatgatgttacctacgtgcttcacccgataagcgaagaccagaccatgctcaggacaaccgtgctccccaatcttcttgaaatccttgccttaaaccagcacagggaacttccacagaagatatttgagttcggagaggtggtaagcaatgaaacaacaggtcagcacgttgctgcggtctccatccacccacaggcaaacttcaccgaagtatatgaggtagttgacgcctttatgagggagatgatgctctcttatgaagtaaaagagtcaaaagaccccgcattccttgaaggcaggcgggcagatgtttacgtcaacggtaaaaagcttggagttttcggagaattacagcctgaggtaataagcaagttttcactcgggtatgccgttgtaggattcgaacttgacctgaatgacctcataggtaaaaatatttaa

SEQ ID NO: 9610 - protein, 545 aa, Methanosarcina mazei
MPVITLHYEDLEKLTGTDKETIIKRVPMIGADIERVEDEYVDIEFFPDRPDLYSVEGAARAMRGFLDLETGLPEYEIKPYKVSISVSEDILKIRPFLGCAVVRGVKFTSSSIKSLMDLQEDLHWGLGRNRKKVSIGVHDLKNVKPPFRYMAVDPGFEFVPLDYTEKMSMTEILEKHPKGTRFAHLVSGFEKYPIILDADDNVLSFPPIINGTLTSVTEETTDLFIDVTGLGEAVYTALNIVVTALAERGGEIEFVRVIRPGGEELVLPDLEPEERLLTTGEVKSLIGMELPVEEIVKQLERMRFGACALDKETVEVRVPAYRADILHNYDLVEDIAKGYGYENIKVKIPETYTAGMSHPISLMRAPVNEIMVGLGYYEVMPFTLTSEKVNFENMCREKTDDVTYVLHPISEDQTMLRTTVLPNLLEILALNQHRELPQKIFEFGEVVSNETTGQHVAAVSIHPQANFTEVYEVVDAFMREMMLSYEVKESKDPAFLEGRRADVYVNGKKLGVFGELQPEVISKFSLGYAVVGFELDLNDLIGKNI

SEQ ID NO: 9611 - DNA, 1650 bp, Methanobacterium thermoautotrophicum
  CDS (1)..(1650): transl_table=11
atgcctgttataacgttcgattacgatgacctgaaggaactgggcattgatattgatagggagaagctccttgacgttctgccgatgatgggaagtgatatagaggactttgatgacgaaagcattaaggtggagttttttcccaaccgtcctgacctgctctcggttgagggtgttgcaaggagcctccgcggattccttggaattgaaaagggtatgccatcctatgatgtccatgactccggggtggaggtcacagtagatgagtctgtacttgatgtgaggccataccttggaatggccgtcatagaggacgttcagttcaccgataaaaaacttaaacaggtcatggagttccaggaggacctgcactgggtcataggcagggaccgcaggaaggtggccataggtatccatgaccttgaccgtgtcgagccacccttcctctacagtggcgttgaaccggagggagtcacattcacaccccttgacagtgtatgtgaaatgacaccccatgaaatactcgaggagcaccccaagggtgtcagttacgcccacctcctccgggaccatgaccgttaccccctgataacagataagaatggggacgttctctccatgccccccataataaatggggagctcaccaagttaaccgtgaacacccgcagaatacttgtggatgtcacaggaaccgatgatagggctgtcagacagaccctgaatatcatatgcacatcctttgcagaggcgggtggaaggataggctcggtgagggttaagcgtcctgatggagagctgcatctaccagacctcacaccacgtgagatgagggtatctgtctcagaagcctcacggataaccggacttgaactcagtgcagatgaggtcatggatctcctcatgaaggcccggatggacgcccggaggacctcagatgatgaggtggttgcggttatacccgcctaccgggtggatatactccacgaggttgaccttgttgagaacatagctgtgcagcactgcatagggaggattgaacccgaacttcctgatatagcgaccattgcagaggaggacacctggagcagggcagacgcgtctataagggaggtcatggtgggcctcggattccaggaggttatgagcctcatgttaaccagtgaggagagccactacaggaggatgaggcttgaggaggatgaaagggttgaggttgcccagcccatttcccaagacaggaccatgatccgcaagagtctgctcaacggcctccttgagttcttcgaggacaacaagcacgaggatcttccacagaagatattcgaggtcggggatgtggtgtacattaaccctgaatctgagacccgtagcagggtcgttacgaagcttgcatgcgcagtcacgcactccagtgcaggtttcaccgagataaagtcccttgcagcggctgtggttgagaacctcggttacgagttcaggatagagccccttgaacacccatccttcatagagggaagatgtgcagccatagaatctgagggcaaatcctcagccataggtggattcttcggtgaggtccatcctgaggttgtaacaaacttcaacctggaatatcctgttattgcacttgaaatcgaatttaagtag

SEQ ID NO: 9612 - protein, 549 aa, Methanobacterium thermoautotrophicum
MPVITFDYDDLKELGIDIDREKLLDVLPMMGSDIEDFDDESIKVEFFPNRPDLLSVEGVARSLRGFLGIEKGMPSYDVHDSGVEVTVDESVLDVRPYLGMAVIEDVQFTDKKLKQVMEFQEDLHWVIGRDRRKVAIGIHDLDRVEPPFLYSGVEPEGVTFTPLDSVCEMTPHEILEEHPKGVSYAHLLRDHDRYPLITDKNGDVLSMPPIINGELTKLTVNTRRILVDVTGTDDRAVRQTLNIICTSFAEAGGRIGSVRVKRPDGELHLPDLTPREMRVSVSEASRITGLELSADEVMDLLMKARMDARRTSDDEVVAVIPAYRVDILHEVDLVENIAVQHCIGRIEPELPDIATIAEEDTWSRADASIREVMVGLGFQEVMSLMLTSEESHYRRMRLEEDERVEVAQPISQDRTMIRKSLLNGLLEFFEDNKHEDLPQKIFEVGDVVYINPESETRSRVVTKLACAVTHSSAGFTEIKSLAAAVVENLGYEFRIEPLEHPSFIEGRCAAIESEGKSSAIGGFFGEVHPEVVTNFNLEYPVIALEIEFK

SEQ ID NO: 9613 - DNA, 1671 bp, Pyrococcus abyssi
  CDS (1)..(1671): transl_table=11
atgccaaagttcgacgtttcaaagtcggacctcgagaggctcgttggaaggagcttctcacttgaagagtgggaagacttagttttgtatgcgaagtgcgagcttgacgatgtctgggaggaaaacgggaaagtatacttcaaactcgactcaaaggacacgaacaggccagatctgtggagtgcggagggagttgctaggcaaattagatgggcccttggacttcaaagtggtttacctgagtacgaagtcaaggagagcgatgttgtagtttacgtcgatgagaagctcaagaacgttagaccttacggagtctacgcgatagtagagggccttaacttagatgaggactcgctcagccagatgatacagttgcaggagaaggtggccttaacgtttggtaggagaaggagggaagttgcgatagggatattcgactttgagaaagtgaaacccccaatctactatagggcagccgaaaaaacggagaaattcgtgccattaggctttgaagaagagttaactttggaggaaatacttgaaaagcacgagaaggggatagagtatggacacttaatcaaggacaagccccactaccccctcttagtggatagcgagggtaacgtcctctcaatgcccccaataattaactccgagctcactggcagagtgacgactgagacaaagaaggtcttcatagatgtcaccggctgggatctaaagaaggtcatgctagcactcaacgtcatggtaactgcactggcggagcgcggaggaaagataaggagcgtgaaggtgatttacaaggacttcgagatagtgacccccgacctaacgccaaagaggtttgaagtcgaacttaattacataaggaagctctcgggtttggacctcaaggatgaggagataaaggagctacttgaaaggatgatgtactcggtggagctggaagatgggaaggcaaagctactctacccggcgtttagggatgacataatgcacgcgagggatgttctagaggatgtgctcatagcctatggatacaacaacatagaacctgaggaaccaaagctggcagttcagggtagaggagacccgtttaaggactttgaagatgcaataagggatttaatggtaggcttcgggcttcaggagataatgactttcaacttgacgaacaaggaggttcagttcaagaagatgaacatcccggaagaagagatagttgagatagcgaacccagtaagtcaaagatggagcgccctaaggaagtggttattgccaagtttaatggagttcctaagcaataacacccacgaggagtacccccagaggattttcgaggttggtcttgcaacgcttattgacgaatcaagggaaacgaaaacgatcagcgaaccaaaacttgccgttgcgctcgcgggtagcgaatatacgtttacaaacgcaaaggaaatactggattcattgatgagacacctcggagttgaatacgagatagaagaaaccgagcacggaagcttcatctcaggaagggttggaaaggtactagtgaatggaaaagaagtagggattataggcgagatacatccccaagtcctcgagaactggaatattgaggttcccgtagttgcgtttgagatattcttaagacccctctatcagccttga

SEQ ID NO: 9614 - protein, 556 aa, Pyrococcus abyssi
MPKFDVSKSDLERLVGRSFSLEEWEDLVLYAKCELDDVWEENGKVYFKLDSKDTNRPDLWSAEGVARQIRWALGLQSGLPEYEVKESDVVVYVDEKLKNVRPYGVYAIVEGLNLDEDSLSQMIQLQEKVALTFGRRRREVAIGIFDFEKVKPPIYYRAAEKTEKFVPLGFEEELTLEEILEKHEKGIEYGHLIKDKPHYPLLVDSEGNVLSMPPIINSELTGRVTTETKKVFIDVTGWDLKKVMLALNVMVTALAERGGKIRSVKVIYKDFEIVTPDLTPKRFEVELNYIRKLSGLDLKDEEIKELLERMMYSVELEDGKAKLLYPAFRDDIMHARDVLEDVLIAYGYNNIEPEEPKLAVQGRGDPFKDFEDAIRDLMVGFGLQEIMTFNLTNKEVQFKKMNIPEEEIVEIANPVSQRWSALRKWLLPSLMEFLSNNTHEEYPQRIFEVGLATLIDESRETKTISEPKLAVALAGSEYTFTNAKEILDSLMRHLGVEYEIEETEHGSFISGRVGKVLVNGKEVGIIGEIHPQVLENWNIEVPVVAFEIFLRPLYQP

SEQ ID NO: 9615 - DNA, 1671 bp, Pyrococcus furiosus
  CDS (1)..(1671): transl_table=11
atgccaaagtttgacgttgcaaaatcagacttggaaagattagttggaagagagttttcagttgaagagtgggaagaccttgttctttatgctaagtgcgagctcgatgacgtttgggaagaagatggaaaaatatatttcaagttggactcaaaagacactaataggccagatctttggagcgctgagggcgttgctcgacaaataagatgggctcttggattagccaagggattgccaaaatatgaagtcgaggaaagtgatgttgttgtttatgttgataaaaagctcagaaacataaggccctacggtgtttacgccgtagtagaaggattaaagctagatgaagaagccttgagtcagttaattcagctccaagaaaaagttgccctaacctatggaaggaggagaagagaagtcgcaatagggatatttgattttgacaaagtaaagcccccaatatattacagagctgcagaaaagacagaaaaatttgtcccccttggatatagtgaggaaatgacgttagaagaaatccttgaaaagcacgagaaaggaagggagtatggccacttaataagagacaagccttactacccacttcttgttgattcagaaggtaacgtcctttcaatgcctccaataataaactccgagctaacggggagagtgaccacagagaccaagaatgtgttcgtggacgtcacgggatgggatctgagaaaagtcatgttagccctgaatgtaatagtcacggcgctcgccgaaagaggagggaaaatcaaaagggttaaagtgatttaccctgacttcgagatcacgactcctgacttgactcctaaagaatttgaagttagttttgagtacataagaaagctttctgggttagagttaagcaatgaagaaatcaaggaacttttagaaagaatgatgtatgaagttgaaattctcagtgaaaacaaggcaaaagtaaagtatccagccttcagagatgacataatgcacactagagatgtacttgaggatgtgttaattgcttacgggtacaataatatagacccagaagagccaaagttagctgtccaagggagaggtgatccatttaaggactttgaggatgcaattagggatttaatggtgggatttggtctccaggaagtcatgacttttaacttaacaagcaaagaagtccagtttgacaagatgaacattccagaggaggaaattgttgaaatagcaaatccaattagtagcagatggagcgcattaagaaaatggttacttccaagtttgatggaattccttagcaacaacactcatgaagaatatccacaaaggatattcgaggttggtttagcaactttgatagacgagagcagagaaactaagactgttagtgaacctaagcttgcagtagctctagccggaagtggatacaccttcaccaacgcaaaggaaatacttgactccttaatgagacacctaggaattgaatatgatatagaagagacagtgcatggaagctttatcccagggagagttggaaagatacttgtggatggaaaggaaatcggaatcataggagagattcatccacaagttctagaaaattggaatatccaagttccagttgttgcttttgagatatttttgaagcctctctatcgctga

SEQ ID NO: 9616 - protein, 556 aa, Pyrococcus furiosus
MPKFDVAKSDLERLVGREFSVEEWEDLVLYAKCELDDVWEEDGKIYFKLDSKDTNRPDLWSAEGVARQIRWALGLAKGLPKYEVEESDVVVYVDKKLRNIRPYGVYAVVEGLKLDEEALSQLIQLQEKVALTYGRRRREVAIGIFDFDKVKPPIYYRAAEKTEKFVPLGYSEEMTLEEILEKHEKGREYGHLIRDKPYYPLLVDSEGNVLSMPPIINSELTGRVTTETKNVFVDVTGWDLRKVMLALNVIVTALAERGGKIKRVKVIYPDFEITTPDLTPKEFEVSFEYIRKLSGLELSNEEIKELLERMMYEVEILSENKAKVKYPAFRDDIMHTRDVLEDVLIAYGYNNIDPEEPKLAVQGRGDPFKDFEDAIRDLMVGFGLQEVMTFNLTSKEVQFDKMNIPEEEIVEIANPISSRWSALRKWLLPSLMEFLSNNTHEEYPQRIFEVGLATLIDESRETKTVSEPKLAVALAGSGYTFTNAKEILDSLMRHLGIEYDIEETVHGSFIPGRVGKILVDGKEIGIIGEIHPQVLENWNIQVPVVAFEIFLKPLYR

SEQ ID NO: 9617 - DNA, 1671 bp, Pyrococcus horikoshii
  CDS (1)..(1671): transl_table=11
atgccaaagttcgacgtttcaaagtctgatttagaaagactcattggaagaagcttcagcatagaagagtgggaagatttagtactttatgccaagtgtgagcttgacgatgtttgggaggaaaatggaaaggtatatttcaagctcgattcaaaggatacaaataggcctgatctatggagcgctgagggagttgcgaggcagataaagtgggccctcggaattgaaaagggcttacctaaatacgaggttaaaaagagtaacgtaacggtttacgttgatgaaaagcttaaagatataaggccttatggagtttacgcaatagttgaaggtttaaggctcgacgaagattctttaagtcaaatgattcagctacaagaaaagatagcccttacatttggaagaagaaggagagaagtggccataggaatcttcgattttgataagattaagccacctatttactataaagccgccgaaaaaactgaaaagtttgcccccctgggctataaagaggaaatgactctagaggagatccttgaaaagcatgaaaagggaagggagtatgggcaccttataaaggataaacaattttatccactacttattgacagcgaggggaatgtgctctccatgccgccaataatcaactccgagtttacgggaagagtaacaacggatacgaaaaatgtcttcatagatgtcacgggatggaagcttgagaaggtaatgcttgcccttaatgtcatggtaactgcattagcagagcgtggaggtaaaataaggagcgttagggttgtctacaaggacttcgaaattgaaaccccagatttaactcccaaagaatttgaagtcgagctggactacataagaaagctttcagggcttgagctaaatgatggagagataaaagagttgctagagaaaatgatgtacgaggttgagatatcgagaggaagggccaagcttaagtatccagccttcagggatgatataatgcatgccagggatatattggaagatgttctaatagcttatggatataataacatagagcccgaggaaccgaagctagcagttcagggaaggggagatcccttcaaagactttgaagatgcaataagggacttaatggtgggctttggattgcaggaggtaatgacgtttaacttgaccaataaggaagtccagttcaagaagatgaacattccagaggaagagatcgttgagatagctaacccaattagccagagatggagtgctttaaggaagtggatcttacctagtcttatggaattcttaagcaataatacccacgaggaatatccacagaggatatttgaagtaggtctagccacgttaatagatgaatcgagggaaacgaaaacggttagcgaacctaagcttgcggtagccctagcgggtacaggttatacgtttacaaatgcaaaggaaattctggatgcactgatgaggcacttagggtttgaatatgagatagaagaagttgaacatggaagctttatcccaggaagggcggggaaaattatagtcaatggaagggatattggaattatcggtgaagtgcacccacaagtcctagaaaactggaacatagaggttcctgttgttgccttcgagattttcctgagacccctttatcgccactaa

SEQ ID NO: 9618 - protein, 556 aa, Pyrococcus horikoshii
MPKFDVSKSDLERLIGRSFSIEEWEDLVLYAKCELDDVWEENGKVYFKLDSKDTNRPDLWSAEGVARQIKWALGIEKGLPKYEVKKSNVTVYVDEKLKDIRPYGVYAIVEGLRLDEDSLSQMIQLQEKIALTFGRRRREVAIGIFDFDKIKPPIYYKAAEKTEKFAPLGYKEEMTLEEILEKHEKGREYGHLIKDKQFYPLLIDSEGNVLSMPPIINSEFTGRVTTDTKNVFIDVTGWKLEKVMLALNVMVTALAERGGKIRSVRVVYKDFEIETPDLTPKEFEVELDYIRKLSGLELNDGEIKELLEKMMYEVEISRGRAKLKYPAFRDDIMHARDILEDVLIAYGYNNIEPEEPKLAVQGRGDPFKDFEDAIRDLMVGFGLQEVMTFNLTNKEVQFKKMNIPEEEIVEIANPISQRWSALRKWILPSLMEFLSNNTHEEYPQRIFEVGLATLIDESRETKTVSEPKLAVALAGTGYTFTNAKEILDALMRHLGFEYEIEEVEHGSFIPGRAGKIIVNGRDIGIIGEVHPQVLENWNIEVPVVAFEIFLRPLYRH

SEQ ID NO: 9619 - DNA, 1725 bp, Pyrococcus kodakaraensis
  CDS (1)..(1725): transl_table=11
atgccgaagttcgacgtttcaaagcgcgaccttgagaggctcgtcgggaaaactttcagcgtcgaggagtgggaagacctcttcctctacgccaaatgtgagctggacgacgtctgggaggagaacggtgaaatctacttcaaggccgactcaaaggacaccaacaggcccgacctctggagtgccgagggtatagcgaggcagatacgattcgcccttggcttccagaagggtttgccgaagtacgagatcgagaagagtgacgttgtagtttacgtggacgagaagctgaaggacatcaggccctacggtgtctatgcaatcgttgagggcctgaacatcgatgaagaggccctgaggcagatgatcaacctgcaggagaaggtcgcgctcaccttcggaaggaggagaagggaggtagcgataggcatcttcgacttcgacaaggtcaagccgccgatatactaccgcgccgctgagaagaccgagaagttcgttcccctcggctacgacgaggagatgacgcttgaggaaatccttgagaagcacgagaagggaagggaatacggacacctgataaaggacaagccctactatcctctcctcgtggacagtgagggcaaagtcctctcgatgccgccggtaatcaactccgagacaactggaagggtgacaaccgagaccaaaaacgtcttcgttgatataaccggctgggacttgaataaagtcatgcttgccctcaacgtcgtcgtcacagctctcgctgagcgcggcggaaagataaagagcgtgaaagtagtttatccagacttcgagatagagactccagacctaacgccgaaggagttcgaggtcgagctcgactacatcagaaaattagccggccttgagctgagcgacggggaaatcaaggagctccttgagagaatgatgtacgaggtcgagcttgagaacagaagggcaaagctccgctatccggccttccgcgacgacataatgcacgcgagggacgttcttgaggacgtgctcattgcctacggatacaacgagatcgaaccagaggagccgaagctggcagtccagggaaggggcgacaagttcatcgagttcgaggacgccgttagggagctcatggtcggctttggcttacaggaggtcatgacgttcaacctgacgaacagggaggcccagtacgacaggatgaatctcccctgcggggagcaccaggaggagtgccgggactacttcaaccacccgcccgctgagctcgtggaaatagagaacccgataagcccgaagtggtcagctttgaggaactggctcattccgagtttgctcgacttcctgagccagaacacccacgaggagtatcctcaaaagttgttcgaggtcggaaaggctacgctcatagacgagagcagggagactaagacggtcagcgagagcaagctggcagtggctttagctcatccgcgcgtgaccttcacagaggcaaaagaaatcctcgagggcgttatgcgtcacctcggcttcgagtacgagcttgaagaggcagaacacccgagcttcattccgggcagagttggtaagatcattgttaacggggagacgataggagttataggggagatacacccggccgtcttagagaactggggaattgagatgcccgttgcggccttcgagctgttccttgctccgctctacacggagccctatctatga

SEQ ID NO: 9620 - protein, 574 aa, Pyrococcus kodakaraensis
MPKFDVSKRDLERLVGKTFSVEEWEDLFLYAKCELDDVWEENGEIYFKADSKDTNRPDLWSAEGIARQIRFALGFQKGLPKYEIEKSDVVVYVDEKLKDIRPYGVYAIVEGLNIDEEALRQMINLQEKVALTFGRRRREVAIGIFDFDKVKPPIYYRAAEKTEKFVPLGYDEEMTLEEILEKHEKGREYGHLIKDKPYYPLLVDSEGKVLSMPPVINSETTGRVTTETKNVFVDITGWDLNKVMLALNVVVTALAERGGKIKSVKVVYPDFEIETPDLTPKEFEVELDYIRKLAGLELSDGEIKELLERMMYEVELENRRAKLRYPAFRDDIMHARDVLEDVLIAYGYNEIEPEEPKLAVQGRGDKFIEFEDAVRELMVGFGLQEVMTFNLTNREAQYDRMNLPCGEHQEECRDYFNHPPAELVEIENPISPKWSALRNWLIPSLLDFLSQNTHEEYPQKLFEVGKATLIDESRETKTVSESKLAVALAHPRVTFTEAKEILEGVMRHLGFEYELEEAEHPSFIPGRVGKIIVNGETIGVIGEIHPAVLENWGIEMPVAAFELFLAPLYTEPYL

SEQ ID NO: 9621 - DNA, 1770 bp, Schizosaccharomyces pombe
  CDS (1)..(1770)
atgcctaccatcagctgtgacaaggaagagctgtacaaggccctaggaagagagtacacaactcaagagtttgatgaactctgcttccaatttggaattgagcttgatgaagacactacaaatgacccagaaagaagtccttctgagcgtccttctttaaaaattgacattccggcaaatcgctacgatatgctctgcttagaaggaatcgcccaggctttgaatgtgtttaatcgtcgcatggctactcctcaatacaaattacttccttccaccacttcactcacaatttcccctgaaacctcggaaattcgtccttatgccgctgcagctatcttacgaggtgtgaagcttgatcccattcgttaccagagcttcattgccttacaagacaagttacatgcaaatttgtgtagaaaccgtacccttgtagccattggtacccatgacttctctgtaatggaaggtccgtttacctacgaggcattaaaacccgaagagatcaatttcgttcctttgaatcaaacccaggaaatcaatggttctaatttattagaattttacaaggatagtaaacatctttcccgttatttacacatcattgccaactctcccagatatcctgtaattttggatgctaagagaagggtttgctcacttccccctatcattaatagtgagttcagtaagatcagtgtggatacccgggacatcttcatcgatgttaccgcaaccgataaaactaaactcgaaattgttgtcaacatgatgaccacgatgttctcttgttactgtgaagagccttttaccattgagcctgttaatatcatatctgagcacaatgggtgtactcgtgttactcctaatttgaatcctacatgttttaaagctgatatcgactatttgaacgaagcctgtggattgtcccttcccgaagatgagatctgtcatttgttgacccgaatgatgcttacagcaaagcccaacccaaatgattccaagactcttttggtatacgttccacccttgcgcgctgatattcttcaccagtgtgatattatggaggatcttggcattgcttatggatatgacaatttgaaacacacttatcctgctcatagtgttacatttggcaagccttttgaggttaatcgactagctgacattattcgtaatgaagttgcatatgctgggtggtccgaggtcatgcctttcatcctttgctcccatgacgagaattatgcatggcttcgaaagactgatgattcaaaagctgttcaacttgcaaatcccaagactttagaatttcaagttgttcgttcaagcttgcttcctggtattttgaaaacggttcgcgagaacaaaaatcatgctttaccgattaaaatatttgaagtcagcgacgtagccttttgtgattattccagagagcgcatgactcgtaatgagcgtcatctttgcgccatttttgcaggtttgaactctggttttgaacaaattcatggcttgttagatcgtgtgatgcttatgttaaatactaaacgcatcatgaatcccaaagattccgatgctgtgggatactggatcgaggctgaggacgacagcacctttttcccaggtcgatgtgcagcagtgtactatcgtaaagattttggtactgctggaattcgcgttggtgtatttggtgttctccatccccttgttttagagaagtttgaactcacttctgctgcttccgctgttgaaattgatttgacactttgggtttag

SEQ ID NO: 9622 - protein, 589 aa, Schizosaccharomyces pombe
MPTISCDKEELYKALGREYTTQEFDELCFQFGIELDEDTTNDPERSPSERPSLKIDIPANRYDMLCLEGIAQALNVFNRRMATPQYKLLPSTTSLTISPETSEIRPYAAAAILRGVKLDPIRYQSFIALQDKLHANLCRNRTLVAIGTHDFSVMEGPFTYEALKPEEINFVPLNQTQEINGSNLLEFYKDSKHLSRYLHIIANSPRYPVILDAKRRVCSLPPIINSEFSKISVDTRDIFIDVTATDKTKLEIVVNMMTTMFSCYCEEPFTIEPVNIISEHNGCTRVTPNLNPTCFKADIDYLNEACGLSLPEDEICHLLTRMMLTAKPNPNDSKTLLVYVPPLRADILHQCDIMEDLGIAYGYDNLKHTYPAHSVTFGKPFEVNRLADIIRNEVAYAGWSEVMPFILCSHDENYAWLRKTDDSKAVQLANPKTLEFQVVRSSLLPGILKTVRENKNHALPIKIFEVSDVAFCDYSRERMTRNERHLCAIFAGLNSGFEQIHGLLDRVMLMLNTKRIMNPKDSDAVGYWIEAEDDSTFFPGRCAAVYYRKDFGTAGIRVGVFGVLHPLVLEKFELTSAASAVEIDLTLWV

SEQ ID NO: 9623 - DNA, 1629 bp, Sulfolobus acidocaldarius
  CDS (1)..(1629): transl_table=11
atgccaaccatagtctcttataaatggaccttaataaataacttaaaaataagcgataaccagctagaagaactactgtttaaacttaagtctgaagttaaaccgatagatgctgaccacgtggaaatagaagtaaacaatgatagacctgatttatttttcccttacggtattataagagcggcaaagggcatcttaggtaaagaattaggagagcctaaatacgacataaaacaaagtgtatattctttcgaggtaaaggaggtaaaaagtagaccttatgcggtagctggaatagtgaaggacataaagttggatgacgagagcttacgagagcttattcagtttcaggaaaagttacatattacagtaggtaggaagagaaaaaaggttgcaataggaatacatgatctagataaaattacgtcaactaagatatattataaaccactaccacttgactataaattcatacccctaaatcagtctaaacttatgacaataaaagaagtgatagaacaaactccccaaggcagagagtatgggaacatctcgatttatgacggattaagtccagcaatagtggaagaaaatggtgatgtgctaagtataccaccaataataaatagtgataagacccgtatagatgaaaaaactagaaatatattcatagatgttactggaacgtcatttgaggcggtatcttcaactcttgatatactggtaacagatctcgctgaaatgggtggtaaaatagaactgctgaattttatttcaccatccaagtttgagttttcgcccttactaagaaggtacacagtaagtgtatcagcaaactatatttccaaaaatctaggaataaatttgagtctaaatgaaatagaaaagtatctcagaatggctagatttgatactaaagtcttaaatgacgttgtagaggtcacagttccaccttatagagtagatattctctcccagatagatttagtagaagaaatagcaatgaccataggttatgataaattatcaccaaaagattataccataaaagctacaggtaaattatcggcagaaactgagctaataagaacacttagggatttaagtataggagcaggattcagtgaaatatttacatttattttgtccaatgataagaggctaagaaacgaatatgtaagtatagttaatccagtaacagtagagtacaatgctgtgagaaattcattgatacccactttacttaactttctaaaatataaccagcatgcaataatgcctgtttacgtttttgaaataggggatgtcgtgataaaggataagcgaaccgacactggttataagaactctctcagagcagtatatggaataatgaatagtaaagtaaactatgaggacttgcagtcgcgagtacatcaaatattaatgagccttgacatagaaccaacctacaagacgtacttagacgatatgtttatacctggaagaggggcaaagatcattgatacaagtaaaagtgttgaaataggagtgattggcgagataaatccggtcctgttagaggaacttgaaatagaatttccagttgtaataagtgagatttaccttgatagcttagtaaaacggtga

SEQ ID NO: 9624 - protein, 542 aa, Sulfolobus acidocaldarius
MPTIVSYKWTLINNLKISDNQLEELLFKLKSEVKPIDADHVEIEVNNDRPDLFFPYGIIRAAKGILGKELGEPKYDIKQSVYSFEVKEVKSRPYAVAGIVKDIKLDDESLRELIQFQEKLHITVGRKRKKVAIGIHDLDKITSTKIYYKPLPLDYKFIPLNQSKLMTIKEVIEQTPQGREYGNISIYDGLSPAIVEENGDVLSIPPIINSDKTRIDEKTRNIFIDVTGTSFEAVSSTLDILVTDLAEMGGKIELLNFISPSKFEFSPLLRRYTVSVSANYISKNLGINLSLNEIEKYLRMARFDTKVLNDVVEVTVPPYRVDILSQIDLVEEIAMTIGYDKLSPKDYTIKATGKLSAETELIRTLRDLSIGAGFSEIFTFILSNDKRLRNEYVSIVNPVTVEYNAVRNSLIPTLLNFLKYNQHAIMPVYVFEIGDVVIKDKRTDTGYKNSLRAVYGIMNSKVNYEDLQSRVHQILMSLDIEPTYKTYLDDMFIPGRGAKIIDTSKSVEIGVIGEINPVLLEELEIEFPVVISEIYLDSLVKR

SEQ ID NO: 9625 - DNA, 1635 bp, Sulfolobus solfataricus
  CDS (1)..(1635): transl_table=11
atggtaactatagtattaaataaatataaattattaaataaaataggcataggtcaacagaaactagaggatttattgtttaacttaaaatcagagataaaaccagttgacgaaagtaatattgaaatagagataaatgctgaccgattagatctactctcctctgatgggatagctagagcgattaaaggcttgttagaaaaagagctaggcgaagcaaagtatgatattacggatactgaatataagttaatagttgataatgtaagaacgagaccttacgcgttggctgctgtaatctataatgctaaaatagaccttcaagaactaatacagtttcaagaaaaacttcatagtaccatagggagaaagagaaaaaaggtagctataggcattcacgatctaaagaaaatagattcaaagaggatagaatatagggaagttcctctttcctataaatttattccattatatgaaaaggaagaacttacaattagcgaggtcttggaaaagactgagcaggggaaactttatggaaatatttcgatatctaatggagtatcaccagcaatagttcaagaagatggagaagtactaagcatacctccaataatcaactctgataagacaaaattggacgagagcacaaaagatctcttcatcgacgttactggaacttcctttgaagcagttgcgcaaaccctagatataatagtttcaaatctagcagaagctggagggacgataggaagagtaaaagtaataaaaactgataattccttccaacaatcttcgcccttactcatacataaaattcagaatgttagagaggaatatgcaaataaaattttaggaatcaaaatcagtgaagaagagatatgtaaacatataacgagaatgagaatgaattgtaacgtagaaaatggaatcataagagttacagtacctcaatatagggtagatataataaatgaaatcgatatagtagaggatattgcaatgagtattggatataataatctagaaccctctaagtatatttcgacaaactatggttcttatgattacttaacattactggaaaggaaaatgagggaattaagcatcggagcagggtttgtagaggtatttaactttgtgctaattaaaaatgaaaagatacttgatagtaagtatgtgaaaattctcaaccctatttctgaggaatataatgcagtaaggaattcgctaattccaatattattagattttctatctaaaaatcagcatgcgaaattcccaattagaatttttgagaccggagacgtggtaatttatgattcttcgacagatactggatttagaaatgataaaagggctgcatatgcaataatggacaataaggtaagttatgaagacgtgcaagcacctatccattacattttgaaaacattaggcatagaagtaaattataaggaagaaaataatgacattttcattgaaggacgttcagcatcaatagtgtatgaaaacgagaaaataggggtaataggtgaaattaatcctgacgtattaataagatttggtattgaatatcctacagtaatcgccgaactgtatatcacggagatagctaaaaaacttaacaagagataa

SEQ ID NO: 9626 - protein, 544 aa, Sulfolobus solfataricus
MVTIVLNKYKLLNKIGIGQQKLEDLLFNLKSEIKPVDESNIEIEINADRLDLLSSDGIARAIKGLLEKELGEAKYDITDTEYKLIVDNVRTRPYALAAVIYNAKIDLQELIQFQEKLHSTIGRKRKKVAIGIHDLKKIDSKRIEYREVPLSYKFIPLYEKEELTISEVLEKTEQGKLYGNISISNGVSPAIVQEDGEVLSIPPIINSDKTKLDESTKDLFIDVTGTSFEAVAQTLDIIVSNLAEAGGTIGRVKVIKTDNSFQQSSPLLIHKIQNVREEYANKILGIKISEEEICKHITRMRMNCNVENGIIRVTVPQYRVDIINEIDIVEDIAMSIGYNNLEPSKYISTNYGSYDYLTLLERKMRELSIGAGFVEVFNFVLIKNEKILDSKYVKILNPISEEYNAVRNSLIPILLDFLSKNQHAKFPIRIFETGDVVIYDSSTDTGFRNDKRAAYAIMDNKVSYEDVQAPIHYILKTLGIEVNYKEENNDIFIEGRSASIVYENEKIGVIGEINPDVLIRFGIEYPTVIAELYITEIAKKLNKR

SEQ ID NO: 9627 - DNA, 1623 bp, Sulfolobus tokodaii
  CDS (1)..(1623): transl_table=11
atgccgacaattaatatatacaagtggcgtctattaaatgagttaaaaattagtgaaacccaattagaggatttattatttaatctaaagtctgaaatgaaaccaatagaccaagatcatatagagatagaaataaacaatgatagaccagatttactatttgtttatggaattattagatcaataaaggggcttcttaagaaagagttaggagaaccaagatatagcgtcaaagatactgattacgtatttgagattaaagaagtaccaagtaggccttatgctctagcagctgttgttgaagatattaagtttgatgatgagttattaaaggaacttattcaatttcaagagaaacttcatataactgttgggagaaaaaggaaaaaaattgctataggattacatgatttaaagaaaatagattctaaacatattatctacacaactgttaatttagattataaattcattccattaaactcagataaagaaatgagcgtaagagagatccttgaatcaacacctcagggaaaagaatatggaaatatttcacttttagatggaaagatgccagcaataatgcaagatgatgggcaaattttaagtttaccaccagttataaattcagaaaaaactaggattaacagtaaaacgcaaagccttttcatagatgttactggaacttcacttgatacagttatattcacactagatgttatagttactaatcttgcggaaatgggcggaaaaattggtagaataaaagtaatttcaccatatgtggataactctccattgcttcaacataaatctataaagattacagcagaatatataaataaaattcttggaacaaatctgaataagaatgaaataatagaatatttaaaaatggctcggtttgatgttaacgatctaggaaaagaaatagaagttataattcccccgtatagaaatgatatcttgtctcaaatagatattacagaagaagttgcaattacatatggatacaacaatttgtcaccaacaccatataaaatagaaaaaataggttccttgtctgatagaactaagttaatacgagtattaagggacttaagcgttggaggaggatttacagagatatttacatttactttgattagtgaatcccttcttcttggagattttgttaaaatacttaacccaattacagttgactataattcagtaagaaactcacttttaccaagtatattaatattcttaagcaaaaatcaacacgctagaatgcctattagagtcttcgaaataggagacgttgtaattagaaacgagaacactgaaactggctattcaaataaattaaatgccgcatacgccattatgaatagtagagtgagttttgaggaactgcaagctccgcttcatgaaatcctaaatagtcttggaataaatcctatatataaaagagatactaatcccctctttatagagggaaggactgcgtctatttatgcaaataacaaaaagataggaattattggtgaaattaacccaaatatactggaaaaaatagatattgaatacccaattgttatgagtgaaatttatttagatgaaataaaagacatactttaa

SEQ ID NO: 9628 - protein, 540 aa, Sulfolobus tokodaii
MPTINIYKWRLLNELKISETQLEDLLFNLKSEMKPIDQDHIEIEINNDRPDLLFVYGIIRSIKGLLKKELGEPRYSVKDTDYVFEIKEVPSRPYALAAVVEDIKFDDELLKELIQFQEKLHITVGRKRKKIAIGLHDLKKIDSKHIIYTTVNLDYKFIPLNSDKEMSVREILESTPQGKEYGNISLLDGKMPAIMQDDGQILSLPPVINSEKTRINSKTQSLFIDVTGTSLDTVIFTLDVIVTNLAEMGGKIGRIKVISPYVDNSPLLQHKSIKITAEYINKILGTNLNKNEIIEYLKMARFDVNDLGKEIEVIIPPYRNDILSQIDITEEVAITYGYNNLSPTPYKIEKIGSLSDRTKLIRVLRDLSVGGGFTEIFTFTLISESLLLGDFVKILNPITVDYNSVRNSLLPSILIFLSKNQHARMPIRVFEIGDVVIRNENTETGYSNKLNAAYAIMNSRVSFEELQAPLHEILNSLGINPIYKRDTNPLFIEGRTASIYANNKKIGIIGEINPNILEKIDIEYPIVMSEIYLDEIKDIL

SEQ ID NO: 9629 - DNA, 23 bp, Artificial sequence
  primer
atgcctaccgtctccgtgaacaa

SEQ ID NO: 9630 - DNA, 25 bp, Artificial sequence
  primer
ttataggaagacttcggcattaacc

SEQ ID NO: 9631 - protein, 745 aa, Artificial sequence
  consensus sequence
  Variant (3)..(10): Xaa in position 3 to 10 is any amino acid
  Variant (12)..(31): Xaa in position 12 to 31 is any amino acid
  Variant (32)..(34): Xaa in position 32 to 34 is any or no amino acid
  Variant (36)..(51): Xaa in position 36 to 51 is any amino acid
  Variant (52)..(75): Xaa in position 52 to 75 is any or no amino acid
  Variant (77)..(77): Xaa in position 77 is any amino acid
  Variant (79)..(82): Xaa in position 79 to 82 is any amino acid
  Variant (85)..(85): Xaa in position 85 is any amino acid
  Variant (87)..(117): Xaa in position 87 to 117 is any amino acid
  Variant (118)..(125): Xaa in position 118 to 125 is any or no amino acid
  Variant (128)..(131): Xaa in position 128 to 131 is any amino acid
  Variant (133)..(144): Xaa in position 133 to 144 is any amino acid
  Variant (145)..(148): Xaa in position 145 to 148 is any or no amino acid
  Variant (150)..(151): Xaa in position 150 to 151 is any amino acid
  Variant (153)..(153): Xaa in position 153 is any amino acid
  Variant (157)..(160): Xaa in position 157 to 160 is any amino acid
  Variant (162)..(162): Xaa in position 162 is any amino acid
  Variant (164)..(165): Xaa in position 164 to 165 is any amino acid
  Variant (170)..(170): Xaa in position 170 is any amino acid
  Variant (173)..(180): Xaa in position 173 to 180 is any amino acid
  Variant (181)..(222): Xaa in position 181 to 222 is any or no amino acid
  Variant (224)..(231): Xaa in position 224 to 231 is any amino acid
  Variant (232)..(234): Xaa in position 232 to 234 is any or no amino acid
  Variant (236)..(236): Xaa in position 236 is any amino acid
  Variant (239)..(250): Xaa in position 239 to 250 is any amino acid
  Variant (251)..(251): Xaa in position 251 is any or no amino acid
  Variant (253)..(269): Xaa in position 253 to 269 is any amino acid
  Variant (270)..(276): Xaa in position 270 to 276 is any or no amino acid
  Variant (278)..(280): Xaa in position 278 to 280 is any amino acid
  Variant (281)..(281): Xaa in position 281 is any or no amino acid
  Variant (283)..(285): Xaa in position 283 to 285 is any amino acid
  Variant (286)..(286): Xaa in position 286 is any or no amino acid
  Variant (288)..(288): Xaa in position 288 is any amino acid
  Variant (290)..(290): Xaa in position 290 is any amino acid
  Variant (293)..(293): Xaa in position 293 is any amino acid
  Variant (296)..(304): Xaa in position 296 to 304 is any amino acid
  Variant (305)..(305): Xaa in position 305 is any or no amino acid
  Variant (307)..(310): Xaa in position 307 to 310 is any amino acid
  Variant (312)..(313): Xaa in position 312 to 313 is any amino acid
  Variant (315)..(349): Xaa in position 315 to 349 is any amino acid
  Variant (350)..(361): Xaa in position 350 to 361 is any or no amino acid
  Variant (363)..(380): Xaa in position 363 to 380 is any amino acid
  Variant (382)..(392): Xaa in position 382 to 392 is any amino acid
  Variant (394)..(411): Xaa in position 394 to 411 is any amino acid
  Variant (412)..(429): Xaa in position 412 to 429 is any or no amino acid
  Variant (431)..(432): Xaa in position 431 to 432 is any amino acid
  Variant (434)..(434): Xaa in position 434 is any amino acid
  Variant (436)..(437): Xaa in position 436 to 437 is any amino acid
  Variant (439)..(440): Xaa in position 439 to 440 is any amino acid
  Variant (442)..(443): Xaa in position 442 to 443 is any amino acid
  Variant (446)..(450): Xaa in position 446 to 450 is any amino acid
  Variant (452)..(475): Xaa in position 452 to 475 is any amino acid
  Variant (476)..(485): Xaa in position 476 to 485 is any or no amino acid
  Variant (487)..(492): Xaa in position 487 to 492 is any amino acid
  Variant (494)..(495): Xaa in position 494 to 495 is any amino acid
  Variant (497)..(501): Xaa in position 497 to 501 is any amino acid
  Variant (503)..(517): Xaa in position 503 to 517 is any amino acid
  Variant (518)..(541): Xaa in position 518 to 541 is any or no amino acid
  Variant (543)..(550): Xaa in position 543 to 550 is any amino acid
  Variant (552)..(555): Xaa in position 552 to 555 is any amino acid
  Variant (557)..(564): Xaa in position 557 to 564 is any amino acid
  Variant (566)..(570): Xaa in position 566 to 570 is any amino acid
  Variant (572)..(574): Xaa in position 572 to 574 is any amino acid
  Variant (577)..(590): Xaa in position 577 to 590 is any amino acid
  Variant (591)..(600): Xaa in position 591 to 600 is any or no amino acid
  Variant (602)..(610): Xaa in position 602 to 610 is any amino acid
  Variant (612)..(641): Xaa in position 612 to 641 is any amino acid
  Variant (642)..(667): Xaa in position 642 to 667 is any or no amino acid
  Variant (670)..(670): Xaa in position 670 is any amino acid
  Variant (672)..(680): Xaa in position 672 to 680 is any amino acid
  Variant (681)..(721): Xaa in position 681 to 721 is any or no amino acid
  Variant (723)..(724): Xaa in position 723 to 724 is any amino acid
  Variant (726)..(728): Xaa in position 726 to 728 is any amino acid
  Variant (730)..(730): Xaa in position 730 is any amino acid
  Variant (732)..(744): Xaa in position 732 to 744 is any amino acid
MPXXXXXXXXLXXXXXXXXXXXXXXXXXXXXXXXEXXXXXXXXXXXXXXXXXXXXXXXXXXXXXXXXXXXXXXXXRXDXXXXEGXAXXXXXXXXXXXXXXXXXXXXXXXXXXXXXXXXXXXXXXXRPXXXXAXXXXXXXXXXXXXXXXIXXQXKLHXXXXRXRXXVAIGXHDXXXXXXXXXXXXXXXXXXXXXXXXXXXXXXXXXXXXXXXXXXXXXXXXXXYXXXXXXXXXXXFXPLXXXXXXXXXXXXXEXXXXXXXXXXXXXXXXXXXXXXXXPXXXXDXXXXVXSXPPXINXXXXXXXXXXTXXXXIXXTXXXXXXXXXXXXXXXXXXXXXXXXXXXXXXXXXXXXXXXXXXXXXXXPXXXXXXXXXXXXXXXXXXGXXXXXXXXXXXLXXXXXXXXXXXXXXXXXXXXXXXXXXXXXXXXXXXXPXXRXDXXHXXDXXEDXXXXXGXXXXXXXXXXXXXXXXXXXXXXXXXXXXXXXXXXRXXXXXXGXXEXXXXXLXXXXXXXXXXXXXXXXXXXXXXXXXXXXXXXXXXXXXXXPXXXXXXXXRXXXXPXXXXXXXXNXXXXXPXXXFEXXXXXXXXXXXXXXXXXXXXXXXXAXXXXXXXXXFXXXXXXXXXXXXXXXXXXXXXXXXXXXXXXXXXXXXXXXXXXXXXXXXXXXXXXXXGRXAXXXXXXXXXXXXXXXXXXXXXXXXXXXXXXXXXXXXXXXXXXXXXXXXXXGXXGXXXPXVXXXXXXXXXXXXXE

SEQ ID NO: 9632 - protein, 29 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Asp or Glu
  Variant (8)..(8): Xaa in position 8 is Leu or Val
  Variant (9)..(10): Xaa in position 9 to 10 is any amino acid
  Variant (11)..(11): Xaa in position 11 is Ala, Asn, Ser, Thr or Val
  Variant (12)..(12): Xaa in position 12 is any amino acid
  Variant (13)..(13): Xaa in position 13 is Ala, Cys or Gly
  Variant (14)..(14): Xaa in position 14 is Gln or Arg
  Variant (15)..(15): Xaa in position 15 is any amino acid
  Variant (17)..(18): Xaa in position 17 to 18 is any amino acid
  Variant (19)..(19): Xaa in position 19 is Gly, Ile, Leu or Val
  Variant (20)..(20): Xaa in position 20 is Ala or Ser
  Variant (21)..(21): Xaa in position 21 is Ile or Met
  Variant (23)..(23): Xaa in position 23 is any amino acid
  Variant (24)..(24): Xaa in position 24 is Phe, His or Tyr
  Variant (25)..(25): Xaa in position 25 is Asp or Asn
  Variant (26)..(28): Xaa in position 26 to 28 is any amino acid
  Variant (29)..(29): Xaa in position 29 is Ile, Leu, Met or Val
IXXXQXKXXXXXXXXRXXXXXGXXXXXXX

SEQ ID NO: 9633 - protein, 41 aa, Artificial sequence
  protein pattern
  Variant (2)..(2): Xaa in position 2 is any amino acid
  Variant (3)..(3): Xaa in position 3 is Ser or Thr
  Variant (4)..(9): Xaa in position 4 to 9 is any amino acid
  Variant (11)..(12): Xaa in position 11 to 12 is any amino acid
  Variant (13)..(13): Xaa in position 13 is Ile, Leu or Val
  Variant (14)..(14): Xaa in position 14 is Ile, Leu, Met or Val
  Variant (16)..(16): Xaa in position 16 is any amino acid
  Variant (17)..(17): Xaa in position 17 is any or no amino acid
  Variant (19)..(23): Xaa in position 19 to 23 is any amino acid
  Variant (24)..(24): Xaa in position 24 is any or no amino acid
  Variant (26)..(30): Xaa in position 26 to 30 is any amino acid
  Variant (32)..(34): Xaa in position 32 to 34 is any amino acid
  Variant (37)..(37): Xaa in position 37 is any amino acid
  Variant (38)..(38): Xaa in position 38 is Gly or Ser
  Variant (39)..(40): Xaa in position 39 to 40 is any amino acid
  Variant (41)..(41): Xaa in position 41 is Ala, Gly, Thr or Val
PXXXXXXXXRXXXXPXXLXXXXXXNXXXXXPXXXFEXXXXX

SEQ ID NO: 9634 - protein, 28 aa, Artificial sequence
  protein pattern
  Variant (2)..(3): Xaa in position 2 to 3 is any amino acid
  Variant (5)..(5): Xaa in position 5 is any amino acid
  Variant (7)..(7): Xaa in position 7 is Ile or Val
  Variant (8)..(8): Xaa in position 8 is Phe, Ile, Leu or Met
  Variant (9)..(11): Xaa in position 9 to 11 is any amino acid
  Variant (13)..(13): Xaa in position 13 is Ile, Leu or Val
  Variant (14)..(14): Xaa in position 14 is any amino acid
  Variant (16)..(17): Xaa in position 16 to 17 is any amino acid
  Variant (18)..(19): Xaa in position 18 to 19 is any or no amino acid
  Variant (21)..(21): Xaa in position 21 is any amino acid
  Variant (22)..(23): Xaa in position 22 to 23 is any or no amino acid
  Variant (25)..(25): Xaa in position 25 is Phe or Tyr
  Variant (26)..(26): Xaa in position 26 is Asp, Glu, Gly or Asn
  Variant (27)..(27): Xaa in position 27 is any amino acid
  Variant (28)..(28): Xaa in position 28 is Phe, Ile, Leu or Val
PXXRXDXXXXXDXXEXXXXAXXXGXXXX

SEQ ID NO: 9635 - protein, 16 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is any amino acid
  Variant (9)..(9): Xaa in position 9 is any amino acid
  Variant (12)..(12): Xaa in position 12 is any or no amino acid
  Variant (14)..(14): Xaa in position 14 is any or no amino acid
  Variant (16)..(16): Xaa in position 16 is Ala, Gly or Ser
DXXXXVXSXPPXIXNX

SEQ ID NO: 9636 - protein, 25 aa, Artificial sequence
  protein pattern
  Variant (2)..(2): Xaa in position 2 is any amino acid
  Variant (3)..(3): Xaa in position 3 is Phe, Ile or Leu
  Variant (5)..(9): Xaa in position 5 to 9 is any or no amino acid
  Variant (11)..(11): Xaa in position 11 is Ile, Leu or Met
  Variant (12)..(13): Xaa in position 12 to 13 is any amino acid
  Variant (14)..(14): Xaa in position 14 is Phe, His, Trp or Tyr
  Variant (15)..(15): Xaa in position 15 is Ala, Asp, Glu, Gly, Asn or Ser
  Variant (16)..(16): Xaa in position 16 is Ile, Leu or Val
  Variant (17)..(18): Xaa in position 17 to 18 is any amino acid
  Variant (19)..(19): Xaa in position 19 is Ala or Pro
  Variant (20)..(20): Xaa in position 20 is Ala, Cys, Gly, Thr or Val
  Variant (21)..(21): Xaa in position 21 is Ala, Ser, Thr or Val
  Variant (22)..(23): Xaa in position 22 to 23 is any amino acid
  Variant (25)..(25): Xaa in position 25 is Phe, Ile, Leu or Val
GXXGXXXXXVXXXXXXXXXXXXXEX

SEQ ID NO: 9637 - DNA, 546 bp, Saccharomyces cerevisiae
  CDS (1)..(546)
atggctggcaaagcagggaggaaacaggctagttcaaatgcaaaaataattcagggcttatacaagcaagtctctttgtttttaggaatggctatcgtacgtctattcatttcacgtaaggttacaattggccaatggattaagctggtggctttgaacgttcctatgttcgttgctctgtatatcattgtgctatccggtaagcccaaatatgatggcaatcgcgtagtaaaacaaggtatagacttgaacgacaatacaaatttgatatcatatttttttgatttgatatatctatcactttttggtaacattggtattatagctttcaggacattcaaattttggtggtgtctactattgtgccccatctatgctggttacaagttatatggcctcaaaaacatgttcatgcctggcgctcaacaaactcaggcagataatcgctcaaaaaatgctaatgagggacaatccaaatccaaaaggcagatgaaaagggagaggaggggtgaaactgactctaaaattaagtacaagtatcgttaa

SEQ ID NO: 9638 - protein, 181 aa, Saccharomyces cerevisiae
MAGKAGRKQASSNAKIIQGLYKQVSLFLGMAIVRLFISRKVTIGQWIKLVALNVPMFVALYIIVLSGKPKYDGNRVVKQGIDLNDNTNLISYFFDLIYLSLFGNIGIIAFRTFKFWWCLLLCPIYAGYKLYGLKNMFMPGAQQTQADNRSKNANEGQSKSKRQMKRERRGETDSKIKYKYR

SEQ ID NO: 9639 - DNA, 525 bp, Oryza sativa (japonica cultivar-group)
  CDS (1)..(525)
atggcgaagcaaggggtgaagaagacgagggacgcgaacaagaagcggatggacctcatcctgcgcctaatcctcgcggccaacgttatttacatagtagtgagaatggctgtaatgcattcgtctttcacctggaagcattggattggtcttgctgtgacatctgctgcatattttctgccgtacaagcaacttgccaatatgtcagagccagaatactctgagaatggagagttaattaatgctggttatgacttgaacgctggtggaatgtccgaatatttacaagatgtgatatatatcactctctttgtgcagctgatgtctattttttctgataaattttggtggacatatttggtgattccagcttatggtggatacaagatttccggtctgttgagaggagcatttttcggtggtagttcagagggcgaagaagaggatgagaagacccgaaagaaaagggagaagatggagaagaaggcatctagggggaagattatcaaaaccaggactcgttga

SEQ ID NO: 9640 - protein, 174 aa, Oryza sativa (japonica cultivar-group)
MAKQGVKKTRDANKKRMDLILRLILAANVIYIVVRMAVMHSSFTWKHWIGLAVTSAAYFLPYKQLANMSEPEYSENGELINAGYDLNAGGMSEYLQDVIYITLFVQLMSIFSDKFWWTYLVIPAYGGYKISGLLRGAFFGGSSEGEEEDEKTRKKREKMEKKASRGKIIKTRTR

SEQ ID NO: 9641 - DNA, 522 bp, Arabidopsis thaliana
  CDS (1)..(522)
atggcgaatcaaggagcgaagaaacgaaaggaagagaacgccaaacacatggctaagctccgtcgtatcatcatcgcttccaatgctgtgtatttcgttgtgaggatgttgattttctactcaagctttacttggaaacattggatcggtttagtgataacttcgctggcttacgcgtttccttataagcagcttgatcaaatggctaaacctagtgttactgatgatggtgagcttattgatggtggatttgacatgaccactggtggaatctgcggatatttgcacgatgtcatctatatcacttgctttgttcagctagcttccatcatcactgggaagttttggtacacgtatcttgtgattcctgcgtttggagtgtataaagcttctggtcttattcgaggattcatgtcacaaggttcagagggaggtgtggaagatgaaaagtctcgtaaaaagagagagaagatggagaggaaagcttcgagagggcaagtcgtcaagacgagaacaagatga

SEQ ID NO: 9642 - protein, 173 aa, Arabidopsis thaliana
MANQGAKKRKEENAKHMAKLRRIIIASNAVYFVVRMLIFYSSFTWKHWIGLVITSLAYAFPYKQLDQMAKPSVTDDGELIDGGFDMTTGGICGYLHDVIYITCFVQLASIITGKFWYTYLVIPAFGVYKASGLIRGFMSQGSEGGVEDEKSRKKREKMERKASRGQVVKTRTR

SEQ ID NO: 9643 - DNA, 522 bp, Arabidopsis thaliana
  CDS (1)..(522)
atggcgaatcaaggagcaaagaagaggaaagatgagaacgctcgacacatggctaagctccgtctcattatgatcctttgcaacattttgtatgtcctagtgagggttataatttcgcattcaagtcatacctggaaaaattggattggtcttgtgttaacatcgttaggttacgggattccatataagcttcttcatcaaatggcaaagcctagtgttagtgatgctggtgaacttcttgatggtggatttgacatgagcactcctggaatgtgtggatatttgcatgatgtactctacatcacctgctttgtgcaggtcggatctatcatctctggaaagttttggtacgcgtatttagtgatccctgcatttggagcatacaaagcttctggtcttattaagggactattgtcacatggttcagagggaggtgttgaggatgagaagactcgcaaaaagagggagaagatggagagaaaagcttctagaggacaagtcgttaagacaagatctcgatga

SEQ ID NO: 9644 - protein, 173 aa, Arabidopsis thaliana
MANQGAKKRKDENARHMAKLRLIMILCNILYVLVRVIISHSSHTWKNWIGLVLTSLGYGIPYKLLHQMAKPSVSDAGELLDGGFDMSTPGMCGYLHDVLYITCFVQVGSIISGKFWYAYLVIPAFGAYKASGLIKGLLSHGSEGGVEDEKTRKKREKMERKASRGQVVKTRSR

SEQ ID NO: 9645 - DNA, 492 bp, Magnaporthe grisea 70-15
  CDS (1)..(492)
atggcacaaaaagcaaaaaaagatcgcgccaagtccaacgcggccaccctttacaaacttcacgtcggatccgcattggtacatgccaccttcctgctctgccacaccatcctcaagccgcgatctctgctgggctacatcctcgtgtccgtccctagcttcatctgccagcttacgctggaaaaggccggtcgaccgaagcacgatgccaacggcacactcaagtcttcgggtgaggacctggcagcatccgggctaaccgagtacatgttcgacgttgtctgggtcacgtgggcaacattggtcctcgttatcctctttggaaattcactttactttatctggctcctcatcccagcatttgctgcatacaagggatttggtctggtggggactgcccggcagatggccggtttgcaaaaaggcggcgttgatccagccggtgcgcaacagcaacctgctagtaaccggaaacaacgacgtgcggcatga

SEQ ID NO: 9646 - protein, 163 aa, Magnaporthe grisea 70-15
MAQKAKKDRAKSNAATLYKLHVGSALVHATFLLCHTILKPRSLLGYILVSVPSFICQLTLEKAGRPKHDANGTLKSSGEDLAASGLTEYMFDVVWVTWATLVLVILFGNSLYFIWLLIPAFAAYKGFGLVGTARQMAGLQKGGVDPAGAQQQPASNRKQRRAA

SEQ ID NO: 9647 - DNA, 522 bp, Candida glabrata CBS 138
  CDS (1)..(522)
atggcgggcaaagctactaagaaacaagctgcttccaatagcaatactttgaacactctgcacaaagttgctggacccgtgctggtcttagcgttcttgaggacagtactgggctctaacaacacatatatcaagtttgtgatgttcaatttgccaatgtgtgcatgcctttacattttggagaagactggtaggccgcaatatgacagcaaggggaaagttgtgcgtgaaggtatggacttgagccaagctggtggtatgactgagtacatgtttgatttgatctatctgagtatcattgccaatgttggtagaattatcttcaataccaacaaatggtggtacttgctgctcttgtgcccaatctacgtcggctacaagctatactccttgaagcagcaatactttggatctaccccaggaccagtcatcccagacaagatgcctgaagaaactaagtccaagagacaaatgaaaagagagaagcgtggtgacgataaagttaagtacaaatacaggtaa

SEQ ID NO: 9648 - protein, 173 aa, Candida glabrata CBS 138
MAGKATKKQAASNSNTLNTLHKVAGPVLVLAFLRTVLGSNNTYIKFVMFNLPMCACLYILEKTGRPQYDSKGKVVREGMDLSQAGGMTEYMFDLIYLSIIANVGRIIFNTNKWWYLLLLCPIYVGYKLYSLKQQYFGSTPGPVIPDKMPEETKSKRQMKREKRGDDKVKYKYR

SEQ ID NO: 9649 - DNA, 546 bp, Kluyveromyces lactis NRRL Y-1140
  CDS (1)..(546)
atggctggaaaatcgtccaagaagattgctgcaaagaacgcagccatcttaaagcagttgcacgtactagtcgtcgctatactatctttaacgttattgaggaaatggttcagtaatgggctgatttcaaccctaaaacctattcttttcaatgtgccgatgttgttatgtttatatattctcgaacgtaccggtagaccaaaatatgaagtcagtaacgctgcgcatggaaaatataaactagttaatgaagggttcgatttggaatctggtggactcactgaatacatgaaagatatcgtgtatgtttccttgttctgtaacctgggaacagttttcttcaacacgatgaaatggtggttcttggtattagtgtgccctgcgtttattttctacaagttgtactacttgaagcaacagtatttccccggtgcctcagcttcaaaggcggatctcgcagagacaacgcccgctgaaccttccaaatcaaagagacaattgaagagggaaaaacgtggtgataaatctcaggtaagataccgatag

SEQ ID NO: 9650 - protein, 181 aa, Kluyveromyces lactis NRRL Y-1140
MAGKSSKKIAAKNAAILKQLHVLVVAILSLTLLRKWFSNGLISTLKPILFNVPMLLCLYILERTGRPKYEVSNAAHGKYKLVNEGFDLESGGLTEYMKDIVYVSLFCNLGTVFFNTMKWWFLVLVCPAFIFYKLYYLKQQYFPGASASKADLAETTPAEPSKSKRQLKREKRGDKSQVRYR

SEQ ID NO: 9651 - DNA, 531 bp, Debaryomyces hansenii CBS767
  CDS (1)..(531)
atggcgtcacagagtatgaaaaaattagcagctgctaacactgaaatacttaagcaaatccatctacttgccgtgataataaatctaattgtaattatggtactattagtgttcaatagaccaaagtcacttatcccgtacctgttattttcgtgtcctgctttcttttgccaatttatcatagaacaatcagcaagaccagtatatgatgtagatagaatgtcgggacaaagaaaattattgaaagctggtgaagatgttaaacatgaaggattatacgagtacatgtttgatacaatgtacattacatggattattgatatattgatgattgttttaggtaccaataaagtgtggtggttatacagcattattcctggctttgccattttcaaagttgtcggtctagttaaaggtttgaaaggcaacaaacccgaaacaaagccagaagaaccagaggctcctcaaaagagtaagagacaggctaaaagagaagccaacaagaacaaggttgttagaaatgttcgttaa

SEQ ID NO: 9652 - protein, 176 aa, Debaryomyces hansenii CBS767
MASQSMKKLAAANTEILKQIHLLAVIINLIVIMVLLVFNRPKSLIPYLLFSCPAFFCQFIIEQSARPVYDVDRMSGQRKLLKAGEDVKHEGLYEYMFDTMYITWIIDILMIVLGTNKVWWLYSIIPGFAIFKVVGLVKGLKGNKPETKPEEPEAPQKSKRQAKREANKNKVVRNVR

SEQ ID NO: 9653 - DNA, 522 bp, Yarrowia lipolytica CLIB122
  CDS (1)..(522)
atggcaggaaactcgctcaaaaaacaggccgccaacaacaaggagatcctcatcaccctgtggaccggcaccgtgtccatcgacgtgctcttcctcagctcatactactttctcggcaaccccgcctccatcatcccctggatcatcttctccattccggctaccgtggtcatggtgcacctggagaagacctgccgacccaagtttgacgagcgaggaggtctgatcaggcccggagaagacctgtcccagcgaggagtaatggagtacctcaaggacattgtctacgtcacctggatctgcaagtttgtgtccgccgtgctcgcctccaactggggctttgctctgtacatcatgatccccctgtacgccgtcgtcaaggcctacactctttactccgagaacagacccaaacattccggttcctcaggctccacagccaacgaaggcttgatccccaagtccaagcgacaagagaagatggagcgacgaggcggccagaaggtcacttaccggtcgtaa

SEQ ID NO: 9654 - protein, 173 aa, Yarrowia lipolytica CLIB122
MAGNSLKKQAANNKEILITLWTGTVSIDVLFLSSYYFLGNPASIIPWIIFSIPATVVMVHLEKTCRPKFDERGGLIRPGEDLSQRGVMEYLKDIVYVTWICKFVSAVLASNWGFALYIMIPLYAVVKAYTLYSENRPKHSGSSGSTANEGLIPKSKRQEKMERRGGQKVTYRS

SEQ ID NO: 9655 - DNA, 546 bp, Candida albicans SC5314
  CDS (1)..(546): transl_table=12
atggcatctgcatcagctaagaagttggcagtagccaataccaacatattaaatcaattattaatcatttccgcatcaattaacattattgtgtttttaattatctccattttccatcgtccatcttcctataaaccgtggataattttctccatcccaagtatatttttacaatattctttggaaaaatttggtcgtcccaaatataccaatggtaactctttagtttcaagtggtgaagacattagattactggggagtttatatgaatattattttgatgttatctatttgacttgggggttcgatattttgatgattatttttggaagtaataaagtatggtatgggtacttgataattcctggatttgctatttacaaattgagtaattttattttaccattcattaaaaagaataaatcaaatggctctacaccagaggaacaacaagcagaaactaaacaaaccaattctgctactagtaaacgtcaacaaaaattgcaagctagaagagaaaagggaccagctgttaaatatagatga

SEQ ID NO: 9656 - protein, 181 aa, Candida albicans SC5314
MASASAKKLAVANTNILNQLLIISASINIIVFLIISIFHRPSSYKPWIIFSIPSIFLQYSLEKFGRPKYTNGNSLVSSGEDIRLSGSLYEYYFDVIYLTWGFDILMIIFGSNKVWYGYLIIPGFAIYKLSNFILPFIKKNKSNGSTPEEQQAETKQTNSATSKRQQKLQARREKGPAVKYR

SEQ ID NO: 9657 - DNA, 522 bp, Phaeosphaeria nodorum
  CDS (1)..(522)
atggcgcaaaaagccaccaaaaccctcgcggcctccaacaccgcccgcctgaaccaaaccctctacttcaccctcttcatccacggtatctactggctcctccgcgccatcctcttccactccagcttcacccggcgctccctcctgctctacctcttcctcgcctccccccagatcctcatccaattcgccttcgagcggcaatcgcgccccacgctcaccgccgacggcgccatcaagcgcgctggcgaagacctcgaagccaaagggctgacagaatacatgtgggacgtcatctactggacatacggcgtgatattcttcgcgggcgtgctgggcgacaaggcgtggtggctgtggggcgtgattccgctgtacagtgcgtatgcggcttggacgacgtatacgggtatgcggggcgggtttacggatgctgcgggcgtgccgcagcctgaggccgggacgagtaagaggcaggcgaagatggagaagagaggcggggcgaaggtgcagtatcggtaa

SEQ ID NO: 9658 - protein, 173 aa, Phaeosphaeria nodorum
MAQKATKTLAASNTARLNQTLYFTLFIHGIYWLLRAILFHSSFTRRSLLLYLFLASPQILIQFAFERQSRPTLTADGAIKRAGEDLEAKGLTEYMWDVIYWTYGVIFFAGVLGDKAWWLWGVIPLYSAYAAWTTYTGMRGGFTDAAGVPQPEAGTSKRQAKMEKRGGAKVQYR

SEQ ID NO: 9659 - DNA, 522 bp, Medicago truncatula
  CDS (1)..(522)
atggcgaatcaaggtgctaagaaacgcaaagaagagaactctcgtcacatcaccaagctccgccacatcatcatcgcctgcaatgttatttatttaataattaggatgttaatcttccattcaagcttcacctggaagcattggattggcttggttttgacttctctagcttattattttccttaccaacaacttgctaagatggcaaaacctagttatacacaagacggtgagctcttagatggtggttttgatatgactactggtggagtttgcggctatttacatgatgttatctacataacatgctttgtgcaagttgcttccatcatctctggaaagttctggtacatatatcttgtgataccagcatttggagcataccaatcctttggcttgattaaaggatttttgcctcaaggttcagaggaatcggttgaagatgaaaagactcgcaagaaaagggaaaagatggaaaagaaggcatccagacctaagtttgtcaagacacgaaccagatag

SEQ ID NO: 9660 - protein, 173 aa, Medicago truncatula
MANQGAKKRKEENSRHITKLRHIIIACNVIYLIIRMLIFHSSFTWKHWIGLVLTSLAYYFPYQQLAKMAKPSYTQDGELLDGGFDMTTGGVCGYLHDVIYITCFVQVASIISGKFWYIYLVIPAFGAYQSFGLIKGFLPQGSEESVEDEKTRKKREKMEKKASRPKFVKTRTR

SEQ ID NO: 9661 - DNA, 780 bp, Arabidopsis thaliana
  CDS (39)..(560)
agacgacgactattgagagctaaaatccgagattaagaatggcgaatgaaggagcgaagaaacgaaaggaagagaacgccaaacacatggctaagctccgtcgtatcatcatcgcttccaatgctgtgtatttcgttgtgaggatgttgattttctactcaagctttacttggaaacattggatcggtttagtgataacttcgctggcttacgcgtttccttataagcagcttgatcaaatggctaaacctagtgttactgatgatggtgagcttattgatggtggatttgacatgaccactggtggaatctgcggatatttgcacgatgtcatctatatcacttgctttgttcagctagcttccatcatcactgggaagttttggtacacgtatcttgtgattcctgcgtttggagtgtataaagcttctggtcttattcgaggattcatgtcacaaggttcagagggaggtgtggaagatgaaaagtctcgtaaaaagagagagaagatggagaggaaagcttcgagagggcaagtcgtcaagacgagaacaagatgaatgtgttgttatagaatacaacatgaatttggggatgagtatgttcttcaaaatatacaaatgtgttcaaaaggtaaactctctaagctttctgagtctcttttacatggacatgtctgcgtgtacaatatttactttgatggggaatagtcatcgagttgaacacagtcgattctctggagatagatgtttttttctttgaggtcgtaaccaatattat

SEQ ID NO: 9662 - protein, 173 aa, Arabidopsis thaliana
MANEGAKKRKEENAKHMAKLRRIIIASNAVYFVVRMLIFYSSFTWKHWIGLVITSLAYAFPYKQLDQMAKPSVTDDGELIDGGFDMTTGGICGYLHDVIYITCFVQLASIITGKFWYTYLVIPAFGVYKASGLIRGFMSQGSEGGVEDEKSRKKREKMERKASRGQVVKTRTR

SEQ ID NO: 9663 - DNA, 519 bp, Pichia angusta
  CDS (1)..(519)
atggctggagcttctgacaaaaagcaggccgcggccaactcgtctatcttgaagcagctgcacctggcctcggttgtggtgaacatggtggctttactggcgctttttcttttgcacaggcccgcagcgaaaaagtactattttatattcagtctcccaggcttggggtgtcaatatgtgctcgaaaaggtgggcaggcccaaataccacatcaatccgcagggctacagcgttttatcttctgctggacaggatctacaacaacagggtctgacagagtacatgatcgacattgtttatttgacattgataattgacgttttgatgatacttttcggttccaacaaggcctggctgcttctgctggctgtgcctgcctacgctggatacaaattgaagggtttcatttcgccgttctttgctcgcagacagaaagaggagcaaatagaaacagagcccgtgaaaagcaagcggcagcaaaagctggaaaacaggaagaacaaggttagatacaggtga

SEQ ID NO: 9664 - protein, 172 aa, Pichia angusta
MAGASDKKQAAANSSILKQLHLASVVVNMVALLALFLLHRPAAKKYYFIFSLPGLGCQYVLEKVGRPKYHINPQGYSVLSSAGQDLQQQGLTEYMIDIVYLTLIIDVLMILFGSNKAWLLLLAVPAYAGYKLKGFISPFFARRQKEEQIETEPVKSKRQQKLENRKNKVRYR

SEQ ID NO: 9665 - DNA, 683 bp, Arabidopsis thaliana
  CDS (78)..(599)
gtctttttcaataacctctgcttcgccggaaaaacaaacagacgacgactattgagagctaaaatccgagattaagaatggcgaatcaaggagcgaagaaacgaaaggaagagaacgccaaacacatggctaagctccgtcgtatcatcatcgcttccaatgctgtgtatttcgttgtgaggatgttgattttctactcaagctttacttggaaacattggatcggtttagtgataacttcgctggcttacgcgtttccttataagcagcttgatcaaatggctaaacctagtgttactgatgatggtgagcttattgatggtggatttgacatgaccactggtggaatctgcggatatttgcacgatgtcatctatatcacttgctttgttcagctagcttccatcatctctgggaagttttggtacacgtatcttgtgattcctgcgtttggagtgtataaagcttctggtcttattcgaggattcatgtcacaaggttcagagggaggtgtggaagatgaaaagtctcgtaaaaagagagagaagatggagaggaaagcttcgagagggcaagtcgtcaagacgagaacaagatgaatgtgttgttatagaatacaacatgaatttggggatgagtatgttcttcaaaatatacaaatgtgttcaaaaggtaaactctct

SEQ ID NO: 9666 - protein, 173 aa, Arabidopsis thaliana
MANQGAKKRKEENAKHMAKLRRIIIASNAVYFVVRMLIFYSSFTWKHWIGLVITSLAYAFPYKQLDQMAKPSVTDDGELIDGGFDMTTGGICGYLHDVIYITCFVQLASIISGKFWYTYLVIPAFGVYKASGLIRGFMSQGSEGGVEDEKSRKKREKMERKASRGQVVKTRTR

SEQ ID NO: 9667 - DNA, 654 bp, Arabidopsis thaliana
  CDS (1)..(654)
atggcgaatcaaggagcaaagaagaggaaagatgagaacgctcgacacatggctaagctccgtctcattatgatcctttgcaacatacgttacttgtatcaatatggaactaaaaatccgttgaatttgatctttaggtctcgaaagtttcaatgtttagctgattttgtttcgatgaattcgaggattgatgtttttggcaatatgtgtttgcagattttgtatgtcctagtgagggttataatttcgcattcaagtcatacctggaaaaattggattggtcttgtgttaacatcgttaggttacgggattccatataagcttcttcatcaaatggcaaagcctagtgttagtgatgctggtgaacttcttgatggtggatttgacatgagcactcctggaatgtgtggatatttgcatgatgtactctacatcacctgctttgtgcaggtcggatctatcatctctggaaagttttggtacgcgtatttagtgatccctgcatttggagcatacaaagcttctggtcttattaagggactattgtcacatggttcagagggaggtgttgaggatgagaagactcgcaaaaagagggagaagatggagagaaaagcttctagaggacaagtcgttaagacaagatctcgatga

SEQ ID NO: 9668 - protein, 217 aa, Arabidopsis thaliana
MANQGAKKRKDENARHMAKLRLIMILCNIRYLYQYGTKNPLNLIFRSRKFQCLADFVSMNSRIDVFGNMCLQILYVLVRVIISHSSHTWKNWIGLVLTSLGYGIPYKLLHQMAKPSVSDAGELLDGGFDMSTPGMCGYLHDVLYITCFVQVGSIISGKFWYAYLVIPAFGAYKASGLIKGLLSHGSEGGVEDEKTRKKREKMERKASRGQVVKTRSR

SEQ ID NO: 9669 - DNA, 22 bp, Artificial sequence
  primer
atggctggcaaagcagggagga

SEQ ID NO: 9670 - DNA, 28 bp, Artificial sequence
  primer
ttaacgatacttgtacttaattttagag

SEQ ID NO: 9671 - protein, 223 aa, Artificial sequence
  consensus sequence
  Variant (3)..(6): Xaa in position 3 to 6 is any amino acid
  Variant (9)..(12): Xaa in position 9 to 12 is any amino acid
  Variant (14)..(19): Xaa in position 14 to 19 is any amino acid
  Variant (21)..(59): Xaa in position 21 to 59 is any amino acid
  Variant (60)..(108): Xaa in position 60 to 108 is any or no amino acid
  Variant (110)..(114): Xaa in position 110 to 114 is any amino acid
  Variant (116)..(125): Xaa in position 116 to 125 is any amino acid
  Variant (126)..(132): Xaa in position 126 to 132 is any or no amino acid
  Variant (134)..(134): Xaa in position 134 is any amino acid
  Variant (136)..(138): Xaa in position 136 to 138 is any amino acid
  Variant (139)..(139): Xaa in position 139 is any or no amino acid
  Variant (141)..(143): Xaa in position 141 to 143 is any amino acid
  Variant (144)..(144): Xaa in position 144 is any or no amino acid
  Variant (146)..(147): Xaa in position 146 to 147 is any amino acid
  Variant (149)..(150): Xaa in position 149 to 150 is any amino acid
  Variant (152)..(152): Xaa in position 152 is any amino acid
  Variant (154)..(160): Xaa in position 154 to 160 is any amino acid
  Variant (162)..(164): Xaa in position 162 to 164 is any amino acid
  Variant (165)..(166): Xaa in position 165 to 166 is any or no amino acid
  Variant (168)..(168): Xaa in position 168 is any amino acid
  Variant (170)..(172): Xaa in position 170 to 172 is any amino acid
  Variant (174)..(175): Xaa in position 174 to 175 is any amino acid
  Variant (177)..(180): Xaa in position 177 to 180 is any amino acid
  Variant (183)..(185): Xaa in position 183 to 185 is any amino acid
  Variant (187)..(205): Xaa in position 187 to 205 is any amino acid
  Variant (206)..(216): Xaa in position 206 to 216 is any or no amino acid
  Variant (218)..(220): Xaa in position 218 to 220 is any amino acid
  Variant (222)..(222): Xaa in position 222 is any amino acid
MAXXXXKKXXXXNXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXPXXXXXXXXXXXXXXXXXGXDXXXXGXXXXYXXDXXYXTXXXXXXXIXXXXXKXWXXXLXXPXXXXYKXXXLXXXXXXXXXXXXXXXXXXXXXXXXXXXXXXKXXXKXE

SEQ ID NO: 9672 - DNA, 1071 bp, Saccharomyces cerevisiae
  CDS (1)..(1071)
atgactgacttaactacacaagaagctattgttctagagcgacctggtaaaatcaccctaactaatgtcagcatcccaaagatttcagatcctaacgaagtaatcatccagatcaaggcgacaggaatatgcgggtcagatatccattactatacccatggaagaatagccaattacgtggtagaatcaccaatggtgctgggacatgaatcatcaggaatagtggccctcataggtgagaacgtcaagacacttaaagtaggagatagggtggcacttgagcccggaatacctgacaggttttcaccggagatgaaagagggcagatacaacctggaccccaatttaaaatttgctgcgacacctccctttgatgggaccttgacaaagtattataagaccatgaaagatttcgtctataaacttcctgatgatgtgtcattcgaggaaggagcactaatagagccattatcagtggcaatccatgctaataaattagcaaagatcaagtttggagcccgttgcgtcgtctttggagctgggcccataggtttgctagccgggaaagtagccagtgtctttggtgctgcagatgttgtttttgtagatctattagaaaacaagctggaaacggctaggcagtttggtgccacccacatcgtcaactcaggtgatctcccacatggcgttactgtagatagtgttataaaaaaagcaatcggcaagaaaggtgctgacgttgtgtttgaatgttctggtgcagagccttgcgttcgagcaggcatcgaagtctgtaaggcaggtggaacgatcgttcaagttggaatgggacaagaggaaatacaatttcccatctcgatcattccaacaaaagaactgacattccaaggctgtttccgatactgtcaaggtgattatagtgactccatcgagctagtctctagcagaaaactctcgcttaaaccattcattacacatcgctatagctttaaggatgctgtcgaggcattcgaagaaacaagccaccacccgttaaataatatcaagacgatcattgagggcccggaatga

SEQ ID NO: 9673 - protein, 356 aa, Saccharomyces cerevisiae
MTDLTTQEAIVLERPGKITLTNVSIPKISDPNEVIIQIKATGICGSDIHYYTHGRIANYVVESPMVLGHESSGIVALIGENVKTLKVGDRVALEPGIPDRFSPEMKEGRYNLDPNLKFAATPPFDGTLTKYYKTMKDFVYKLPDDVSFEEGALIEPLSVAIHANKLAKIKFGARCVVFGAGPIGLLAGKVASVFGAADVVFVDLLENKLETARQFGATHIVNSGDLPHGVTVDSVIKKAIGKKGADVVFECSGAEPCVRAGIEVCKAGGTIVQVGMGQEEIQFPISIIPTKELTFQGCFRYCQGDYSDSIELVSSRKLSLKPFITHRYSFKDAVEAFEETSHHPLNNIKTIIEGPE

SEQ ID NO: 9674 - DNA, 1032 bp, Bradyrhizobium sp. ORS278
  CDS (1)..(1032): transl_table=11
atgcgtgccgtcgtgattcacgcgcccaaggatctgcgcatcgacagcttccccgacccggcgccggaggcgggccaggtccgggtcaagatcgaggccggcggcatctgcgggtcggacctgcattattaccatcatggcggcttcggcacggtgcgcatcaagcagccgatggcgctcggccatgaaatcgcgggcgtcgtcgccgcggtcggcgccggcgtgaccggcctcgccgagggcacgcgtgtcgccgtcaatccaagcctgccgtgcggccactgcgcctattgccgcgagggcctgcgcaaccagtgcctggacatgcgcttcatgggcagcgcgatgcgcgacccgcacgtgcagggcggctttcgcgagttcgtcaccgtcgatgcctcgcaggcggtgccgatcgcgccgtcactgtcgctgggtgaggccgcgatggccgagccgctgtcggtgtgcttgcatgccgcgcatcaggccggctcgctgctcggcaagcgcgtgctggtgaccggctgcggcccgatcggcgcgctgtcgatcctggtcgcgcgctatggcggcgcggccgaaatcgtggccaccgacgtcgccgaggcgccgcttgccgtggcgcgcaagctcggcgccagccacgctgtcaacgtcgccgcggagccatccgcgctcgatccctggcgcgtggggaagggcaccttcgacgtgctgttcgaggcgtccggcaaccaggccgcgctgcgcgcagcgctcgacgtgatgaggccgggcggggtcatcgtccagctcgggctcggcggcgaaatgacattgccgctcaacacgctggtcacgaaggagctgcaattgcgcggcaccttccggttcgaccgcgaattcgatctggcggtgcggctgatgggcgaggggctgctcgacgtgaagccgctgatctcagccacgctgccgttccaggaggcaatttccgccttcgagctcgccagcgatcgaagccgcgcgatgaaggttcatttgacgttttaa

SEQ ID NO: 9675 - protein, 343 aa, Bradyrhizobium sp. ORS278
MRAVVIHAPKDLRIDSFPDPAPEAGQVRVKIEAGGICGSDLHYYHHGGFGTVRIKQPMALGHEIAGVVAAVGAGVTGLAEGTRVAVNPSLPCGHCAYCREGLRNQCLDMRFMGSAMRDPHVQGGFREFVTVDASQAVPIAPSLSLGEAAMAEPLSVCLHAAHQAGSLLGKRVLVTGCGPIGALSILVARYGGAAEIVATDVAEAPLAVARKLGASHAVNVAAEPSALDPWRVGKGTFDVLFEASGNQAALRAALDVMRPGGVIVQLGLGGEMTLPLNTLVTKELQLRGTFRFDREFDLAVRLMGEGLLDVKPLISATLPFQEAISAFELASDRSRAMKVHLTF

SEQ ID NO: 9676 - DNA, 1110 bp, Oryza sativa (japonica cultivar-group)
  CDS (1)..(1110)
atggggaagggagggaaaggagccgaggcggcggcggcggcggtggccggagccggtgaggaggagaacatggcggcgtggctggtggcgaagaacaccctcaagatcatgcccttcaagctcccgccagttgggccttatgatgtccgtgtccggatgaaggcagtgggcatctgcggcagcgacgtgcactacctcagggagatgcgcattgcgcatttcgtggtgaaggagccgatggtgatcgggcacgagtgcgccggcgtgatagaggaggtcggcagcggcgtgacgcacctcgccgtcggcgaccgcgtggcgctcgagcccggcatcagctgctggcgctgcaggcactgcaagggcggccgctacaacctctgcgaggacatgaagttcttcgccacccctcccgtccacggatccctcgccaaccagatcgtgcaccctggtgatctgtgcttcaagctgccggagaacgtgagcctggaggaaggcgccatgtgcgagccgctgagcgtgggcgtgcacgcgtgccgccgcgccgacgtcgggccggagacgggggtgctgatcatgggcgcggggccgatcggcctggtcaccctgctggcggcgcgcgcgttcggcgcgacgcgcgtcgtgatcgtggacgtggacgaacaccgcctctccgtggcccgatccctcggcgccgacgccgccgtgagggtgtcggcgcgcgcggaggacgtcggcgaggaggtggaacggatcagggcggcgatgggcggggacatcgacgtgagcctggactgcgccgggttcagcaagacggtggcgacggcgctggaggcgacgcgcggcggcgggaaggtgtgcctcgtcgggatggggcacaacgagatgacggtgccgctgacgtcggcggcgatcagggaggtggacgtggtggggatattccggtacaaggacacgtggccgctctgcatcgagttcctccgcagcggcaagatcgacgtgaagccgctcatcacccaccgattcgggttctcgcaggaggacgtggaggaggcgttcgaggtcagcgcccgtggccgcgacgccatcaaggtcatgttcaacctctag

SEQ ID NO: 9677 - protein, 369 aa, Oryza sativa (japonica cultivar-group)
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 9678 - DNA, 1095 bp, Arabidopsis thaliana
  CDS (1)..(1095)
atggggaaaggagggatgtctcaaggagaaggctcaaaggttgaagaagaaaacatggctgcttggttggttggtatcaataccctcaagatccaaccttttcttcttccttccgttggtcctcatgatgtgagagttaggatgaaagctgttggtatttgtggaagtgatgttcattaccttaagaccatgagatgtgcggattttgtggtgaaagagccgatggtgattggacatgaatgtgctgggatcattgaagaagtaggtgaagaagtgaaacatttagtggttggtgaccgtgtagctcttgaacctgggattagttgttggagatgcaatctctgcagggaaggacgatacaacctttgtccagaaatgaagttctttgcaactccaccggttcatggctctttagctaaccaagtggtacaccctgcggacctatgcttcaaattgcctgagaatgtgagtttggaggaaggagcaatgtgtgaaccacttagtgttggtgtccatgcttgtcgccgagctgaggttggtcctgaaacaaacgttttggtaatgggagctggacctattggccttgttacaatgttggctgctcgggctttcagtgtgcctagaattgttattgtggatgttgatgagaaccgtttagccgtagcaaaacagctcggcgcagatgagattgtacaagtgacaacaaacttagaggatgttggttctgaggttgaacagattcagaaagctatggggtcaaacatcgatgtaacattcgactgtgcgggttttaacaaaaccatgtcgacagcattagcagccactcgttgtggcggtaaagtctgtcttgtcggaatgggtcacggtataatgactgtccctctcactcctgcagctgcaagggaggtagatgtggtgggtgtgttcaggtacaagaacacatggccattgtgtcttgagttcctgacaagtggtaagattgatgtaaagccactcataacccacagattcggtttctctcaaaaggaagtggaagatgcctttgaaaccagtgctcgtgggagcaatgccatcaaagttatgttcaatctctga

SEQ ID NO: 9679 - protein, 364 aa, Arabidopsis thaliana
MGKGGMSQGEGSKVEEENMAAWLVGINTLKIQPFLLPSVGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 9680 - DNA, 1065 bp, Bacillus halodurans C-125
  CDS (1)..(1065): transl_table=11
atgaaagcccttaatttatacggcattcaagaccttcgatttgaagaaacaccggccccttccatcgagcacgatgacgacatcatcataaaggtgaaggcggttggaatatgcggctctgacctctctcgatacaaaaagctcggtccttatgttccagggatgacgtttggtcatgaatttgcaggggaagtcgtcaaaatcggccgttcggtgactggattttccataggcgatcgggtggccgcttgtcctacctatacatgtggtcaatgtcgatactgtcaattaggtgagcccacacgttgcgagcggctatctgttatcggtgcccgtcatcccggcgcttatgctgaatatgtaaagctccccgcaaagcatgtgattcccttgccaaacgttgtgaactatgatgaagcagcactgattgagccggcttccgttgtggcacatggcttttatcggacgaatataaagcctggggcatccgttgcgatcatgggagtcggaagcattggcttgttggcggttcaatgggcaaagatttttggagcgactacggtttttgccatcgacatcgacgaacaaaaactgaatgtcgctaaccagctaggtgccgatgtattaattagtagcttacagcgcccagcccataaacaaattttggagtatacgaacggcatcggggtcgatgtggcggtagaatctgcagggactccaagcacgtctgcccaagtattcgcccttcctaaaaaaggcggggaagttgtatttctcggaattccttatgctgacgtccaaatcgaacgtttttattttgagaaaattgtccgcaacgaacttcatgtctacggttcgtggaatgcgctctcctccccattccctggaaaggaatgggcgaccacaatacattatatgtcaagtgggcaactgaacgtagcaccgatgatctcgtatcgccttcctctagccaaaggtcccgagacatttcagcaaatagctaaaggggaactgaaaccgacaaaagtattgttttacccagaaaaactgtctgagaggaagtag

SEQ ID NO: 9681 - protein, 354 aa, Bacillus halodurans C-125
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIHYMSSGQLNVAPMISYRLPLAKGPETFQQIAKGELKPTKVLFYPEKLSERK

SEQ ID NO: 9682 - DNA, 1047 bp, Bacillus halodurans C-125
  CDS (1)..(1047): transl_table=11
ttgcaggctttaagatggcatggagtaaaagacgtaagagttgacgacatcgcagaacctgcaacgcttaaagggaaagtaaagattaaagtgaaatggtgtggcatttgtggaagtgatcttcatgagtatgcggccggtccaatctttattccacaaaatagccctcattctctaacggaagaaaaagctccgattgtgatgggccatgagttttctggacaagtggtggaagtaggcgatggtgtgaccaaatgtgaagagggcgaccgtgtagtggtcgagccgatttttgcttgtggtacttgtaccgcctgcaagcaaggaaagtataatctttgcgagcaattagggttcctcggtttagctggaggtggaggtggtttctcggaatatgtgacagtagacgagcacatggttcacaaaattccggacactgtatccttcgagcaaggggccttagtcgagcccgccgccgttgccttatatgcggtccgccagagccagtttaatgtcggtgaccaagcggttgtattcggtacaggcccaatcggattattggttattgaagcgcttaaagcttcgggggcctcaaagatttacgcagtagaactctcaaccgaacggagacagagagcagaacaattaggtgccattgccctgaacccagcggaagtaaatgtagtggaagaaattcagcgtctaaccgatggcggtgctgatgtgtcctttgaagtaaccggtgtccctattgtcttaacacaggcgatcgagtccaccaagctaaacgggcaaacgatgattgtgagcatctttgaaaaagaagcctcttttcaaccaaacctagttgtcatgcgagaacgaaacattgcagggattattggctaccgcgacattttcccagcggtcatcagcttgatgaatcaaggctacttttccgctgagacgttagtcaccaagcggatcggcctacatgacattgtagagcaaggcttcgaggctttaatgaagacgaattgtaatattaagtgcgacaccacaaaataa

SEQ ID NO: 9683 - protein, 348 aa, Bacillus halodurans C-125
MQALRWHGVKDVRVDDIAEPATLKGKVKIKVKWCGICGSDLHEYAAGPIFIPQNSPHSLTEEKAPIVMGHEFSGQVVEVGDGVTKCEEGDRVVVEPIFACGTCTACKQGKYNLCEQLGFLGLAGGGGGFSEYVTVDEHMVHKIPDTVSFEQGALVEPAAVALYAVRQSQFNVGDQAVVFGTGPIGLLVIEALKASGASKIYAVELSTERRQRAEQLGAIALNPAEVNVVEEIQRLTDGGADVSFEVTGVPIVLTQAIESTKLNGQTMIVSIFEKEASFQPNLVVMRERNIAGIIGYRDIFPAVISLMNQGYFSAETLVTKRIGLHDIVEQGFEALMKTNCNIKCDTTK

SEQ ID NO: 9684 - DNA, 1092 bp, Pseudomonas aeruginosa PAO1
  CDS (1)..(1092): transl_table=11
atgaacagttccccgcaagccaacgcggcgatgcgcgccgccgtctggcacggccgccacgatatccgcgtggaagacgtgccgctcccggccgagccgccgcccggctgggtgcagatccgcgtgcactggtgcggcatctgcggctccgacctgcacgaatacctggccggcccggtattcatccccgtggaggcgccgcacccgctcaccggcctcaaggatcaatgcatcctcggccacgagttcagcggcgaaatcgtccgcctcggcaacggcgtgaccggcttcgccgtcggccaggcggtcgccgcagacgcctgccagcattgcggcacctgctactactgccggcatgggctgtacaacatctgcgagaacctggccttcaccgggctgatgaacaacggcgccttcgccgaatacgtcaacgtaccggccaacctgctctacgccctgccggccggatttcccagcgaggccggcgcgctgatcgagccgctggcggtgggcatgcacgcggtgaagaaggccggcagcctgctcgggcagaacgtggtggtggtcggcgccggcaccatcggcctgagcaccatcatgtgcgcgcgcgccgccggcgcggcacaggtgatcgccctggagatgtcctcggcgcgcaaggccaaggccctggaggtcggcgccagccaggtgctcgacccctcgcggtgcgacgccctaggcgaaatccgcgccctcaccggcgggcttggcgccgacgtcagcttcgaatgcatcggcaacaagcacaccgccaagctggccatcgatgccatccgcaaggccggcaaatgcgtgcttgtgggaatcttcgaggagcccagtgaattcaatttcttcgagctggtttccaccgagaagcagttgctcggggccctcgcctacaacggcgagttcgccgacgtgatcgccttcatagccgacggccgcctcgacatcgcaccgctggtgaccggtcgcatcggcctggaagaaatcgtcgagcgcggtttcgaagagttggtgaacaacaaggagcacaacgtgaagatcatcgtctcgccgggcggctga

SEQ ID NO: 9685 - protein, 363 aa, Pseudomonas aeruginosa PAO1
MNSSPQANAAMRAAVWHGRHDIRVEDVPLPAEPPPGWVQIRVHWCGICGSDLHEYLAGPVFIPVEAPHPLTGLKDQCILGHEFSGEIVRLGNGVTGFAVGQAVAADACQHCGTCYYCRHGLYNICENLAFTGLMNNGAFAEYVNVPANLLYALPAGFPSEAGALIEPLAVGMHAVKKAGSLLGQNVVVVGAGTIGLSTIMCARAAGAAQVIALEMSSARKAKALEVGASQVLDPSRCDALGEIRALTGGLGADVSFECIGNKHTAKLAIDAIRKAGKCVLVGIFEEPSEFNFFELVSTEKQLLGALAYNGEFADVIAFIADGRLDIAPLVTGRIGLEEIVERGFEELVNNKEHNVKIIVSPGG

SEQ ID NO: 9686 - DNA, 1071 bp, Lactococcus lactis subsp. lactis Il1403
  CDS (1)..(1071): transl_table=11
atgcgcgcagcacgtttttacgaccgcggggatatccgcattgatgaaattaatgaaccaatagtaaaagctggccaagttggcattgatgtggcttggtgtggaatttgtggaacagatctccatgaatttttagatggcccaattttttgtccgtcagcagaacatcctaatccaattactggagaagtaccaccagtcactcttggacatgaaatgtctggggttgtaaattttataggtgaaggagtaagcggacttaaagtaggtgaccatgtcgttgtcgaaccttatatcgttcccgaagggactgatacaagtgaaactggacattataacctctcagaaggctcaaactttattggtttgggcggaaatggtggaggtttggctgaaaaaatttctgttgatgaacgttgggttcacaaaattcctgataacttaccattggatgaagctgctctaattgagccactatcagtcggctatcacgctgttgaacgagcaaatttaagtgaaaagagtacggtattagttgttggtgctggaccaattggactattaactgctgccgttgcaaaagcgcaaggacatactgttatcatcagtgaacctagtggacttcgtcgtaaaaaagcacaagaagcacaagttgctgattatttcttcaatccaattgaagatgacattcaagctaaagttcatgaaattaatgaaaaaggagtggacgcagcctttgaatgtacctctgtccaaccgggatttgacgcttgtctagatgcgattcgtatgggtggaacagttgtcattgtcgcaatttggggcaagcctgctagtgttgatatggcaaaattagtaatcaaagaagctaaccttttaggaacgattgcttataataacactcatccaaaaacaattgatttagtatcaacaggtaaaataaaattggaccaattcatcacagctaaaatcggtttggatgatttgattgataaaggattcgatacgctgattcatcataatgaaacagctgttaaaattttagtttcaccaactggtaaaggtctataa

SEQ ID NO: 9687 - protein, 356 aa, Lactococcus lactis subsp. lactis Il1403
MRAARFYDRGDIRIDEINEPIVKAGQVGIDVAWCGICGTDLHEFLDGPIFCPSAEHPNPITGEVPPVTLGHEMSGVVNFIGEGVSGLKVGDHVVVEPYIVPEGTDTSETGHYNLSEGSNFIGLGGNGGGLAEKISVDERWVHKIPDNLPLDEAALIEPLSVGYHAVERANLSEKSTVLVVGAGPIGLLTAAVAKAQGHTVIISEPSGLRRKKAQEAQVADYFFNPIEDDIQAKVHEINEKGVDAAFECTSVQPGFDACLDAIRMGGTVVIVAIWGKPASVDMAKLVIKEANLLGTIAYNNTHPKTIDLVSTGKIKLDQFITAKIGLDDLIDKGFDTLIHHNETAVKILVSPTGKGL

SEQ ID NO: 9688 - DNA, 1065 bp, Neisseria meningitidis MC58
  CDS (1)..(1065): transl_table=11
atgaaagcagcacgtttttacgacaaaggcgacatccgcatcgaagacatccccgaaccgaccgtcgcccccggcactgtcggcatcaatgtcgcctggtgcggcatctgcggtactgacctgcacgaattcatggaaggcccgattttcattccgccttgcggtcatccgcacccgatttccggcgagtccgcacccgtaacgatgggacacgagttctccggcgtggtctatgccgtcggcgaaggcgtggacgacatcaaagtcggccaacacgtcgtggtcgaaccctacatcatccgcgatgacgtaccgaccggagaaggcagcaactaccacctctccaaagatatgaactttatcggcttgggcggctgcggcggcggtctgtccgaaaaaatcgccgtcaaacgccgttgggtgcatccgatttccgacaaaatcccgttggatcaagccgctttgatcgaaccgctgtctgtcggacaccacgcctatgtacgcagcggcgcgaaagaaggcgacgtcgcattggtcggcggtgcaggtccgatcggtttgctgttggctgccgtgttgaaagccaaaggcatcaaagtcatcatcaccgagttgagtaaagcacgcaaagacaaagcgcgcgaatccggcgttgccgactacatcctcgacccgtccgaagtcgatgttgttgcagaagtgaaaaaactgaccaacggcgaaggcgtggacgtggcatttgagtgcaccagcgtcaacaaagtgttggatactttggtcgaagcctgcaaacctgccgccaatttggttatcgtatccatctggagccaccccgccaccatcaacgtccacagcgtcgtgatgaaagagttggacgtgcgcggcacgattgcctactgcaacgaccacgccgaaaccatcaaactggtcgaagaaggcaaaatcaaccttgagcctttcatcacccagcgcatcaagctggacgagctggtttccaaaggcttcgagcgtctgattcacaacaacgaatccgccgttaaaattattgtgagtccaaacctgtaa

SEQ ID NO: 9689 - protein, 354 aa, Neisseria meningitidis MC58
MKAARFYDKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKEGDVALVGGAGPIGLLLAAVLKAKGIKVIITELSKARKDKARESGVADYILDPSEVDVVAEVKKLTNGEGVDVAFECTSVNKVLDTLVEACKPAANLVIVSIWSHPATINVHSVVMKELDVRGTIAYCNDHAETIKLVEEGKINLEPFITQRIKLDELVSKGFERLIHNNESAVKIIVSPNL

SEQ ID NO: 9690 - DNA, 1065 bp, Neisseria meningitidis Z2491
  CDS (1)..(1065): transl_table=11
atgaaagcagcacgtttttacgataaaggcgacatccgcatcgaagacatccccgaaccgaccgtcgcccccggcactgtcggcatcaatgtcgcctggtgcggcatctgcggtactgacctgcacgaattcatggaaggcccgattttcattccgccttgcggtcatccgcacccgatttccggcgagtccgcacccgtaacgatgggacacgagttctccggcgtggtctatgccgtcggcgaaggcgtggacgacatcaaagtcggccaacacgtcgtggtcgaaccctacatcatccacgatgacgtaccgaccggagaaggcagcaactaccacctctccaaagatatgaactttatcggcttgggcggctgcggcggcggtctgtccgaaaaaatcgccgtcaaacgtcgttgggtgcatccgatttccgacaaaatcccgttggatcaagccgctttgatcgaaccgctgtctgtcggacaccacgcctatgtacgcagcggcgcgaaagcaggcgacgtcgcattggtcggcggcgcaggtccgatcggtttgctgttggctgccgtgttgaaagccaaaggcatcaaagtcatcatcaccgagttgagtaaagcacgcaaagacaaagcgcgcgaatccggcgttgccgactacatcctcgacccgtccgaagtcgatgttgtcgaagaggtgaaaaaactgaccaacggcgaaggcgtggacgtggcattcgaatgtaccagcgtgaacaaagtgttggatactttggtcgaagcctgcaaacctgccgccaatttggttatcgtatccatctggagccaccctgcaaccgtcaacgtccacagcgtcgtgatgaaagagctggatgtgcgcggcacgattgcctactgtaacgaccacgccgaaaccatcaaactggtcgaagaaggcaaaatcaacctcgaacccttcatcacccagcgcatcaagctggacgaactggtttccgaaggcttcgagcgtctgatccacaacaacgaatccgccgttaaaattattgtgagtccaaacctgtaa

SEQ ID NO: 9691 - protein, 354 aa, Neisseria meningitidis Z2491
MKAARFYDKGDIRIEDIPEPTVAPGTVGINVAWCGICGTDLHEFMEGPIFIPPCGHPHPISGESAPVTMGHEFSGVVYAVGEGVDDIKVGQHVVVEPYIIHDDVPTGEGSNYHLSKDMNFIGLGGCGGGLSEKIAVKRRWVHPISDKIPLDQAALIEPLSVGHHAYVRSGAKAGDVALVGGAGPIGLLLAAVLKAKGIKVIITELSKARKDKARESGVADYILDPSEVDVVEEVKKLTNGEGVDVAFECTSVNKVLDTLVEACKPAANLVIVSIWSHPATVNVHSVVMKELDVRGTIAYCNDHAETIKLVEEGKINLEPFITQRIKLDELVSEGFERLIHNNESAVKIIVSPNL

SEQ ID NO: 9692 - DNA, 1044 bp, Escherichia coli O157:H7 EDL933
  CDS (1)..(1044): transl_table=11
  misc_feature (513)..(513): r is g or a
atgaaaaattcaaaagcaatattgcaggtgccgggcacaatgaaaattatttcagcagaaataccagtgcctaaagaagatgaagttttgattaaagtagaatatgtcggtatttgtggttcagatgtacatggttttgaatcaggtccgtttattccgcctaaagacccaaatcaagaaattggcctgggtcatgaatgcgccgggacggttgtggctgtgggaagccgtgtgcgcaaatttaaaccgggggatcgggtaaatatcgaacctggcgttccttgcggtcactgtcgttactgtctggaaggcaaatataacatctgcccggacgttgattttatggcgacacaacccaactaccgcggcgcattaacgcactatctgtgtcatccggagagctttacttacaaactgcccgacaatatggacacgatggaagggacgctggtggagcctgccgcagtcgggatgcatgccgcgatgctggcagatgttaaaccgggtaagaarataattattctgggagcaggttgtattggtttgatgacgttgcaagcgtgcaaatgcctgggagcaacggaaattgccgtcgttgatgtgctggaaaaacgtctggcaatggcggaacagcttggtgcgacagtggttattaacggcgcaaaagaagacactattgcacgctgtcagcaatttaccgaagacatgggcgcagatattgttttcgaaacagcgggttctgcggtcaccgttaaacaggcaccttatctggtaatgcgtggcggtaaaattatgattgttggtactgtacccggcgcttcggcaatcaatttcctcaaaatcaatcgcgaagtcactatccagacggtattccgctatgccaatcgttatccggtcacgattgaagcaatttcttcagggcgattcgatgtgaaatcgatggtgacgcatatttacgattatcgggatgtacaacaggcatttgaagagtcagttaacaacaaacgcgacattattaaaggcgttattaagattagcgattaa

SEQ ID NO: 9693 - protein, 347 aa, Escherichia coli O157:H7 EDL933
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGTLVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGASAINFLKINREVTIQTVFRYANRYPVTIEAISSGRFDVKSMVTHIYDYRDVQQAFEESVNNKRDIIKGVIKISD

SEQ ID NO: 9694 - DNA, 1038 bp, Sulfolobus solfataricus P2
  CDS (1)..(1038): transl_table=11
atggtggagggattctcacctatgaaaagcgtaattatggagaacggaaaggctgtaataaaggagctaccattacctaaattacagcaaggtgatgtattagttaaaatgaaggcttgtggattgtgcggtactgacatcgagaagatttgtgggcaatacaccgcatcacaaccaatattgggtcatgaaccgactggaataatccaagaatctacagtggattggctaaagcctggggatagggtctttgctcatcaccatgtcccatgctatgagtgttattattgtaaaaagggaagcccgaccatgtgtccttattatagaaaaactaacttagatcccggtggattttcggagtacttcagagtcccagcttggaatgttgcaagagggggagtattaaagttgccagataatgtaagtttcgaagaaggggcattcatagaaccattagctaccgttattagggcgcaaaagagagtagctatcgataatggcgatacggtctttattgttggaattggtcccatgggactattacacgcaatgatggctaaggtaaataaggcaggagttatcatagcatcagacgtaagtgattttagaaccgaatttggatacaaagtaggtattaactattcccttaatgcgaagaaagttaatgtagttgatgaagttaagagattaaccgatggtagaggcgctgatgttactataatagcctctggatctccttctgcaatagtctctggtcttaatgctactagaaagggtggtagagttttactatttggtgtgccatataaggggacgatacttaattacgatattagtgacctcttaaataatgagatctcaataattcctagtaatgctgctgtggaagaggatacaaaggaagctttagctataatagctaataagaagattgatgtaactaaactgataactcatagattctcattagatgagttcaatgaggccgtaaggataggtaaggagggaaatgccataaaggtaataatatatagttga

SEQ ID NO: 9695 - protein, 345 aa, Sulfolobus solfataricus P2
MVEGFSPMKSVIMENGKAVIKELPLPKLQQGDVLVKMKACGLCGTDIEKICGQYTASQPILGHEPTGIIQESTVDWLKPGDRVFAHHHVPCYECYYCKKGSPTMCPYYRKTNLDPGGFSEYFRVPAWNVARGGVLKLPDNVSFEEGAFIEPLATVIRAQKRVAIDNGDTVFIVGIGPMGLLHAMMAKVNKAGVIIASDVSDFRTEFGYKVGINYSLNAKKVNVVDEVKRLTDGRGADVTIIASGSPSAIVSGLNATRKGGRVLLFGVPYKGTILNYDISDLLNNEISIIPSNAAVEEDTKEALAIIANKKIDVTKLITHRFSLDEFNEAVRIGKEGNAIKVIIYS

SEQ ID NO: 9696 - DNA, 1032 bp, Agrobacterium tumefaciens str. C58
  CDS (1)..(1032): transl_table=11
atgaaagcgattgtcgcccacggggcaaaggatgtgcgcatcgaagaccggccggaggaaaagccgggtccgggcgaggtgcggctccgtctggcgaggggcgggatctgcggcagtgatctgcattattacaatcatggcggtttcggcgccgtgcggcttcgtgaacccatggtgctgggccatgaggtttccgccgtcatcgaggaactgggcgaaggcgttgaggggctgaagatcggcggtctggtggcggtttcgccgtcgcgcccatgccgaacctgccgcttctgccaggagggtctgcacaatcagtgcctcaacatgcggttttatggcagcgccatgcctttcccgcatattcagggcgcgttccgggaaattctggtggcggacgccctgcaatgcgtgccggccgatggtctcagcgccggggaagccgccatggcggaaccgctggcggtgacgctgcatgccacacgccgggccggcgatttgctgggaaaacgtgtgctcgtcacgggttgcggccccatcggcattctctccattctggctgcgcgccgggcgggtgctgctgaaatcgtcgccaccgacctttccgatttcacgctcggcaaggcgcgtgaagcgggggcggaccgtgtcatcaacagcaaggatgagcccgatgcgctcgccgcttatggtgcaaacaagggaaccttcgacattctctatgaatgctcgggtgcggccgtggcgcttgccggcggcattacggcactgcggccgcgcggcatcatcgtccagctcgggctcggcggcgatatgagcctgccgatgatggcgatcacagccaaggaactcgacctgcgtggttcctttcgcttccacgaggaattcgccaccggcgtcgagctgatgcgcaagggcctgatcgacgtcaaacccttcatcacccagaccgtcgatcttgccgacgccatctcggccttcgaattcgcctcggatcgcagccgcgccatgaaggtgcagatcgccttttcctaa

SEQ ID NO: 9697 - protein, 343 aa, Agrobacterium tumefaciens str. C58
MKAIVAHGAKDVRIEDRPEEKPGPGEVRLRLARGGICGSDLHYYNHGGFGAVRLREPMVLGHEVSAVIEELGEGVEGLKIGGLVAVSPSRPCRTCRFCQEGLHNQCLNMRFYGSAMPFPHIQGAFREILVADALQCVPADGLSAGEAAMAEPLAVTLHATRRAGDLLGKRVLVTGCGPIGILSILAARRAGAAEIVATDLSDFTLGKAREAGADRVINSKDEPDALAAYGANKGTFDILYECSGAAVALAGGITALRPRGIIVQLGLGGDMSLPMMAITAKELDLRGSFRFHEEFATGVELMRKGLIDVKPFITQTVDLADAISAFEFASDRSRAMKVQIAFS

SEQ ID NO: 9698 - DNA, 1047 bp, Agrobacterium tumefaciens str. C58
  CDS (1)..(1047): transl_table=11
atgcagacacgcgtggcacgtctatattcccgtgaagatatccgcgtcgaaacgcaggacgttgcgccccccggccccggcgaagtgttgcttgccatggcggcaggtggcatttgcggctccgatctgcattattatcaggatggcggtttcggcccggtgcgggtgcgcgagccgatcatctgcggtcatgaggcatccggccatatcgcggctttgggtgcgggtgtcagtgggcttgccatcggccaactcgtcgccgtcaatccctcgcagccctgcggccactgccagttctgcctgaagggccagccgatccattgcctcgacatgcgcttcatgggcagcgccatgcgcctgccgcatgagcagggcatgttccgcgaccggctggttgttcccgcaaaacaatgcgcgacattttcggacgctacctcgcccgccgaggccgcctgtaccgagccgcttgcggtgtgcctgcatgccgtcgcacaggctggcgatctggcaggtgcgaaggtactggtgaccggtgccggccccatcggcctcctcaccatagccgctgcccgccaggccggcgcaggcatcatcgtcgccaccgatctcaccgatgcggcgctggaacgggcccccgccatgggtgcggaccgcaccatcaatgtcgcaaaggacgccgatgcgcttttgccctatcaggacaacaaaggttatttcgacgtcattttcgattgttcagccgccggtcccgcgctccgctccgccttcgcctgcgtccgcccgcgcggcaccatcgtgcaggtgggggtgacaggcgacgtcaccattccgcttaatgcgctggtgggcaaagagattgtctggcgtgggtcgcagcgtttccatgacgaattcgccatagccgccgggctcatctcgtcgcgcaaaatcgatgtgcgaccgatcatttcccacagcttcccgcttggcgacgccaaagcggcattcgaacaggccggagaccgctccgccgcctgcaaggtgcagctgacattttccgcagactga

SEQ ID NO: 9699 - protein, 348 aa, Agrobacterium tumefaciens str. C58
MQTRVARLYSREDIRVETQDVAPPGPGEVLLAMAAGGICGSDLHYYQDGGFGPVRVREPIICGHEASGHIAALGAGVSGLAIGQLVAVNPSQPCGHCQFCLKGQPIHCLDMRFMGSAMRLPHEQGMFRDRLVVPAKQCATFSDATSPAEAACTEPLAVCLHAVAQAGDLAGAKVLVTGAGPIGLLTIAAARQAGAGIIVATDLTDAALERAPAMGADRTINVAKDADALLPYQDNKGYFDVIFDCSAAGPALRSAFACVRPRGTIVQVGVTGDVTIPLNALVGKEIVWRGSQRFHDEFAIAAGLISSRKIDVRPIISHSFPLGDAKAAFEQAGDRSAACKVQLTFSAD

SEQ ID NO: 9700 - DNA, 1056 bp, Staphylococcus aureus subsp. aureus Mu50
  CDS (1)..(1056): transl_table=11
gtgaaagctttagtaaaaacaagagaaggacatggcaacttagaacttcttgataaagaagttgcaacaccgctagatgataaagtaaagattaaagtacattatgcaggaatttgtggcacagacattcatacttatgaagggcattataaagttaattttccagtgacattaggtcatgaattttctggtgaaatcgttgaagttggagcagacgttaaagattttaaagttggtgaccgtgtcacttctgaaactacattctatgtttgtaatgagtgtgaatactgtaaatcaaaagactataatttatgcaaccatcgaaaaggtattggaacacaagttgatggcgtatttactaattatgtcattgcacgtgaagaaagtttgcatcatattccagacgaagtatcgtatcagtctgcagctatgacagaaccattagcatgtgcacatcatggcgtttctaagattcaagtgaactctggcgatgtagcagttgtaatgggacctgggccaatcggattacttgtagcacaagtgttgaaaagtaaaggcgcaactgttgtggtaactggattggacaatgacaaagtcagattagataaagcagaagcattgcacatggattatgtagtcaatttacaacaaacagacttaaaaacgtatatcaatggaattacagacggttacggtgcagatgttgttgttgaatgttcaggtgcagttccagcagcacgacaaggtttagatattatacgcaaaaaaggtttctacagtcaaataggtatttttaaggatgctgaaattccatttgatatggaaaaagtgattcaaaaagaaataacagttgttggtagtagaagtcaaaagccagcagattgggaaccttcattgcaacttatggcggatggtttagtaaatgctgaagctttggtgacaaaaatatatgatatttcgaaatgggacgaggcgtatcaacatttaaaatctggcgaaggtattaaagcattacttaagccgctcgatttagatgaaaatgaaggagagaattaa

SEQ ID NO: 9701 - protein, 351 aa, Staphylococcus aureus subsp. aureus Mu50
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGVFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDIIRKKGFYSQIGIFKDAEIPFDMEKVIQKEITVVGSRSQKPADWEPSLQLMADGLVNAEALVTKIYDISKWDEAYQHLKSGEGIKALLKPLDLDENEGEN

SEQ ID NO: 9702 - DNA, 1041 bp, Bacillus subtilis subsp. subtilis str. 168
  CDS (1)..(1041): transl_table=11
atgaaggcagcaagatggcataaccaaaaggatatccgtattgaacatatcgaagagccaaaaacggagccgggaaaagtaaagatcaaagtcaaatggtgcggcatctgcggaagtgatttacacgaatatctgggcggcccgatctttattccggttgacaaaccgcacccattaacaaatgaaacggcacctgtcacaatggggcatgaattctccggtgaagttgtcgaagtcggagaaggcgttgaaaattataaagttggagaccgcgttgtagtcgagccgatttttgctacacacggccaccaaggcgcctacaaccttgatgaacaaatgggattcctcggcttagccggcggaggcggcggtttctctgaatacgtctctgtggatgaagagcttttgttcaaacttcctgatgaattatcatatgaacaaggcgcgctcgttgaaccttctgcagttgctctatacgctgtccgctcaagcaaactcaaagcaggcgacaaagcggctgtattcggctgcggcccgatcggacttcttgtcattgaagcgctgaaggctgccggtgcaactgatatttacgctgttgagctttctcctgaacgccagcaaaaagctgaggagcttggcgcgatcatcgttgatccgtctaaaacagacgatgtagtcgctgagattgcagaacgtacaggaggcggtgttgacgtagcattcgaagtcactggtgtcccagtggtgttacgacaagccatccagtccactacaattgccggtgaaaccgtcatcgtcagcatttgggaaaaaggtgctgaaatccatccgaacgatatcgtaatcaaagaacgtacagtaaaaggaattatcggataccgcgacatcttcccggctgtattgtcattaatgaaagaaggctatttctcagccgacaaactcgtaacgaaaaaaatcgtactagatgatttgatcgaggaaggcttcggggctcttattaaagagaaaagccaagtcaaaatccttgttagacctaactaa

SEQ ID NO: 9703 - protein, 346 aa, Bacillus subtilis subsp. subtilis str. 168
MKAARWHNQKDIRIEHIEEPKTEPGKVKIKVKWCGICGSDLHEYLGGPIFIPVDKPHPLTNETAPVTMGHEFSGEVVEVGEGVENYKVGDRVVVEPIFATHGHQGAYNLDEQMGFLGLAGGGGGFSEYVSVDEELLFKLPDELSYEQGALVEPSAVALYAVRSSKLKAGDKAAVFGCGPIGLLVIEALKAAGATDIYAVELSPERQQKAEELGAIIVDPSKTDDVVAEIAERTGGGVDVAFEVTGVPVVLRQAIQSTTIAGETVIVSIWEKGAEIHPNDIVIKERTVKGIIGYRDIFPAVLSLMKEGYFSADKLVTKKIVLDDLIEEGFGALIKEKSQVKILVRPN

SEQ ID NO: 9704 - DNA, 1170 bp, Agrobacterium tumefaciens str. C58
  CDS (1)..(1170): transl_table=11
gtgagcaggatcactcgtcccggtatgcgaaatcagcccttggaggaaaagatgacccaacccgccaccgcagccgtactggaagaaaaaaacggccgtttcattcttcgtgaagtgaagcttgaggcgccgcgccccgacgaagtgctgattcgcatggttgctacgggtatttgcgcgaccgatgctcatgtcaggcaacagctcatgccaactccgctgccggcgatcttgggccatgaaggcgccggcatcgtcgaacgcgttggatcgaccgtatcgcatctcaagcccggcgatcatgtcgttctttcctatcactcctgcggccactgcaagccctgcatgtcttcccatgcggcctactgcgaccacgtctgggaaacgaatttcgcaggcgccaggctcgatggaacgatcggcgttgcggcgcctgatgggaacacgctccatgcgcacttctttggtcagtcttcattctccacctatgcgctcgctcatcagcgcaatgccgtcaaggtcccggacgatgttccgctcgagctcctcggaccgctcggttgcgggttccagaccggagccggctcggtcttgaacgcgctcaaagtgccggtaggcgcctctatcgccattttcggggtaggggcagtggggttgtcggcgatcatggctgccaaggtcgccgatgccgccgtcattatcgccattgatgtcaataccgaacggctgaagctcgcttccgagctcggcgcgacgcattgcgtcaacccgcgtgaacaagccgatgttgcctcggcgatcagggatatcgcgcctcgcggcgtcgaatacgttctcgacacgagcggtcggaaggagaacctcgacggcggcatcggcgctcttgctccgatggggcagttcggttttgtcgccttcaacgaccattcgggcgcggttgtcgatgcctcccggctcacggtagggcaaagcctcatcgggattatccagggcgatgccatttccggcctgatgattccggaactggtcggtctctatcgaagcggccgtttcccgttcgacaggctgctcaccttctacgacttcgccgacatcaatgaggcatttgacgatgtcgcggcaggacgggtgatcaaggccgtcctgcgctttcccccgcaagctgcttaa

SEQ ID NO: 9705 - protein, 389 aa, Agrobacterium tumefaciens str. C58
MSRITRPGMRNQPLEEKMTQPATAAVLEEKNGRFILREVKLEAPRPDEVLIRMVATGICATDAHVRQQLMPTPLPAILGHEGAGIVERVGSTVSHLKPGDHVVLSYHSCGHCKPCMSSHAAYCDHVWETNFAGARLDGTIGVAAPDGNTLHAHFFGQSSFSTYALAHQRNAVKVPDDVPLELLGPLGCGFQTGAGSVLNALKVPVGASIAIFGVGAVGLSAIMAAKVADAAVIIAIDVNTERLKLASELGATHCVNPREQADVASAIRDIAPRGVEYVLDTSGRKENLDGGIGALAPMGQFGFVAFNDHSGAVVDASRLTVGQSLIGIIQGDAISGLMIPELVGLYRSGRFPFDRLLTFYDFADINEAFDDVAAGRVIKAVLRFPPQAA

SEQ ID NO: 9706 - DNA, 1032 bp, Sinorhizobium meliloti 1021
  CDS (1)..(1032): transl_table=11
atgaaggcgatcgtcatccatacggccaaggacttgcgcgtcgaagagtgtgcggtggaaaagcccggccccggcgaggtggagatccgccttgcggccggtggcatctgcggctcggatctgcactattacaaccacggcggcttcggcacggtgcgcctcaaggagccgatgatcctcggccatgaggtctccggtcatgtcgcggcgctcggcgaaggcgtatcggaccttgccatcggcgatctcgtcgcggtctcgccctcgcggccctgcggcgcctgcgactactgcctcaaaggcctgcccaaccattgcttccacatgcgcttctacggctcggccatgccgttcccgcatatccagggcgcctttcgcgagcggctcgtcgccaaggccagccagtgcgtgaaggccgaagggctttcggccggcgaggcggcgatggcggagccgctctccgtgacgctgcacgccacgcggcgcgccggcgagatgctgggcaagcgcgtcctcgtcaccggctgcgggccgatcggcacgctgtcgatcctcgccgcccgaagggcgggcgccgccgagatcgtcgccgccgatctttccgaacgcgcgctcggctttgcccgtgccgtcggtgctgaccgcacggtcaatctgtcggaagaccgcgacggtcttgttccctttagcgagaacaagggcactttcgacgtgctttacgagtgctcgggggcgcagcccgcgctggtagccggcatccaggcactgcgcccgcgcggcgtcatcgtccagctcggtcttggcggcgacatggccctgccgatgatggcgatcaccgccaaggaactcgacctgcgcggctccttccgcttccatgaggaattcgcgactgcggtgaagctgatgcagggcggcctgatcgacgtcaagccgctgatcacccacacgctgccgcttggcgaggcgctgaaagccttcgagatcgcctcggacaaggggcaatcgatgaagacgcagatcgcctttgcctag

SEQ ID NO: 9707 - protein, 343 aa, Sinorhizobium meliloti 1021
MKAIVIHTAKDLRVEECAVEKPGPGEVEIRLAAGGICGSDLHYYNHGGFGTVRLKEPMILGHEVSGHVAALGEGVSDLAIGDLVAVSPSRPCGACDYCLKGLPNHCFHMRFYGSAMPFPHIQGAFRERLVAKASQCVKAEGLSAGEAAMAEPLSVTLHATRRAGEMLGKRVLVTGCGPIGTLSILAARRAGAAEIVAADLSERALGFARAVGADRTVNLSEDRDGLVPFSENKGTFDVLYECSGAQPALVAGIQALRPRGVIVQLGLGGDMALPMMAITAKELDLRGSFRFHEEFATAVKLMQGGLIDVKPLITHTLPLGEALKAFEIASDKGQSMKTQIAFA

SEQ ID NO: 9708 - DNA, 1059 bp, Sinorhizobium meliloti 1021
  CDS (1)..(1059): transl_table=11
atgtcgggcgcacccacgcgcacacgcttcgcccgcctttacggcccgcgcgatcttcggctggaagtcgccgacgttcccgcaccgggggacggcgaggtgctgttgaagatggccgcaggcggcatctgcggctcggatcttcactattaccaggacgggggtttcggcccggtccgggttcgtgagccgatcatacccggccacgaggcctcgggacgcgtcgcggtgctcggggccggcgtctccggccttgctatcgatgatctggtggcggtcaatccgagccagccttgcggaacctgccgcttttgcggggaaggactccctgtccactgccttgacatgcgcttcctgggcagtgcaatgcgtctcccccacacacagggtatgttccgcgattggctggtggttccggccgtccaatgtcatcccgcaggctcgcaggtgagccccggcgaggcagcctgtgccgagccgctggcggtctgccttcacgcggccgcccaggcgggcgaaatcaggggaaagaaggtactcgtcaccggagcggggccgatcggcgcgctcgtggtggcggcggcgcgccatgcgggagccgatgagatcgtcgtgacggatctggccgatgcggcactcgacagggccaaggccatgggagcgacccgcatcgtcaatgtccatcgcgatccggccgggcttgccgcctacgaggccgacaagggcaagttccacgtggccttcgaatgctcggccgccgagccggcactacgcggcgcggtcgcggcagttcggccgcgcggcacgatcgtgcaggtcggcgtgacgggcgaaattaccctgccgctccatgcgctggtcggcaaggagttgcggctcgtcggatcgcagcggttcgacggggaattcgcccttgcggtcgcgctcatctcggatcgccgaatcgacgtgcggccgatcatttcccatcagtttccggtcgacgaggcggttcgggccttcgagcaggccggcgatcgatccgctgcatgcaaggtgcagctgacatttctttcctga

SEQ ID NO: 9709 - protein, 352 aa, Sinorhizobium meliloti 1021
MSGAPTRTRFARLYGPRDLRLEVADVPAPGDGEVLLKMAAGGICGSDLHYYQDGGFGPVRVREPIIPGHEASGRVAVLGAGVSGLAIDDLVAVNPSQPCGTCRFCGEGLPVHCLDMRFLGSAMRLPHTQGMFRDWLVVPAVQCHPAGSQVSPGEAACAEPLAVCLHAAAQAGEIRGKKVLVTGAGPIGALVVAAARHAGADEIVVTDLADAALDRAKAMGATRIVNVHRDPAGLAAYEADKGKFHVAFECSAAEPALRGAVAAVRPRGTIVQVGVTGEITLPLHALVGKELRLVGSQRFDGEFALAVALISDRRIDVRPIISHQFPVDEAVRAFEQAGDRSAACKVQLTFLS

SEQ ID NO: 9710 - DNA, 1032 bp, Listeria monocytogenes EGD-e
  CDS (1)..(1032): transl_table=11
ttgaaagcagtagtaaaaacaaatcccggatatgatcaaatggagctaaaagatgtggaagaaccacaagtctatggcgacaaagtaaaaatcaaagtagcattcactggtatttgcggatcagatatccatacgtttaaaggagaatacaaaaatccaacaactcccgtcacacttggacatgaattttctggtgtcgttgtagaagttgggccagatgtaacgagtatcaaagtgggagaccgtgtcacaagtgaaacaacttttgaaacttgtggagagtgtatttattgtaaagaacatgattacaatttatgtagcaatcgtcgcggcattggtacgcaagcaaatggtagttttgcagaatttgttttatctcgcgaggaaagttgccacgtgctagatgaacgtatttcgctcgaagcagcagcactgacagaaccacttgcatgttgcgtgcattcggcgcttgaaaaaacaacaattcgtccagatgacacagtacttgttttcggaccggggccaattggattattactagctcaagttgtgaaagcgcaaggggcaacggtgattatggcaggaattaccaaagatagcgaccgcttacgtctagcaaaagaacttggaatggaccggattgtcgataccttaaaagaagacttggctgaagttgtgctcggcatgacagggggttacggagcggaacgcgtatttgattgctcaggcgcagtaccagctgtaaatcaaggattacctctaacgaagaaaaaaggcgattttgttcaagtaggactttttgccgaaaagaaaaatgcgattgatgaagaatctattatccaacgtgaaattgcttatattggcagccgttctcaaaaaccatcttcttggattttagcactcgacttacttgctaatggcaaaatcgatacagataaaatgattaccaaagtatatggtttagatgactggcgcgaggctttcgaggcagttatggcaggtaatgaaattaaagtattagtgaaatcttaa

SEQ ID NO: 9711 - protein, 343 aa, Listeria monocytogenes EGD-e
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKIDTDKMITKVYGLDDWREAFEAVMAGNEIKVLVKS

SEQ ID NO: 9712 - DNA, 1047 bp, Listeria innocua Clip11262
  CDS (1)..(1047): transl_table=11
atgaaagctttaaaattatatggaaaaagagatttgcgttatgaagacgcagatatgccaacaatcgaacaacctgatgatgttattttgaaagtaaaaacggttggaatttgcggatcagatatttcgagatacagtaaacttggtccgtatgtaccgggaatggtgtggggacacgaattttcaggagaagtgattgaggttggtagtgcggtaactgatattgaaattggtgatagggctgccggatgcccagcactctattgcggagagtgtgaatactgtaaaaaaggcgaattcgcccgctgtcggaagctaacagtaatcggagcaagacatcccggagcctatgctgagtatatcaaacttccagcagaaaatgtagtaaaaataccagacgaattagattatgaagcggctgcacttgtcgagccttctgcagtggtcgttcatggattttatcatacgaaattacaagctggcgatgatgtcgtcgttgtcggaagcggcaatatcggtttgctagcaattcaatgggcaaaagtttttggcgcaagaagagttattgcgattgatgtagacgataaaaagttagctcttgcgaaagaagtgggagcagacgtagttattaattctttaaaagaagatccattagaagtagtcgcagcacatacagatggtctaaatgctgatttagttgtagaagccgcgggatcacctattacatccgctcaagtttttgcctatgcgaaaaaaggtggaggcgtcgtgttcctaggaattccatatgctgatgtaacaatcgaacgtttctattttgaaaaaattgtgcggagtgagcttacagtttggggttcatggaacgcaatttccgcaccatttccaggaaaagagtggcaaacaaccattcacttcctagctaacaaacaaatcaacattgagccaatgattacacaccgtctttcacttgctgaaggaccagaagtttttgagcgaatctatgaaagaaatgaatttttcgggaaagtactatttttcccagaatga

SEQ ID NO: 9713 - protein, 348 aa, Listeria innocua Clip11262
MKALKLYGKRDLRYEDADMPTIEQPDDVILKVKTVGICGSDISRYSKLGPYVPGMVWGHEFSGEVIEVGSAVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 9714 - DNA, 1032 bp, Listeria innocua Clip11262
  CDS (1)..(1032): transl_table=11
ttgaaagcagtagtaaaaacaaaccccggatatgatcaaatggagctaagagatgtagaagaaccacaagtctatggcgacaaagtaaaaatcaaagtagctttcactggtatttgcggatcagatattcatacgtttaaaggtgaatacaaaaatccaacaactcccgttacactgggacatgaattttctggtgttgttgtagaagttgggccagatgtaacgagtatcaaagtgggagaccgcgtcacaagtgaaacaacttttgaaacttgtggagaatgtatttattgtaaggaacgtgattacaatttatgtagcaatcgtcgcggcattggtacgcaagcaaatggtagttttgcagaatttgttttatctcgcgaggaaagttgtcacgtgcttgatgaacgtatttcgctcgaagcagcagcactgacagaaccgcttgcatgttgtgttcattcagcgcttgaaaaaacaacgatttgtccagatgacacagtacttgttttcggaccaggtccaattggtttgttactagctcaagttgtgaaagcgcaaggggcaacggtgattatggcaggaattaccaaagatagcgaccgcttacgtctagcaaaagaacttggaatggaccggattgtcgatactttaaaagaagacttggctgaagttgtgctcggcatgacagatggttacggagcggaacgcgtatttgattgttccggcgcagtacccgcagtgaaccaaggattacctctaacgaagaaaaaaggcgattttattcaagtaggactttttgcagaaaagaaaaatgcgattgacgaagaatccattatccaacgtgaaattgcttatatcggcagccgttcgcaaaaaccatcttcttggattttagcgctcgatttactggcaaatggcaaaatcaatacggataaaatgattactaaagtatacggtttggatgactggcgcgaggctttcgaggcagttatggcaggaaatgaaattaaagtattagtgaaatcttaa

SEQ ID NO: 9715 - protein, 343 aa, Listeria innocua Clip11262
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTICPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFIQVGLFAEKKNAIDEESIIQREIAYIGSRSQKPSSWILALDLLANGKINTDKMITKVYGLDDWREAFEAVMAGNEIKVLVKS

SEQ ID NO: 9716 - DNA, 1035 bp, Ralstonia solanacearum GMI1000
  CDS (1)..(1035): transl_table=11
atggacgctctcgtcattcacgccgccaacgacctgcgcatcgaggacatcgacacccccgaggtgcagcccgatcaactgcgcgtgcaggtgcgctttggcggcatctgcggctccgacctgcactattacaaccacggcggcttcggcaccgtgcgcgtcaaggaaccgatggtgctgggccacgaggtggcgggccgcgtggaagaaatcgggcccggcgtgcaccggcatgccaagggcgatcgggtcgccatcagcccgagccggccctgcggccagtgccactattgccagcaaggcctgcagaaccattgcctggacatgcgctactacggcagtgccatgcgcacgccccacgtgcaaggcgcgttccgccgagagatcgtcatcgacgaaagccaggcgcatcgtcttgccgacaccctcagcgaccaggaaggggcaatggctgagccgttgtccgtggcgctgcatgccgtgcgccgcgccggcccgctgctgggcaagcgcgtgctggtgaccggctgcggccccatcggcgcattgatcgtggtggcggcgcggcgcgcgggggccgccgagatcatcgtcacggacatgggtgcctatccgctgaaggccgccgtcgcggtgggcgccgacgtcacgatcaacgtcgcggaacagcccgacgggctcaagccgtacaccaccgacaagggacagatcgacgtgttgttcgaggccagcggcaacgagcgcgcactgcgcggcgccatcgatgcgctgcgcccgcgcggcatcatcgtgcaggtggggctgggcggcgagatgacgctgcccctcaacgccatcgtcgccaaggaactcgagctgcgtggcgccttccgctttcacgaagagttcgccatggcggtcgagctgctgaacaagggcctggtcgacgtcaagccgctgatttccgctaccgtgccctaccgcaatgcggcccatgcgtttgcgcttgctggcgaccgcacacaggcgatgaaagtcctgctggattttcaatga

SEQ ID NO: 9717 - protein, 344 aa, Ralstonia solanacearum GMI1000
MDALVIHAANDLRIEDIDTPEVQPDQLRVQVRFGGICGSDLHYYNHGGFGTVRVKEPMVLGHEVAGRVEEIGPGVHRHAKGDRVAISPSRPCGQCHYCQQGLQNHCLDMRYYGSAMRTPHVQGAFRREIVIDESQAHRLADTLSDQEGAMAEPLSVALHAVRRAGPLLGKRVLVTGCGPIGALIVVAARRAGAAEIIVTDMGAYPLKAAVAVGADVTINVAEQPDGLKPYTTDKGQIDVLFEASGNERALRGAIDALRPRGIIVQVGLGGEMTLPLNAIVAKELELRGAFRFHEEFAMAVELLNKGLVDVKPLISATVPYRNAAHAFALAGDRTQAMKVLLDFQ

SEQ ID NO: 9718 - DNA, 1044 bp, Agrobacterium tumefaciens str. C58
  CDS (1)..(1044): transl_table=11
atgcgcggagtcgtcattcatgcagcaaaagacctgcgggtagaggacgttgctggccagccacttgccgcggacgaggtgcgggtggccgttgccgtcggcggaatttgcggctcggatctgcattattataaccatggcggcttcggcacggtgcgcgtgcgcgagccgatggcgctcggtcatgagtttgccggtacggtggttgaggtgggcagttcggtctcgcatctcgtgcccggcatgcgcgtggccgtcaatccgagcctgccttgcggcacctgccgctattgcgctcagggcaggcagaatcagtgcctggacatgcgcttcatgggcagcgccatgcgctccccccatgttcagggcggtttccgtgaagtcgtgaccgtccattcaacgcaaccggtacagatcgccgacggactttccatgggtgaggcagccatggccgagcctttggccgtgtgcctccatgccgcgcgtcaggcgggatcgcttctgggcaagacggtgctgataaccggtgccgggccgatcggcatgcttagcctgctggttgcccgtcttgccggcgcggcgcatatcgtcgttaccgatgtcgccgatgcaccgctcgatctggcgcgacgtatcggcgcggatgaagccgtcaacatcctgcgcgatgccgacatgcttgaaaaataccgatttgaaaaaggcgtcttcgacgtcctgttcgaagcctccggcaatcaggcggcacttctcccggcgctggatctgctccggccgggcggtattatcgtccagctcggtcttggcggagacttcaccattccgatgaacctcatcgttgccaaagagctgcagctgcgcggaacgttccgcttccacgaggaatttgcccaggcggtgaatatgatgggacgtggcctgatcgacgttaagcctttgatcagcgccacattgccgttcgatcaggcccgcgaggctttcgatcttgccggtgaccgcgcaaaaagcatgaaagtgcagcttgccttcagcggagcagcctga

SEQ ID NO: 9719 - protein, 347 aa, Agrobacterium tumefaciens str. C58
MRGVVIHAAKDLRVEDVAGQPLAADEVRVAVAVGGICGSDLHYYNHGGFGTVRVREPMALGHEFAGTVVEVGSSVSHLVPGMRVAVNPSLPCGTCRYCAQGRQNQCLDMRFMGSAMRSPHVQGGFREVVTVHSTQPVQIADGLSMGEAAMAEPLAVCLHAARQAGSLLGKTVLITGAGPIGMLSLLVARLAGAAHIVVTDVADAPLDLARRIGADEAVNILRDADMLEKYRFEKGVFDVLFEASGNQAALLPALDLLRPGGIIVQLGLGGDFTIPMNLIVAKELQLRGTFRFHEEFAQAVNMMGRGLIDVKPLISATLPFDQAREAFDLAGDRAKSMKVQLAFSGAA

SEQ ID NO: 9720 - DNA, 1119 bp, Agrobacterium tumefaciens str. C58
  CDS (1)..(1119): transl_table=11
atgacccaacccgccaccgcagccgtactggaagaaaaaaacggccgtttcattcttcgtgaagtgaagcttgaggcgccgcgccccgacgaagtgctgattcgcatggttgctacgggtatttgcgcgaccgatgctcatgtcaggcaacagctcatgccaactccgctgccggcgatcttgggccatgaaggcgccggcatcgtcgaacgcgttggatcgaccgtatcgcatctcaagcccggcgatcatgtcgttctttcctatcactcctgcggccactgcaagccctgcatgtcttcccatgcggcctactgcgaccacgtctgggaaacgaatttcgcaggcgccaggctcgatggaacgatcggcgttgcggcgcctgatgggaacacgctccatgcgcacttctttggtcagtcttcattctccacctatgcgctcgctcatcagcgcaatgccgtcaaggtcccggacgatgttccgctcgagctcctcggaccgctcggttgcgggttccagaccggagccggctcggtcttgaacgcgctcaaagtgccggtaggcgcctctatcgccattttcggggtaggggcagtggggttgtcggcgatcatggctgccaaggtcgccgatgccgccgtcattatcgccattgatgtcaataccgaacggctgaagctcgcttccgagctcggcgcgacgcattgcgtcaacccgcgtgaacaagccgatgttgcctcggcgatcagggatatcgcgcctcgcggcgtcgaatacgttctcgacacgagcggtcggaaggagaacctcgacggcggcatcggcgctcttgctccgatggggcagttcggttttgtcgccttcaacgaccattcgggcgcggttgtcgatgcctcccggctcacggtagggcaaagcctcatcgggattatccagggcgatgccatttccggcctgatgattccggaactggtcggtctctatcgaagcggccgtttcccgttcgacaggctgctcaccttctacgacttcgccgacatcaatgaggcatttgacgatgtcgcggcaggacgggtgatcaaggccgtcctgcgctttcccccgcaagctgcttaa

SEQ ID NO: 9721 - protein, 372 aa, Agrobacterium tumefaciens str. C58
MTQPATAAVLEEKNGRFILREVKLEAPRPDEVLIRMVATGICATDAHVRQQLMPTPLPAILGHEGAGIVERVGSTVSHLKPGDHVVLSYHSCGHCKPCMSSHAAYCDHVWETNFAGARLDGTIGVAAPDGNTLHAHFFGQSSFSTYALAHQRNAVKVPDDVPLELLGPLGCGFQTGAGSVLNALKVPVGASIAIFGVGAVGLSAIMAAKVADAAVIIAIDVNTERLKLASELGATHCVNPREQADVASAIRDIAPRGVEYVLDTSGRKENLDGGIGALAPMGQFGFVAFNDHSGAVVDASRLTVGQSLIGIIQGDAISGLMIPELVGLYRSGRFPFDRLLTFYDFADINEAFDDVAAGRVIKAVLRFPPQAA

SEQ ID NO: 9722 - DNA, 1062 bp, Pyrobaculum aerophilum str. IM2
  CDS (1)..(1062): transl_table=11
atgaaaatacccattaaaatgagagccgccctctataaagcgccaggacagcctctagaattagccgaaacagaaatccctactccgggagaaggggaaatattgataaaagtcgccgccacgggggtctgccactcagatctccacattctagacggggaaatcgtcccccctccagagggctttattctagggcatgaagtatctgggtgggttgtggatttcggccctcgttgtgaaaacccccacggactatcgcccggcgatcctgttgtaatatcttggattataccatgtggcaaatgttattggtgtgtgagaggccaggagaactactgtccttacgccgccgctagaatgcccggcttagtggggctaaacggaggccatgcagaatatatgtcagtgccagaaacagcagtctttccaattccaaaagaagttgacgtacacacagcagcagtcatatcatgcgcctacgggacagcctacagagcgctaaaagaagcggcagttggcccgggtacctctcttgtagtaattggcgttgggggcgtgggtctagcggccgtggagctggcgagcgccctaggcgcccgccccataattgcagttgacgtgagaaaacacgtcctggaaaaagccgcagagctgggggcgactcacttaataaatgcaactaacggagaccctttaagcaagataagagatatcttgccacaaggcgcagacgtcgtatatgaaacaaagccaaacccagatctcaaattagccgtggaaattgttaggagagggggaacaatagttgtcacaggattaggcacatcaactatcgaaatcccggcaaatcacatcgtaatgaacggaattaggataataggaagcctagggtataagcccagaacggacataccagaactattaacactagccgcaagtggaaaaataaaaccgcaacgccttatctctcacaaatatgctccaaatgaaataaacgaagcatataaaaatctaagaattggcttacatcacagagctattattatttggaatacaaaataa

SEQ ID NO: 9723 - protein, 353 aa, Pyrobaculum aerophilum str. IM2
MKIPIKMRAALYKAPGQPLELAETEIPTPGEGEILIKVAATGVCHSDLHILDGEIVPPPEGFILGHEVSGWVVDFGPRCENPHGLSPGDPVVISWIIPCGKCYWCVRGQENYCPYAAARMPGLVGLNGGHAEYMSVPETAVFPIPKEVDVHTAAVISCAYGTAYRALKEAAVGPGTSLVVIGVGGVGLAAVELASALGARPIIAVDVRKHVLEKAAELGATHLINATNGDPLSKIRDILPQGADVVYETKPNPDLKLAVEIVRRGGTIVVTGLGTSTIEIPANHIVMNGIRIIGSLGYKPRTDIPELLTLAASGKIKPQRLISHKYAPNEINEAYKNLRIGLHHRAIIIWNTK

SEQ ID NO: 9724 - DNA, 1035 bp, Oceanobacillus iheyensis HTE831
  CDS (1)..(1035): transl_table=11
atgaaggcattagtgaaaacagagctagggcatggtaatctacacattcaaaatgttgaagaaccaagcgtatctagtcatcaagtgaaaataaaagtagcttatgcaggtatttgcggttcggatattcatacgtacgaaggtcattataaagtagctgctccggtaactttaggacatgagttttccggtcggattgtagaggttggtgaaggagttaccgattttaaagtcggtgatcgtgttacttcagaaacaactttttctatttgtggagaatgtcgctattgtcaaactggtgattataatttatgcaatcatcgtaaagggttaggtacgcagcaaaatggtggatttacgaattacttgattgctagagaagaaagtcttcaccatttgcccgacgaagtggatgatcgttctgcatccatgacagaaccattagcatgtacgtatcatgctattcaaaaaataaatattaagccaggagatttagtcgttgtgcttggaccaggtccaattggtttgttagcagctcaggttgctaaaagctatggagctaccgtcatgatgtccggactcgataatgacaaaattcgtctggataaagcgaaagaagttggcattgactacgttatcaacattcaagaagaagatataaaggaaaaaattgcagctttaacggatggttatggagtggatgtagtattagaatgttctggttcgattcatgctgctaatcaaggtctcgacttactacggaaaaaaggaagctacgcacaagtaggaatttttccagactcacatgtgaagtttgatatggaaaaagtcattcaaaaagaaatacatgttgtaggaagtagaagtcaaaaatcagcagattgggaaccatcacttcagttaatgaaagaaaagaaagtagatgcaaaagccttagtaacgcatgaattcactattgatcagtgggatgaagcataccaagcgataaaagacggagaggcaataaaagtactattaaaaccattacaagattaa

SEQ ID NO: 9725 - protein, 344 aa, Oceanobacillus iheyensis HTE831
MKALVKTELGHGNLHIQNVEEPSVSSHQVKIKVAYAGICGSDIHTYEGHYKVAAPVTLGHEFSGRIVEVGEGVTDFKVGDRVTSETTFSICGECRYCQTGDYNLCNHRKGLGTQQNGGFTNYLIAREESLHHLPDEVDDRSASMTEPLACTYHAIQKINIKPGDLVVVLGPGPIGLLAAQVAKSYGATVMMSGLDNDKIRLDKAKEVGIDYVINIQEEDIKEKIAALTDGYGVDVVLECSGSIHAANQGLDLLRKKGSYAQVGIFPDSHVKFDMEKVIQKEIHVVGSRSQKSADWEPSLQLMKEKKVDAKALVTHEFTIDQWDEAYQAIKDGEAIKVLLKPLQD

SEQ ID NO: 9726 - DNA, 1017 bp, Oceanobacillus iheyensis HTE831
  CDS (1)..(1017): transl_table=11
atggagacagtaacttatgctggaccaaagaacattttatttcagaataatcgaaaaccaacgataaccaaaggttgggcaattataaaaacgtcatatgctgggatttgtgggagtgatttaagtatatttgctggtgtgcatccacgtgcagaggcccctttagtcatggggcatgagttctcaggaacgattgaagaaggtcacccaactttaaagaaaggaacaagggtaacggtcaatcctttattacgttgtggtgaatgctatccttgtcaaaatgggtatagccatgtatgtgagaacttgaaattagtgggtatagattgtgatggtgggatgggagagtatgtgaaagttcccatacatagcatcgtacctttgaaagataatatttcaatgaaattaggtgcgctaattgagccagttgcagttgctgtacacgcgataaggcaaggtaactacatgcctggagatagcgtcgtaattttcggtgcaggaacgattggtctttgtgtagctttaactttaaggtcttatggagcaaagaatttgataatcgtggaaccaaataaattacgattagagaaggcgaaacaactcggttttcaaacgttggatccattatctgagaatgtaacagagaaaatagtagaaggaaccgataatattggtgcagattacgtctttgattgtgcgggacatccttctgtagtggaagccattaccgaagttgtaagagtaagaggaaatatagttattgtagctatgtataagcagcccccaacccttgatatgagacaaggaatgtttaaagaattaaatatacaatttgtacgtgtttatacagataaagattttcaaatagccattgacttagtagacaatcacaaggagtatgaagatataataacgcatgtcttacaacctgaagaagcacaaaaaggcttcgatttattaactactcatacagatgcagtcaaagtaatgtatgaattcaataggggggagttgtaa

SEQ ID NO: 9727 - protein, 338 aa, Oceanobacillus iheyensis HTE831
METVTYAGPKNILFQNNRKPTITKGWAIIKTSYAGICGSDLSIFAGVHPRAEAPLVMGHEFSGTIEEGHPTLKKGTRVTVNPLLRCGECYPCQNGYSHVCENLKLVGIDCDGGMGEYVKVPIHSIVPLKDNISMKLGALIEPVAVAVHAIRQGNYMPGDSVVIFGAGTIGLCVALTLRSYGAKNLIIVEPNKLRLEKAKQLGFQTLDPLSENVTEKIVEGTDNIGADYVFDCAGHPSVVEAITEVVRVRGNIVIVAMYKQPPTLDMRQGMFKELNIQFVRVYTDKDFQIAIDLVDNHKEYEDIITHVLQPEEAQKGFDLLTTHTDAVKVMYEFNRGEL

SEQ ID NO: 9728 - DNA, 981 bp, Oceanobacillus iheyensis HTE831
  CDS (1)..(981): transl_table=11
gtgaatgggctttatttatcaagtcctggagttattgaatttagagagttagcttccaggtcaaaattaagcgatgatgaagttagaattaggctaatatacggagggatatgtggatctgatattagtgtatttaaaggaaagcttccacatgcgaactatccagttgtacctggtcatgaattaataggaaccgtcatagaaacaggtaaatctgcagccgattttgctggaaaacgcgtcgcaattatgccaaactccttctgtggtaagtgcgagtattgtaaggtaggaaaaacaaatatttgtacggagaaacaatcattaggtattaatagagatggtggttttgctgaagagtttgttatctcggcaaaatacgtattgtcattacccgatcaattgaccaatgaaaaggcagttcttattgaaccattggcagttattgttcacgcaatgaaaaaagtagtgattacagaggaaacaaaagttgccatcatcggatgtggtaacgaggggatgttagcaattgcggtggccgaatacttaggcgctcaagttaccgccatcgatgttaaacaaaataagttaaacaaagtatctcatagctatcacaacgtctctacatgtcaatcagccgatgctgaggaattgtttgatgtagttatagaagcagcaggaacaagtgaatcctttgaacagggaatacaattattaaaaccaggtggagcctttgtagctataggaatgccgccacatgcaaatttaccagttgtagaaatcgttcgcaaggaagtaacaatttatggatcaataatatataacttcccagaagactttaatacgagtatagaattcttgttacaggaagattttcaagtagaaccagttatttcaaaaattctttctgtaaacgaatatgaaaaggcatacacgtatgcggtatcaggagattatgggaaaattattttgaaattctag

SEQ ID NO: 9729 - protein, 326 aa, Oceanobacillus iheyensis HTE831
MNGLYLSSPGVIEFRELASRSKLSDDEVRIRLIYGGICGSDISVFKGKLPHANYPVVPGHELIGTVIETGKSAADFAGKRVAIMPNSFCGKCEYCKVGKTNICTEKQSLGINRDGGFAEEFVISAKYVLSLPDQLTNEKAVLIEPLAVIVHAMKKVVITEETKVAIIGCGNEGMLAIAVAEYLGAQVTAIDVKQNKLNKVSHSYHNVSTCQSADAEELFDVVIEAAGTSESFEQGIQLLKPGGAFVAIGMPPHANLPVVEIVRKEVTIYGSIIYNFPEDFNTSIEFLLQEDFQVEPVISKILSVNEYEKAYTYAVSGDYGKIILKF

SEQ ID NO: 9730 - DNA, 1029 bp, Oceanobacillus iheyensis HTE831
  CDS (1)..(1029): transl_table=11
atgaaagcggtatttgtagaagatgctgagaaaattattgtgaaagatatagaggtccccgagttaaaaccgaatgaggtgcaaatcaaagtaaatgtcgctgggatttgcggttccgatattcatacgtataaaggcttacatccatttcgtaaacccccggtcgttattggacatgaagtagctggagaagttgtagaagttggatcatccgttactaaattcaaggttggtgatcgagtaacggtggagccgcaaatcggtacaggtgagagtgaaggagtaatgacgggaaatgtaaattactctgatacaagactagctccaggaatgggagactggttagggacaatggctgaatatttcgcatcgcctgaagaacaagtaattaaattaccagattccgttagttatgatcaaggtgtattagtcgaacctcttgctgtaggtgtacatgcagcgtttaaaggcgatgttcaaccaaccgatcgagtagcaattttgggagccggaccaattggccttcttacacttatcgctgtgaaagctaaaggcgtaaaagatattgttgttacggatgtgctcgactattcactacaagtggcaaaagaaatgggtgcttcagaagttattaatattaaggataattcaaactggattcatgatgcgaagcagagcttagataaaggatcttttgataaagtatttatcactgcgggtgttcctggtattgtaaatgactctcttaatctactaagaaaaggtggacgagtggttaccgtagccatgttccatggacaacagtctgttgatatcgaacagttacagcaaaatgaaaaagaaattattgggtgcatgacatataaccgtccggatacagaagaagccctagaaataatcgcaagcgggaaacttgatgtagagaaggttatttcccataaattgcattatgaagaagcagcaaagggttttacaattgtagataaaaagaaagataaatccgttaaagtacttgtttcatttgaatag

SEQ ID NO: 9731 - protein, 342 aa, Oceanobacillus iheyensis HTE831
MKAVFVEDAEKIIVKDIEVPELKPNEVQIKVNVAGICGSDIHTYKGLHPFRKPPVVIGHEVAGEVVEVGSSVTKFKVGDRVTVEPQIGTGESEGVMTGNVNYSDTRLAPGMGDWLGTMAEYFASPEEQVIKLPDSVSYDQGVLVEPLAVGVHAAFKGDVQPTDRVAILGAGPIGLLTLIAVKAKGVKDIVVTDVLDYSLQVAKEMGASEVINIKDNSNWIHDAKQSLDKGSFDKVFITAGVPGIVNDSLNLLRKGGRVVTVAMFHGQQSVDIEQLQQNEKEIIGCMTYNRPDTEEALEIIASGKLDVEKVISHKLHYEEAAKGFTIVDKKKDKSVKVLVSFE

SEQ ID NO: 9732 - DNA, 1056 bp, Oceanobacillus iheyensis HTE831
  CDS (1)..(1056): transl_table=11
atgaaggcagcagtttggtatggtaaacacgatattcgtgtagagaataaggaagaacctataattaaacctggaaaggttaaaataaaagtagcatggacaggcatttgtggaagtgacctgcatgcttatcacggcgctgagggagtcgttcaagttggcgaacctcatcctgtaactggtgaaatggcaccattgacgcttgggcatgagttttctggtgtaattcatgaaattggtgaaggtgtaagcggtttatctgttggagatcgtgtagcgattgagccggctattaagtgtggcaagtgtgagaattgtgtacgaggaaactacaacttgtgtgaacacaatggctttgttggcttacaatctgacggtgcttttgctgagtatgcaattgttgatccacatatggttcacaagcttccagataatatatcgtttgaagaagctacagcaattgagcctacagctgtgtctttccacgcgcttaaattaagcaatatgaaagcaggcgatacggtagcggtctttggtgttggcccaattggtcttacggcgattctatgtgcgaaggcagctggtgcgtctcgtatttatgcgattgatgtttccaatgagcgtcttgagatggctcaaaagcttggcgcaactacggttattaatgcgatagaagagaatgcggcagaaaagatatatgctgaaacaggaagtggcgttactatcgcatttgattgtgcaggagctgaagcgactgtgaacagtgcaattgattcacttgctaaaggcggacaacttgtcattgtgtccattattccagaaccgatcaaagtaaatcttttgcaggcgaacttaaaagaaataaacattcttgcaactatcggttacagagatgtgtataaagacgttattgctatggtggaatcaggacagctggatcttaaaccgatcatcactaaaaaaatcggtttggatgatattatcgaagaaggcttccacgcccttacaaatgataagagccaagcaaaaattcttgtgagcccaacaggggtttaa

SEQ ID NO: 9733 - protein, 351 aa, Oceanobacillus iheyensis HTE831
MKAAVWYGKHDIRVENKEEPIIKPGKVKIKVAWTGICGSDLHAYHGAEGVVQVGEPHPVTGEMAPLTLGHEFSGVIHEIGEGVSGLSVGDRVAIEPAIKCGKCENCVRGNYNLCEHNGFVGLQSDGAFAEYAIVDPHMVHKLPDNISFEEATAIEPTAVSFHALKLSNMKAGDTVAVFGVGPIGLTAILCAKAAGASRIYAIDVSNERLEMAQKLGATTVINAIEENAAEKIYAETGSGVTIAFDCAGAEATVNSAIDSLAKGGQLVIVSIIPEPIKVNLLQANLKEINILATIGYRDVYKDVIAMVESGQLDLKPIITKKIGLDDIIEEGFHALTNDKSQAKILVSPTGV

SEQ ID NO: 9734 - DNA, 1077 bp, Shigella flexneri 2a str. 301
  CDS (1)..(1077): transl_table=11
atgaaagcactggctcggtttggcaaggcctttggcggctacaagatgattcatgtcccacaacccatttgtggcccggaagacgtagtgactgaaattaaagccgcggcaatctgcggcgcagacatgaagcactacaatgtcgatagcggttctgatgagtttaactctatccgcggccatgagttcgcaggttgtattgcgcaggttggtgaaaaagtcaaagactggaaagtggggcaacgcgtcgtgtcggataacagcggtcacgtttgcggcgtttgtccggcctgtgaacagggtgattttctgtgttgtacagaaaaagtaaaccttggtctggataacaatacctggggcggtggtttttccaaatattgtctggttcctggtgaaattctcaaaattcatcgtcatgcgttgtgggaaatccctgatggtgttgattatgaggacgcagccgtacttgaccctatctgtaatgcctataaatccatcgcgcagcaatcgaaattccttcctggtcaggatgttgtcgtcattggcactggcccactcgggctgttttccgtacaaatggcgcggattatgggggcggtaaatatcgtcgtcgttggtctgcaagaagatgtggcggtccgcttcccggttgcaaaagaactgggggcgacggcagtagtaaatggttctaccgaagatgtggtggcgcgctgccagcaaatttgtggcaaagataatctgggactggtgattgaatgctccggtgccaatatcgcactgaaacaagccatcgaaatgctccgcccgaatggggaagtggtacgcgttggaatgggcttcaaacctcttgatttctcgattaatgacattaccgcctggaataaaagcatcattgggcatatggcctatgactccacctcatggcgtaacgctatccggctattagccagcggcgctatcaaagtcaaaccgatgatcacgcatcgtatcggcctgtcgcaatggcgcgaagggtttgatgcgatggtcgataaaaccgcaatcaaagtgatcatgacttacgactttgatgaataa

SEQ ID NO: 9735 - protein, 358 aa, Shigella flexneri 2a str. 301
MKALARFGKAFGGYKMIHVPQPICGPEDVVTEIKAAAICGADMKHYNVDSGSDEFNSIRGHEFAGCIAQVGEKVKDWKVGQRVVSDNSGHVCGVCPACEQGDFLCCTEKVNLGLDNNTWGGGFSKYCLVPGEILKIHRHALWEIPDGVDYEDAAVLDPICNAYKSIAQQSKFLPGQDVVVIGTGPLGLFSVQMARIMGAVNIVVVGLQEDVAVRFPVAKELGATAVVNGSTEDVVARCQQICGKDNLGLVIECSGANIALKQAIEMLRPNGEVVRVGMGFKPLDFSINDITAWNKSIIGHMAYDSTSWRNAIRLLASGAIKVKPMITHRIGLSQWREGFDAMVDKTAIKVIMTYDFDE

SEQ ID NO: 9736 - DNA, 1041 bp, Shigella flexneri 2a str. 301
  CDS (1)..(1041): transl_table=11
atgaaatcagtagtgaatgatactgatggtatcgtgcgcgttgcaaaaagcgtcattcctgaaattaaacatcaggatgaggtgcgggtaaaaattgccagctcgggcttatgtggttccgatttacccaggatatttaaaaatggtgcacattattatccaataacgttaggccatgaatttagcggctatattgatgcggtgggatccggtgttgatgatttacaccctggcgatgcggttgcctgtgtgccgttattaccctgttttacttgtccagagtgtttgaaagggttttattcccagtgcgcaaaatatgattttattggctcgcggcgtgatggtggatttgctgaatatattgtcgttaagcgaaaaaatgtctttgctctacccacggatatgcctattgaggatggggcttttattgagccgattaccgttggcctgcatgcttttcatttagcgcaaggttgtgagaataaaaacgttattattattggtgccggaaccattggcctgctggctattcagtgcgctgtcgcgctgggagcaaagagtgtgacggcgatcgacattagctcagaaaaactggcactggcaaaatctttcggtgcgatgcaaacatttaacagtagcgaaatgagcgcgccgcaaatgcagagcgttttacgcgaactgcgctttaatcagcttatcctcgagacggctggcgtaccgcaaactgtcgaactggcggtagagattgccggtcctcatgcccaactggcgctggtgggcacgttgcatcaggatctgcatttaacatcggcaacgtttggcaaaatattgcgtaaagagctgacggttatcggcagttggatgaactattccagcccttggccggggcaggagtgggaaacggcgagccggttgctgacagaacgtaagttaagcctggagccattaatcgctcaccgtggaagctttgaaagcttcacccaggcggtgcgtgacatcgctcgtaatgccatgcagggcaaagtgttgctcattccatga

SEQ ID NO: 9737 - protein, 346 aa, Shigella flexneri 2a str. 301
MKSVVNDTDGIVRVAKSVIPEIKHQDEVRVKIASSGLCGSDLPRIFKNGAHYYPITLGHEFSGYIDAVGSGVDDLHPGDAVACVPLLPCFTCPECLKGFYSQCAKYDFIGSRRDGGFAEYIVVKRKNVFALPTDMPIEDGAFIEPITVGLHAFHLAQGCENKNVIIIGAGTIGLLAIQCAVALGAKSVTAIDISSEKLALAKSFGAMQTFNSSEMSAPQMQSVLRELRFNQLILETAGVPQTVELAVEIAGPHAQLALVGTLHQDLHLTSATFGKILRKELTVIGSWMNYSSPWPGQEWETASRLLTERKLSLEPLIAHRGSFESFTQAVRDIARNAMQGKVLLIP

SEQ ID NO: 9738 - DNA, 1047 bp, Leptospira interrogans serovar Lai str. 56601
  CDS (1)..(1047): transl_table=11
ttggggataatgggaatgaaagctgcggttttagaatccggtaaaaaaattttagagatcagagatgtttccgttccacaacttagggctgaacaagtaaaggtaagaattaaggcttgtggtatttgtggttcagacgtacatctcgtggttcatggaactctcaaatgtaaacattttcccagagttccaggacatgagtcatcgggaattatcgaagaagtaggcgagaacgttagacgattccgtaaaggagatcgagtggtcatcgcggccggaacttcatgtggagtttgttcttattgtaaagaaggaaaagaaaatctatgtaaagatttaggggtgtttggttttgatcgagatggaagttttgcagaatttaatatagtagaagaacgttatttgtattctcttccagatgagattccatttgatcaaggagcgattcttgcagatgctgtatctactccttatcacgctattcgttacagagggaatattcaggaaagtgatacagtagctatttttggttgtggggggcttggaatccatgcggtggcgattgcaagggcgatgacaaaaggtaaggtgattgcattggatgtggattcgggagctttagaaaacgctaccaaatatggagctgatgaagtggttaacttgaaagaagttcgaaattcgggcaaggttctaaaggaagtatcgaaaggtgtagatctacttgccgacttttcgggttatatgtctaacgtagaagattcaatacgagcgatgaacccgggaggtagaattgtacttgtaggtattggaagacagcccttgaaatttcagattccttttatattaattgaaaaaatgatttctgtttctggttcttatggatccgatcgtagagcgattcctgaattgattgaactttatctaaaaggaaaaatcaatctttctcattcgattacttctcatcatccattagaagaattgaatgaatgccttgaggccttggatcagagaaaaggaaatccgattcggtttattgttgaaccttaa

SEQ ID NO: 9739 - protein, 348 aa, Leptospira interrogans serovar Lai str. 56601
MGIMGMKAAVLESGKKILEIRDVSVPQLRAEQVKVRIKACGICGSDVHLVVHGTLKCKHFPRVPGHESSGIIEEVGENVRRFRKGDRVVIAAGTSCGVCSYCKEGKENLCKDLGVFGFDRDGSFAEFNIVEERYLYSLPDEIPFDQGAILADAVSTPYHAIRYRGNIQESDTVAIFGCGGLGIHAVAIARAMTKGKVIALDVDSGALENATKYGADEVVNLKEVRNSGKVLKEVSKGVDLLADFSGYMSNVEDSIRAMNPGGRIVLVGIGRQPLKFQIPFILIEKMISVSGSYGSDRRAIPELIELYLKGKINLSHSITSHHPLEELNECLEALDQRKGNPIRFIVEP

SEQ ID NO: 9740 - DNA, 1140 bp, Shewanella oneidensis MR-1
  CDS (1)..(1140): transl_table=11
atgtcgaatgaaaaaccacagtttatcaagtctaaggccgctgtggcttggggacctagacagccgcttaagattgaagaagtcgatgtgatgttacctaaagctggtgaagtattagtgcgcatcgtggcgactggcgtgtgccataccgatgcatttaccctaagtggtgatgatcctgaaggtgtgtttcctgcgatccttggccatgagggcggcgggattgttgagcaagtgggcgaaggcgtgaccagcgtgcaagtgggcgatcatgtgatcccactttatacgccagaatgcggcgaatgtaagttctgtttatcgggtaaaaccaatctgtgccaaaagatccgtgcgacccaaggtaaaggtttgatgcccgatggcaccactcgcttttataaagatggccagccgattttccattatatgggttgttcaactttttctgaatacacggtattacctgaaatctcattggctaaggtgaataaaacagcaccattaaaagaaatctgtctgctcggttgtggtgtcacaaccggtatgggcgcggtgatgaataccgctaaggttgaagcgggcgcaaccgtggcgattttcggccttggtggtatcggcctttcggccattattggtgcgaccatggccaaagctagccggattattgccatcgatattaatgaatccaaattcgaacttgcccgtaaattaggggctaccgattgtattaatccgaaaaatttcgataaaccgatccaagaggtgattgtcgagatgaccgatggcggcgtggattactccttcgaatgtatcggtaatgtcaatgtgatgcgcagtgcgcttgagtgttgtcacaaaggttggggcgagtcagttattattggcgtggcaggtgctgggcaggagatctcgactcgtccattccaactggtgacgggccgcgtatggcgaggttcggcctttggtggtgttaaaggtcgctcacaactgcctaaaatcgttgaacaataccttgcaggtgagtttaagctcgatgactttattactcacactatgggactcgaacaagtgaatgaggcctttgacttgatgcatgagggcaagagcattcgcagcgtgatccatttcgataaatag

SEQ ID NO: 9741 - protein, 379 aa, Shewanella oneidensis MR-1
MSNEKPQFIKSKAAVAWGPRQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLKEICLLGCGVTTGMGAVMNTAKVEAGATVAIFGLGGIGLSAIIGATMAKASRIIAIDINESKFELARKLGATDCINPKNFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 9742 - DNA, 1089 bp, Pseudomonas putida KT2440
  CDS (1)..(1089): transl_table=11
atgaatgacctgagccacacccacatgcgcgcggccgtctggcatggccgccacgatattcgtgtcgaacaggtacctttgccggccgaccctgcgccgggctgggtgcagatcaaggtggactggtgcggcatctgcggctccgacctgcacgaatatgttgccggcccggtgttcatcccggtagaggccccgcacccgctgaccggcattcagggccagtgcatcctcggccacgaattctgcggccacatcgccaagcttggcgaaggcgtggaaggctatgccgtaggcgacccggtggcggcagacgcgtgccagcattgtggtacctgctattactgcacccatggcctgtacaacatctgcgaacgcctggcgttcaccggcctgatgaacaacggtgccttcgccgagctggtcaacgtgcccgccaacctgctctaccggctgccgcagggcttccctgccgaagccggggcactgatcgagccgctggcggtgggtatgcacgcggtgaaaaaggccggcagcctgcttgggcaaaccgttgtagtggttggggccggcaccatcggcctgtgcaccatcatgtgcgccaaggctgcaggtgcggcacaggtcatcgcccttgagatgtcctctgcgcgcaaagccaaggccaaggaagcgggcgccaacgtggtgctggaccccagccagtgcgatgccctggcggaaatccgcgcactgactgctgggctgggcgccgatgtgagttttgagtgcatcggcaacaaacatacggccaagctggccatcgacaccatccgcaaagcaggcaagtgcgtgctggtgggtattttcgaagagcccagcgagttcaacttcttcgagctggtgtccaccgagaagcaagtgctgggggcgttggcgtacaacggcgagtttgctgacgtgattgccttcattgctgatggtcggctggatattcgcccgctggtaaccggccggatcggattggagcagattgtcgagctgggcttcgaggaactggtgaacaacaaagaggagaacgtgaagatcatcgtttcaccaggtgtgcgctga

SEQ ID NO: 9743 - protein, 362 aa, Pseudomonas putida KT2440
MNDLSHTHMRAAVWHGRHDIRVEQVPLPADPAPGWVQIKVDWCGICGSDLHEYVAGPVFIPVEAPHPLTGIQGQCILGHEFCGHIAKLGEGVEGYAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEAGANVVLDPSQCDALAEIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 9744 - DNA, 1044 bp, Escherichia coli CFT073
  CDS (1)..(1044): transl_table=11
atgaaaaattcaaaagcaatattgcaggtgccgggcacaatgaaaattatttcagcagaaatacctgtgcctaaagaagatgaagttttgattaaagtggaatatgtcggtatttgtggttcagatgtacatggttttgaatcaggcccgtttattcctcctaaagacccaaatcaagaaattggcctgggtcatgaatgcgccgggacggttgtggctgtgggaagccgcgtgcgcaaatttaaaccgggggatcgggtaaatatcgaacctggcgttccttgcggtcactgtcgttactgtctggaaggcaaatataacatttgcccggacgttgattttatggcgacacaacccaactaccgcggcgcattaacgcactatctgtgtcatccggagagctttacttacaaactgccagacaatatggacacgatggaaggggcgctggtggagcctgccgcagtcgggatgcatgccgcgatgctggcagatgttaaacctggtaagaagataattattctgggagcgggttgtattggtttgatgacgttgcaagcgtgcaaatgcctgggagcaacggaaattgccgtcgttgatgtgctggaaaaacgtctgacaatggcggaacagctcggcgcgacagtggttattaacggcgcaaaagaagacactattgcacgctgtcagcaatttaccgaagacatgggcgcagatattgtttttgaaacagcgggttctgcggtcaccgttaaacaggcaccttatctggtcatgcgcggcggtaaaattatgattgttggtactgtacccggcgattcggcaatcaatttcctcaaaatcaatcgcgaagtcactatccagacggtattccgctatgccaatcgttatccggtcacgattgaagctatttcctcagggcgattcgatgtgaaatcgatggtgacgcatatttacgattatcgggatgtacaacaggcatttgaagagtcagttaacaacaaacgcgacattattaaaggcgttattaaaattagcgattaa

SEQ ID NO: 9745 - protein, 347 aa, Escherichia coli CFT073
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLTMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 9746 - DNA, 1053 bp, Staphylococcus epidermidis ATCC 12228
  CDS (1)..(1053): transl_table=11
atgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcatagaaaatgttggtaaagacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacacactgacaacggtgtagatgtgtcatttgaagttgctggtgtaggtattactttacaacaatctattgaagtaacacgtccgcgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagagaatattgttgaaagtggcttcaatcaacttgtaaacgataaatctcaagctaaaattttagtccgtttaaatggcgaccaaaaataa

SEQ ID NO: 9747 - protein, 350 aa, Staphylococcus epidermidis ATCC 12228
MKAAVWYGQKDVRVEDREPKAIKDNEVQVKVSWAGICGTDLHEYLEGPIFISTDQPDPLLGQTAPVTLGHEFSGVIENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELENIVESGFNQLVNDKSQAKILVRLNGDQK

SEQ ID NO: 9748 - DNA, 1053 bp, Staphylococcus epidermidis ATCC 12228
  CDS (1)..(1053): transl_table=11
atgaaagcttatgaatacttaaaacctggtcatgcacaacttacggataaagagaagccaaccattacgagcagtactgacgctattattcgcatagttaagacgacaatatgtggtacagatcttcatatcataaaaggagatacacctgaagttaaatcacatacgacactaggtcacgaaggtattggaatcattgaagaaattggtgacaacgttaacaacttcaaagttggagataaagtgattatctcttgcatttcatcatgtggcaaatgctactattgcaaaaaaggtatctatgcacattgtgaaaacggaggaggatggatattaggacatttagtgaatggtactcaagcagaatatgttaaagttccttttgcagataattctttatatcacgccccttcaaatttaaaagaagacgcccttgtaatgttatcagatatacttccaacaggttatgaaattggtgttttaaaaggtaaagttaaacctggctgtacagtagccattgtaggtgctggtcctgtaggtttagcagcattacttacagcacaattctattcaccttcaaaaattattatgattgatttagatgataatagattagaaaccgctaaagaaataggtgctacgcatttaattaactctaaagagactgaaaccgcaattaaaaaggtaaaatcgttaaatccacgtggtgttgatgttgctattgaagctgtcggaattccacaaacctttgatttatgtcaaaatttaattggtgtcgatggtacgattgctaatgttggtgtgcatgggttacctgtacaacttgatatagataaattatggattaaaaatattaacgtaactactggtttagtttcaggaaatacaactgaagaattacttgaagcgttaaaaagcaaaataatacaaccagaacaactcgtgacacattatagtaaactgagtgaaatcgaaagtgcctatgatttatttagaaatgcaacagatcataaagcgattaaattaatcatagagaatgatatcacaatttaa

SEQ ID NO: 9749 - protein, 350 aa, Staphylococcus epidermidis ATCC 12228
MKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKEIGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 9750 - DNA, 1032 bp, Bradyrhizobium japonicum USDA 110
  CDS (1)..(1032): transl_table=11
atgcgcgccgtcgtcattcacgccccgaaagacctgcggatcgacagctatcccgatccggcacccggcccgggcgaggtccgcgtcaagatcgccaatggcggcatctgcggctcggacctgcattactaccatcacggcggcttcggcgtcgtgcgcatccagcagccgatggcgctgggccatgagatcgccggcgtggtcgcggccgtcggtgacggcgtgaccagcgtgaagccgggcacgcgcgtcgccgtcaatccgagcaagccgtgcggcaagtgcctgcattgccaggaggggatgcgcaaccaatgcctcgacatgcgcttcctcggcagcgcgatgcgctttccccatgtgcagggcggctttcgcgagttcctcacgatcgatgcgacgcaggccgtaccgatcgcggatgagctgtcgctggccgaggccgcggtcgccgagccgctcgcggtttgcctgcatgccggcaagcaggccggccccctcctcggcaagcgcgtgctgatcaccggctgcggcccgatcggtgcactgatgatcctggtctcgcgtttcggcggggcgtccgagatcgtggtgaccgatgtcgccgacgcgccgctggcggtcgccagaaagctcggtgccacccacgccatcaacgtcgcgacccatgccaccgcgctcgatccctggcgcgccggcaagggcgtgttcgacacgctgttcgaggcttccggcaaccaggctgcgctccgcaccgcgctcgacgtgctcaggcccggcgccacgctggtgcagctcggcctcggcggcgagatgacgctgccgatcaactccatcgtcgccaaggaattgcagctccgcggcaccttccgcttcgatcccgagttcgagctcgcggtgcggctgatgggcgaaggcctgatcgacgtcaagccgctgatcacggccaccatgccgttcgagaacgcggtcgccgccttcgagcttgccagcgaccgttcgcagtcgatgaaggtgcagctgtcgttctag

SEQ ID NO: 9751 - protein, 343 aa, Bradyrhizobium japonicum USDA 110
MRAVVIHAPKDLRIDSYPDPAPGPGEVRVKIANGGICGSDLHYYHHGGFGVVRIQQPMALGHEIAGVVAAVGDGVTSVKPGTRVAVNPSKPCGKCLHCQEGMRNQCLDMRFLGSAMRFPHVQGGFREFLTIDATQAVPIADELSLAEAAVAEPLAVCLHAGKQAGPLLGKRVLITGCGPIGALMILVSRFGGASEIVVTDVADAPLAVARKLGATHAINVATHATALDPWRAGKGVFDTLFEASGNQAALRTALDVLRPGATLVQLGLGGEMTLPINSIVAKELQLRGTFRFDPEFELAVRLMGEGLIDVKPLITATMPFENAVAAFELASDRSQSMKVQLSF

SEQ ID NO: 9752 - DNA, 1110 bp, Bradyrhizobium japonicum USDA 110
  CDS (1)..(1110): transl_table=11
atgaagacacgtgccgccgttgctttcgaagccaagaaaccactcgagatcgtcgaagtcgatctggaaggaccgaaggccggcgaagtcctggtcgagatcaaggcgacgggcatctgccataccgacgcctacacgctcgacggcttcgacagcgaaggaatcttcccgtcgatcctcggccatgagggcgccggaatcatccgcgagatcggccccggcgtgacctcggtcaagccgggcgaccacgtcatcccgctgtacacgccggaatgccggcagtgcaaaagctgcctgagccagaagaccaatctctgcaccgcgatccgcgcgacgcagggcaagggcgtgatgcccgacggcaccagccgcttctcctacaagggcaagccgatctaccactacatgggctgctcgaccttctcgaacttcaccgtgctgcccgagatcgccgtcgccaagatccgcgaagacgcgccgttcgacaagagctgctacatcggttgcggcgtcaccaccggcgtcggcgcggtcgtcaacactgccaaggtcgagccgggcgccaacgtggtcgtgttcggcctcggcggcatcggactgaatgtgatccagggcgccaagatggccggcgccgacaagatcatcggcgtcgacgtcaatgattccaaggaagattggggccgccggttcggcatgacccacttcgtcaacccgaagaagatcaccggcgacatcgttccgcatctcgtcaacctcaccgacggcggcgccgactacaccttcgactgcaccggcaacaccaccgtgatgcgccaggcgctggaagcctgccatcgcggctggggcacctcgatcatcatcggcgtcgccgaagccggcaaggagatcgccacccgcccgttccagctcgtcaccggccgcaattggcgcggcacggctttcggcggcgcgcgcggccgcaccgacgtgccgaagatcgtcgactggtacatgaacggaaagatccagatcgatccgatgatcacccacgtgctcaagctcgaagagatcaacaagggctttgacctcatgcatgagggcaaatccatccgttccgtcgtcgtctactag

SEQ ID NO: 9753 - protein, 369 aa, Bradyrhizobium japonicum USDA 110
MKTRAAVAFEAKKPLEIVEVDLEGPKAGEVLVEIKATGICHTDAYTLDGFDSEGIFPSILGHEGAGIIREIGPGVTSVKPGDHVIPLYTPECRQCKSCLSQKTNLCTAIRATQGKGVMPDGTSRFSYKGKPIYHYMGCSTFSNFTVLPEIAVAKIREDAPFDKSCYIGCGVTTGVGAVVNTAKVEPGANVVVFGLGGIGLNVIQGAKMAGADKIIGVDVNDSKEDWGRRFGMTHFVNPKKITGDIVPHLVNLTDGGADYTFDCTGNTTVMRQALEACHRGWGTSIIIGVAEAGKEIATRPFQLVTGRNWRGTAFGGARGRTDVPKIVDWYMNGKIQIDPMITHVLKLEEINKGFDLMHEGKSIRSVVVY

SEQ ID NO: 9754 - DNA, 1050 bp, Bradyrhizobium japonicum USDA 110
  CDS (1)..(1050): transl_table=11
atgacctccactgctctcgccgcaaccctgttcggccccgaagatctgcgcatgatcgagcatccgctcgacaagctcgcatcaggcatggtgcgcatccgcttcggcgccggcggcatctgcggctcggacatgcattatttccgtcatgcgcggaccggtgatttcgtggtgaagtcgcctttggtgctgggacatgagatctccggcgaggtcgtggagatatcgggttccgcagccaatctgaaggtcggcgaccgcgtcgccgtcaatccgtcgcgctggtgcggccattgcgtcgcctgccgcgagggccggccgaacctctgcgaaaacatctatttcatgggctcggcctcgaagaccccgcacatgcagggcggctttgccaattacttcgacgcgatccccgcgcaatgcgtcaagattcccgatcacgtctcctatcaggcggcagcgctcgccgagccgctcgcagtctgcctgcacgcggtcgcgcgcgccggcaatatcgagggcaagcgcggcatcatcttcggcgccggtccgatcgggcttctgaccatgctcgccgcgcaccgtgccggcatggccgacatcacggtggccgacatcgcaccggcaccgctcgcctttgcgagccggcttggcgcctctcatgtcgagaacgtatcgggtggcgaagagggcctgaaggcgcaggccgctgcacgtccctacgacgtcgcgttcgaagtctcgggcacggccgcgggccttgccagtgcgatcggcatcgtccggcgtggcggcgtcgtggtgcagatcggcaatctgcccggtggccagatcccgacgccgtcgaacgccgtgatggcgaaggagatcgacctgcgcggctcgttccgcttcggcttcgagttcatgacggcggtggaactgatttccgctggcagcgtcgacgtgctgtcgctggtcacggccgagcggccgctctcgaccgcacccgatgcgctgcggctggcgctcgaccgctcgcagagcgtcaaggtcgtgctgactgcgaactga

SEQ ID NO: 9755 - protein, 349 aa, Bradyrhizobium japonicum USDA 110
MTSTALAATLFGPEDLRMIEHPLDKLASGMVRIRFGAGGICGSDMHYFRHARTGDFVVKSPLVLGHEISGEVVEISGSAANLKVGDRVAVNPSRWCGHCVACREGRPNLCENIYFMGSASKTPHMQGGFANYFDAIPAQCVKIPDHVSYQAAALAEPLAVCLHAVARAGNIEGKRGIIFGAGPIGLLTMLAAHRAGMADITVADIAPAPLAFASRLGASHVENVSGGEEGLKAQAAARPYDVAFEVSGTAAGLASAIGIVRRGGVVVQIGNLPGGQIPTPSNAVMAKEIDLRGSFRFGFEFMTAVELISAGSVDVLSLVTAERPLSTAPDALRLALDRSQSVKVVLTAN

SEQ ID NO: 9756 - DNA, 1059 bp, Lactobacillus plantarum WCFS1
  CDS (1)..(1059): transl_table=11
atggaggctgtcgttaagacggaatctggttacgacaatatggaactgaagcaaattccaatccctgaagtaacaggagacaaagttttattaaaagtggcctacactgggatctgcggtactgatattcatacatttaagggtcagtatgccaatgcggtgacaccacttgttttgggccatgaattttcaggtgaagttgttgaagtgggaccagatgttaaaacgctaaagcctggcgaccgggtgactagtgaaacgacttttgcaacggatggcacatgtgtttactgccaagataaagaatataatttatgtcctaaccgtgtaggaatcggaactaaagctaatggttcaatggcaaattatgttctaactcgtgaggaaagtgctcacattttaccggataacgtttcctacaagatggctgcaatgtcggaacctttagcatcttgtgttcatgctatgtatcaaaagacaccattcacgttacacgacactttattaattatgggaccaggaccaatggggctactctcattgcagattgccaaagaaattggtgcctttgttattgtttctgggatcactaaggatgctgatcgtttacaaattgctaaagagttaggtgctgacattattgtagatacccaaaaagaagacttggccaaggtcgtgatggatgcgacagatggcgttggcgttaccaaggtttatgactgttcaggtgcaacgccagcggttaactctgcattaccattgatccgtaagggtggaactttccaacaggttggtctttttgcaaagccgatgaatgaattagatgaacgttcaattattcagcatgaaattacgtatcgtggctcacggtcacaaaatccgtatgattgggcgattgctttacatcttgaaagcaagggtgctattaaccaagatgcaatgattacgaaggtctttgatcttgaacactggcgtgacgcttttgatgcaatgatggccggtaaagagctcaaagttatgattgcctctaatcctgatgatccagatttagcagactaa

SEQ ID NO: 9757 - protein, 352 aa, Lactobacillus plantarum WCFS1
MEAVVKTESGYDNMELKQIPIPEVTGDKVLLKVAYTGICGTDIHTFKGQYANAVTPLVLGHEFSGEVVEVGPDVKTLKPGDRVTSETTFATDGTCVYCQDKEYNLCPNRVGIGTKANGSMANYVLTREESAHILPDNVSYKMAAMSEPLASCVHAMYQKTPFTLHDTLLIMGPGPMGLLSLQIAKEIGAFVIVSGITKDADRLQIAKELGADIIVDTQKEDLAKVVMDATDGVGVTKVYDCSGATPAVNSALPLIRKGGTFQQVGLFAKPMNELDERSIIQHEITYRGSRSQNPYDWAIALHLESKGAINQDAMITKVFDLEHWRDAFDAMMAGKELKVMIASNPDDPDLAD

SEQ ID NO: 9758 - DNA, 1113 bp, Pseudomonas syringae pv. tomato str. DC3000
  CDS (1)..(1113): transl_table=11
atgatcaagtcacgcgccgctgtcgcctttgaagccaaaaagccactggagatcgttgaagtcgatgtcgccatgcccaaagcgggagaagtgctgctcaaagtagtggcatccggcgtctgccataccgatgcgtacacgctttccggcgccgaccctgaggggatctttccgtcgattctcggccatgaaggcggcgcgattgtcgaagccatcggcgagggcgtgacctctgtggcggtcggtgatcacgtcattccgctgtacaccccggaatgccgtcagtgcaaattctgccggtcggggaaaaccaacctgtgtcaggcgatccgttcgacccaaggcaaaggcctgatgccggatggcaccacgcgcttctcttataagggcgagccgattttccactacatgggcacctcgaccttctccgaatacaccgtgctgccagaaatctcggtggccaaaatcgacaagaaagcccccctggaaaaagtctgcctgctgggttgcggcgtcaccaccggtattggcgcagtgctcaacaccgccaaggtcaagccgggcgataccgtagcggtcttcggtctgggcggtatcggcctctcggcggtgattggcgcggtcaaagccaaggcggcgcgaatcatcgccatcgacatcaacccggccaagttcgagattgccaaacagctcggcgcgaccgattgcgtcaatccgaaggatttcgaccgtccgatccaggaagtcatcgttgacatgaccgatggcggcgtcgacttttcgttcgagtgcatcggcaatgtgcagctcatgcgttcagcgctggaatcctgccacaagggctggggtgagtcggtgatcattggcgtggccggtgccggtcaggaaatctcgacccgtccattccagttggtgaccgggcgcgtctggcgcggttcggcgttcgggggcgtgcgtggccgtaccgaattgccaagctacgtcgacatggcgcagaccggcgaaattccgctggacacgttcatcacccacacaatgggcctggaagacatcaacaaggcattcgatctgatgcatgaaggcaaaagcatccgcaccgtcattcatttttga

SEQ ID NO: 9759 - protein, 370 aa, Pseudomonas syringae pv. tomato str. DC3000
MIKSRAAVAFEAKKPLEIVEVDVAMPKAGEVLLKVVASGVCHTDAYTLSGADPEGIFPSILGHEGGAIVEAIGEGVTSVAVGDHVIPLYTPECRQCKFCRSGKTNLCQAIRSTQGKGLMPDGTTRFSYKGEPIFHYMGTSTFSEYTVLPEISVAKIDKKAPLEKVCLLGCGVTTGIGAVLNTAKVKPGDTVAVFGLGGIGLSAVIGAVKAKAARIIAIDINPAKFEIAKQLGATDCVNPKDFDRPIQEVIVDMTDGGVDFSFECIGNVQLMRSALESCHKGWGESVIIGVAGAGQEISTRPFQLVTGRVWRGSAFGGVRGRTELPSYVDMAQTGEIPLDTFITHTMGLEDINKAFDLMHEGKSIRTVIHF

SEQ ID NO: 9760 - DNA, 1044 bp, Salmonella enterica subsp. enterica serovar Typhi Ty2
  CDS (1)..(1044): transl_table=11
atgaaatcagtggttattcacgctgagggagacgtgcgcgttgaagaacgtcccttaccacaactgcaagccgaggacgatgtgttggtcaaagtcgttagctcagggctttgcgggtcggatatcccgcgtattttcgcgcagggcgcccattattatcctattacgttaggccatgaattcagcggctacgttgaatcctacggcacaggcgtaacggatatgcagcctggcgatgccgtcgcttgtgtcccgcttcttccctgctttcactgtccgcaatgcgaacgcggttacttttctttatgcaaacagtatcagtttgtaggatcgcgcagcgaaggcggtaatgcggaatatgtggtggtcaaacgggccaatcttttccgcttgccgtctgatatgccgattgaagatggcgcgtttatcgaaccgattaccgtgggcttacacgcctttcatctggcgcagggctgcgaggggaaaaacgtaattatcgtcggggccgggacaattggcctgctggccttacagtgcgcgcgggaactgggcgcgcgaagcgtaacggcgattgatatcaatccgcagaaactggaactggcgaaagcgctcggcgcaacgcatacctgtaatagccgggaaatgaccgccgacgacatccagaccgcgttgtccgacattcagtttgatcaactggttctcgaaacggcaggaactccccagaccgtctcgctggctatcgatatcaccgggccgcgcgcgcaactggcgctggtggggacgttacatcacgatctcaccctgacgacgcgtacattcgggttaattttgcgtaaagagctcacgctcctcggcagttggatgaactactccgcgccatggccaggagaagaatgggaaaccgcagcgcgcctgttggctgaaaaacgtcttcaactgacccctctcattgcccatcgcggcgatgcggaaagctttgcagaagcagtcaaagcgcttaatggcgcgcccatgcagggcaaaatcttacttcaactttcctga

SEQ ID NO: 9761 - protein, 347 aa, Salmonella enterica subsp. enterica serovar Typhi Ty2
MKSVVIHAEGDVRVEERPLPQLQAEDDVLVKVVSSGLCGSDIPRIFAQGAHYYPITLGHEFSGYVESYGTGVTDMQPGDAVACVPLLPCFHCPQCERGYFSLCKQYQFVGSRSEGGNAEYVVVKRANLFRLPSDMPIEDGAFIEPITVGLHAFHLAQGCEGKNVIIVGAGTIGLLALQCARELGARSVTAIDINPQKLELAKALGATHTCNSREMTADDIQTALSDIQFDQLVLETAGTPQTVSLAIDITGPRAQLALVGTLHHDLTLTTRTFGLILRKELTLLGSWMNYSAPWPGEEWETAARLLAEKRLQLTPLIAHRGDAESFAEAVKALNGAPMQGKILLQLS

SEQ ID NO: 9762 - DNA, 1053 bp, Bacillus cereus ATCC 14579
  CDS (1)..(1053): transl_table=11
atgaaagcactactttggcataatcaacgtgatgtacgagtagaagaagtaccagaaccaacagtaaaaccaggaacagtgaaaatcaaagttaaatggtgtggtatttgtgggacagacttgcatgaatatttagcagggcctatttttattccaacagaagaacatccattaacacatgtgaaagcacctgttattttaggtcatgagtttagtggtgaggtaatagagattggtgaaggagttacatctcataaagtgggagaccgcgttgttgtagagccaatttattcttgtggtaaatgtgaagcttgtaaacatggacattacaatgtttgtgaacaacttgttttccacggtcttggcggagaaggcggcggtttctctgaatatacagtagtaccagaagatatggttcatcacattccagatgaaatgacgtatgaacaaggtgcgcttgtagaaccagcagcagtagcagttcatgcagtacgtcaaagtaaattaaaagaaggggaagctgtagcggtatttggttgcggtccaattggacttcttgttatccaagcagctaaagcagcaggagcaactcctgttattgcagttgaactttctaaagaacgtcaagagttagcgaaattagcaggtgcggattatgtattaaatccagcaactcaagatgtgttagctgaaattcgtaacttaacaaatggtttaggtgtaaatgttagctttgaagtaacaggtgttgaagttgtactacgccaagcgattgaaagtacaagcttcgaaggacaaactgtaattgttagtgtatgggaaaaagacgcaacaattactccaaataacttagtattaaaagaaaaagaagttattggtattttaggataccgtcacatcttcccagctgttattaaattgattagctccggtcaaattcaagcagagaaattaattacgaaaaaaattacagtggatcaagttgttgaagaaggatttgaagcacttgtaaaagataaaacacaagtgaaaattcttgtttcacctaaataa

SEQ ID NO: 9763 - protein, 350 aa, Bacillus cereus ATCC 14579
MKALLWHNQRDVRVEEVPEPTVKPGTVKIKVKWCGICGTDLHEYLAGPIFIPTEEHPLTHVKAPVILGHEFSGEVIEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVIGILGYRHIFPAVIKLISSGQIQAEKLITKKITVDQVVEEGFEALVKDKTQVKILVSPK

SEQ ID NO: 9764 - DNA, 1107 bp, Nitrosomonas europaea ATCC 19718
  CDS (1)..(1107): transl_table=11
atgaaaacacgtgcagcagttgcctggcaagctggccagccacttaccatcgaagaagtcgatctcgccggccctcgtactggcgaggtgttggtcgaaatcaaggcaacgggcatctgccataccgattattacacgctttccggtgccgatccggaaggtttgtttcccgccatccttggccatgagggtgccggtatcgtggttgaagttggtgcagacgtcaaatcactccgtccgggggatcatgtcattcctctgtacacgccggaatgccgggaatgcaagttctgtctatcacgcaaaaccaatttatgtcaggccatccgtgcgacgcagggacgcggcctaatgccggatggcacttcacgcttctcactcgatggcaaggccattatgcactatatgggtacttcgactttttccaactatattgtcgttcctgaaattgctttggcaaagattcgtgaagatgccccttttgataaagcctgttacatcggctgtggtgtgactactggcattggtgcggtactgtttactgccaaagtggaagtcggagcaaatgtcgctgtattcggactgggaggaatcggcctgaacgtcattcagggtgcacgcatggcgggcgctgacaaaatcatcggtattgatctcaatcctgaacgggaagcattgggccgccaatttggtatgacgcatttcatcgatccaagccaggtggaaaacgtggtggatgctgtgatacaactgactgacggtggtgcagactacagctttgaatgcatcggtaataccacagttatgcgtcaggctctggaatgcacacataaaggctgggggcgcagcatcatcattggagtagccaaagccggcgccgaaatcagtacccgtccattccagctcgttaccggcagaaaatgggaaggctctgcctttggcggagcgcgcggccgttcggatgtgccacgaatcgtcgactggtacatggatggcaaaatcagcattgatccgttgatcacacacatattgaagctggaagaaatcaatgaaggcttcaagttgatggaagcaggcgaatcgattcgttcagtggtggttttctga

SEQ ID NO: 9765 - protein, 368 aa, Nitrosomonas europaea ATCC 19718
MKTRAAVAWQAGQPLTIEEVDLAGPRTGEVLVEIKATGICHTDYYTLSGADPEGLFPAILGHEGAGIVVEVGADVKSLRPGDHVIPLYTPECRECKFCLSRKTNLCQAIRATQGRGLMPDGTSRFSLDGKAIMHYMGTSTFSNYIVVPEIALAKIREDAPFDKACYIGCGVTTGIGAVLFTAKVEVGANVAVFGLGGIGLNVIQGARMAGADKIIGIDLNPEREALGRQFGMTHFIDPSQVENVVDAVIQLTDGGADYSFECIGNTTVMRQALECTHKGWGRSIIIGVAKAGAEISTRPFQLVTGRKWEGSAFGGARGRSDVPRIVDWYMDGKISIDPLITHILKLEEINEGFKLMEAGESIRSVVVF

SEQ ID NO: 9766 - DNA, 1053 bp, Bacillus anthracis str. Ames
  CDS (1)..(1053): transl_table=11
atgaaagcattactttggcataatcaacgtgatgtaagagtagaagaagtaccagaaccaactgtaaaaccaggagcagttaagattaaagttaaatggtgtggtatctgcgggacagacttgcatgaatatttagcaggacctatttttattccgacagaagagcatccattaacacatgtaaaagcaccggttattttaggtcatgagtttagcggtgaggtagttgaaatcggtgaaggcgttacatctcataaagtgggagaccgcgtcgttgtagaaccaatttattcttgtggtaaatgtgaagcttgtaaacatggacattacaatgtttgtgaacaacttgttttccacggtcttggcggagaaggcggcggtttctctgaatatacagtagtaccagaagatatggttcaccatattccagatgaaatgacgtatgaacaaggtgctcttgtagaaccagcagcagtagcggttcatgcagtacgtcaaagtaaattaaaagaaggggaagcagtagcagtctttggttgtggtccaattggacttcttgttatccaagcagctaaagcagcaggagcaactcctgttattgcagttgaactttctaaagaacgtcaagagttagcaaaattagcaggtgcggattacgtattgaatccagcgactcaagatgtattagctgaaattcgcaacttaacaaatagtttaggtgtaaatgtaagctttgaagtaactggtgttgaagtagtacttcgtcaagcaattgaaagcacaagctttgaaggacaaactgtaattgttagtgtatgggaaaaagacgcaacaattactccaaataatcttgtactaaaagaaaaagaagtggttggtattttaggataccgtcatatcttcccagctgttattaaattaattagctctggtcaaattcaagcagagaaattaattacgaaaaaaatcacagtagatcaagttgttgaagaaggatttgaagcacttgtaaaagataaaacacaagtgaaaattcttgtttcacctaaataa

SEQ ID NO: 9767 - protein, 350 aa, Bacillus anthracis str. Ames
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNSLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 9768 - DNA, 1041 bp, Rhodopirellula baltica SH 1
  CDS (1)..(1041): transl_table=11
atgaaggcattgttgctgaccgaatacaaaaacatgcaggtgacggatgtggatgagcccgaggtgggcccagatgacgttttggtccaagtcgaagcgtgtgggatctgcggcagtgacattcatggatacgatggcagcaccgggcgtcgtatcccgcctttggtgatggggcacgaggctgccggggtggtggttcaggtcggcgaaaacgtccgcgatttggaactcggagcccgcgtcacgtttgattcgatggtgtcctgcggaaactgtgagttttgtcgcgaagggcacgggaacctttgtgacaaccgaatggttctcggcgtttcctgtggtgattaccgacgtcatggtgcgttcgcggaacgcatctcggttccgcgtcggatagtctatcgattacccgacactttgcccttcgaacacgcagctttggtcgaagcggtcagcgtcgcggtccatgcagcggaagtcactccgatcaagctaggtgataccgccgttgtggttggtgctggcatgatcggattgttggctgtgcaagccgtgcgagcagcgggtgcgacgcaggtcatcgcggtggatctaaacgacaaacgcctggaaacagccggaacgttgggagccgacgtgttgttgcgagccgatcaagtggacgtgccggaaaaggttcgcgaactgaccggtggccgcggggcagacgtggcattggaagtcgtcggtgcgacgccgacggtcaaaacagcgattgaatccgttcgcaagggtggagcggtcacgttggtcggcaacgtctcgccgacgatcgaattgcctttgcagtcagtcgttacgcgagaaattcgattgcagggcacatgtggttgcaacggtgaatacccacagtgcatcgatttgatgaatcgcggcgtcatcaacgttgaacctttgatcacggccaaaatttctttggcggacggtcccaaatggtttgaccgcctgcacgccggtgatgcggagcaaatgaaggtgttggtttgtcctcgttcggagtga

SEQ ID NO: 9769 - protein, 346 aa, Rhodopirellula baltica SH 1
MKALLLTEYKNMQVTDVDEPEVGPDDVLVQVEACGICGSDIHGYDGSTGRRIPPLVMGHEAAGVVVQVGENVRDLELGARVTFDSMVSCGNCEFCREGHGNLCDNRMVLGVSCGDYRRHGAFAERISVPRRIVYRLPDTLPFEHAALVEAVSVAVHAAEVTPIKLGDTAVVVGAGMIGLLAVQAVRAAGATQVIAVDLNDKRLETAGTLGADVLLRADQVDVPEKVRELTGGRGADVALEVVGATPTVKTAIESVRKGGAVTLVGNVSPTIELPLQSVVTREIRLQGTCGCNGEYPQCIDLMNRGVINVEPLITAKISLADGPKWFDRLHAGDAEQMKVLVCPRSE

SEQ ID NO: 9770 - DNA, 1029 bp, Photorhabdus luminescens subsp. laumondii TTO1
  CDS (1)..(1029): transl_table=11
atgaaagcattagtattagaaaaagcaggtcagatttcaattcaagactgggaaacccccgaaatattgggtgaaaatgatgttgaaataaaaattcactcggtggggatttgtggcagcgatgtgcattattatcaatacgggcgtattgggccatttattgtcgaaaagccgatgatcctcgggcacgaagcatcaggtgtcatcaccgcagtaggtaaaaatgtgactcacttaaaaatcggcgatcgtgtctgtatggaacctggcattcctaatctgcaatcaccacaatcacgggcaggtatttataacttagatccagaagtgcgtttctgggcgacgccccctattgatggttgcttacgtgaaagagttattcatccggcagcatttacgttcaaattaccggataatgtcagttttgccgaaggtgcaatggttgaaccattagctatcggtatgcaagccgccacaaaagcagaaattaaaccaggagatatcgcattagttattggtgctggcacgatcggaattgttaccgcacttgccgcattagccggtggttgttctgatgtcattatttgcgatgtgttcgatgaaaagctagaaattgcaaaacagtatccaggtcttcacccggttaatagcaaagtacttactgagaaagtgaatgcattaaccgagggtaatggcgtcaatattctctttgaatgtagtggcgcaaaaccggtcattgccactatttcagagcacattgcaccgggaggaatagctgttctagtcggtatgcctatcgatccggcaccatttgatgttgtctctgctcaagctaaagagatcacattcaaaactattttccgctacgcaaatatgtaccctcgtactattcgtttacttagctcaggtaagctcaaagtaacccctctattatccgcaacctataaatttaaagacagcgttcaggcgtatgaacgagccgcggagggtcgcccgacagatatcaaaattatgttggaaatggagtaa

SEQ ID NO: 9771 - protein, 342 aa, Photorhabdus luminescens subsp. laumondii TTO1
MKALVLEKAGQISIQDWETPEILGENDVEIKIHSVGICGSDVHYYQYGRIGPFIVEKPMILGHEASGVITAVGKNVTHLKIGDRVCMEPGIPNLQSPQSRAGIYNLDPEVRFWATPPIDGCLRERVIHPAAFTFKLPDNVSFAEGAMVEPLAIGMQAATKAEIKPGDIALVIGAGTIGIVTALAALAGGCSDVIICDVFDEKLEIAKQYPGLHPVNSKVLTEKVNALTEGNGVNILFECSGAKPVIATISEHIAPGGIAVLVGMPIDPAPFDVVSAQAKEITFKTIFRYANMYPRTIRLLSSGKLKVTPLLSATYKFKDSVQAYERAAEGRPTDIKIMLEME

SEQ ID NO: 9772 - DNA, 1092 bp, Corynebacterium diphtheriae NCTC 13129
  CDS (1)..(1092): transl_table=11
atgaaagcagcacggtactacgaccaaaaagacatccgaattgaagaaatctccgagcagccactgctgccaggcactgcccgcatcaaagtagcgtggtgtggcatttgtggcaccgacttgcacgagttcctcgaaggtccactgttcgttccagaacaccaccacccgcacccagtctccggcgaggactccccagtgaccttggggcatgaaatgtccggcgtgatcacagaagtcgccgaggacgtgaccgatctagccgttggcgaccacgtagtagtagagccctatttgattcacgatgatgtagacacctctgaagccaaccccttctaccatctttcccgcgacatgaacttcattggtcttgccggtggcggcggtggcttgagtgaaaacattgtggtcaagcggcgctggatccacaaaatctccccagacctgcctctcgacgaagcagccctcatcgaaccactgtctgtgggctatcacgcagtggaacgtgctgggttcgcctccgaagaagcagccaagggcaaggttgcacttgtcggcggtgctggacctattggcttgctcaccgcctcagtactcaaggctttcggcgccaccgtggtgatatcggaactatccccgctgcgtaggaagaaagcactcgattccggtgctgccgactacgctctcaacccagcagaagtggatgtggttgaagaaattgccaagcttaccgacggcaaaggtgccgacgtcgccttcgaatgcacctccgtccaagtagtgctggacaccctcatggatgctgttcgcccaggggctgtgatcgttgtggtgtctatctggtctaagcgctccaactttgacatccataagttggtgatgaaggagatcgacctgcgcggcacgattgcctactcccatgcgcacccgaacaccatcaagctggtggaatccggaaagattaacctcaagccgtttatcaccggaaagattgcgcttcaagacatcgtggataaaggttttgacaccctcattaaccacaatgaaacagcagtcaagatcttggtatccccatcgggcgtaggcctctag

SEQ ID NO: 9773 - protein, 363 aa, Corynebacterium diphtheriae NCTC 13129
MKAARYYDQKDIRIEEISEQPLLPGTARIKVAWCGICGTDLHEFLEGPLFVPEHHHPHPVSGEDSPVTLGHEMSGVITEVAEDVTDLAVGDHVVVEPYLIHDDVDTSEANPFYHLSRDMNFIGLAGGGGGLSENIVVKRRWIHKISPDLPLDEAALIEPLSVGYHAVERAGFASEEAAKGKVALVGGAGPIGLLTASVLKAFGATVVISELSPLRRKKALDSGAADYALNPAEVDVVEEIAKLTDGKGADVAFECTSVQVVLDTLMDAVRPGAVIVVVSIWSKRSNFDIHKLVMKEIDLRGTIAYSHAHPNTIKLVESGKINLKPFITGKIALQDIVDKGFDTLINHNETAVKILVSPSGVGL

SEQ ID NO: 9774 - DNA, 1110 bp, Rhodopseudomonas palustris CGA009
  CDS (1)..(1110): transl_table=11
atgaagacacgggccgccgtcgcgttcgaggccaagaagccgctcgaaatcgtcgagctggatctcgaagggccgaaggccggcgaggtgctggtcgagatcaaggccaccggcatctgccacaccgacgcctacacgctcgacggcttcgatagcgaaggcatcttcccgtcgatcctcggccatgaaggcgcgggcatcgtgcgcgagatcggccccggcgtcacctcggtgaagccgggcgatcacgtcattccgctgtacacgccggaatgccggcagtgcaaaagctgcctgagccagaagaccaatctctgcaccgcgatccgcgccacgcagggcaagggcctgatgccggacggcacctcgcgcttttcctacaagggccagaccatctatcactacatgggctgctcgacgttctcgaacttcaccgtgctgccggagatcgcagtcgcgaagatccgcgacgacgcgccgttcgacaagagctgctacatcggctgcggtgtcaccaccggcgtcggcgccgtggtcaacaccgccaaggtcacgcccggctccaacgtcgttgtgttcggcctcggcggcatcggcctcaacgtgatccagggcgccaagatggtcggcgccgataaaatcgtcggcgtcgacatcaacgacgacaaggaagaatggggccgccgcttcggcatgacgcacttcgtcaacccgaagaaaatcgacggcgacatcgtccagcacctcgtcgggctcaccgatggcggcgccgactacaccttcgactgcaccggcaacaccaatgtgatgcgccaggcgctggaagcctgccatcgcggctggggcgtctcggtggtgatcggcgtggcggaagccggcaaggaaatctcgacccgcccgttccagctcgtcaccggccgagtctggaagggcagcgccttcggcggcgcccgcggccgcaccgacgtgccgaagatcgtcgactggtacatgaacggcaagatcgagatcgacccgatgatcacccacgtgctgaaactcgaagagatcaacaagggtttcgacctgatgcaccagggcaagtcgatccgctcggtggtggtgtactaa

SEQ ID NO: 9775 - protein, 369 aa, Rhodopseudomonas palustris CGA009
MKTRAAVAFEAKKPLEIVELDLEGPKAGEVLVEIKATGICHTDAYTLDGFDSEGIFPSILGHEGAGIVREIGPGVTSVKPGDHVIPLYTPECRQCKSCLSQKTNLCTAIRATQGKGLMPDGTSRFSYKGQTIYHYMGCSTFSNFTVLPEIAVAKIRDDAPFDKSCYIGCGVTTGVGAVVNTAKVTPGSNVVVFGLGGIGLNVIQGAKMVGADKIVGVDINDDKEEWGRRFGMTHFVNPKKIDGDIVQHLVGLTDGGADYTFDCTGNTNVMRQALEACHRGWGVSVVIGVAEAGKEISTRPFQLVTGRVWKGSAFGGARGRTDVPKIVDWYMNGKIEIDPMITHVLKLEEINKGFDLMHQGKSIRSVVVY

SEQ ID NO: 9776 - DNA, 1053 bp, Bacillus cereus ATCC 10987
  CDS (1)..(1053): transl_table=11
atgaaagcattactttggcataatcaacgtgatgtaagagtagaagaagtaccagaaccaactgtaaaaccaggagcagttaagattaaagtgaaatggtgtggtatctgcgggacagacctgcatgaatatttagcaggacctatttttattccaaaagaagagcatccattaacacatgtaaaagcaccggttattttaggtcatgagtttagcggtgaggtagttgaaatcggtgaaggcgttacatctcataaagtgggagaccgcgtcgttgtagaaccaatttattcttgtggtaaatgtgaagcttgtaaacatggacattacaatgtttgtgaacaacttgttttccacggtcttggcggagaaggcggcggtttctctgaatatacagtagtaccagaagatatggttcaccatattccagatgaaatgacgtatgaacaaggtgcacttgtagaaccagcagctgtagcagttcatgcagtacgtcaaagtaaattaaaagaaggggaagctgtagcagtatttggttgtggtccaattggacttcttgttatccaagcagctaaagcagcaggagcaactcctgttattgcagtcgagctttctaaagaacgtcaagagttagcaaaattagcaggtgcggattacgtattaaatccagctactcaagatgtattagcagaaattcgtaacttaacaaatggtttaggtgtaaatgtgagctttgaagtaacaggtgttgaagtagtacttcgtcaagcaattgaaagtacaagtttcgaaggacaaactgtaattgttagtgtatgggaaaaagacgcaacaattactccaaacaatcttgtactaaaagaaaaagaagtggttggtattttaggataccgtcatatcttcccagctgttattaaattaattagctctggccaaattcaagcagagaaattaattacgaaaaaaatcacagtggatcaagttgttgaagaaggatttgaagcacttgtaaaagataaaacacaagtgaaaattcttgtttcacctaaataa

SEQ ID NO: 9777 - protein, 350 aa, Bacillus cereus ATCC 10987
MKALLWHNQRDVRVEEVPEPTVKPGAVKIKVKWCGICGTDLHEYLAGPIFIPKEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 9778 - DNA, 1023 bp, Bacillus cereus ATCC 10987
  CDS (1)..(1023): transl_table=11
atgaaagctgcagtgtggtatggtgaaagagatattcgtattgaggaaagagaaacgaaagaattacaacccaatgacgtaaaagttaaagtggcatgggctggtatttgtggttctgatttgcatgcatacttgcatccaggttcagtaccaataaatatgaatacggtaatgggacatgaattttctggtgaaattgcagaggttggttctcatgtaacaaaatttaaaaaaggtgacagagtatgtatctatccaatgatgcttaaagatccttcaaatgctgaaattgaacgtttcatcactttagacgcagttggtgcacaaatcgacggagggtttgctgaatatgtgatacttccacaaaaaacgatttttaaaattccagatcatttaccgctagaattagcagccatggttgaaccagcagctgtatctttccaatccattaaggattcaaatgtaagagaaggggatactgtcgttgtctatggagcgggtcctattgggctatttgctgttttaggtgcaaaagctgcaggtgcttctaatattattgttatcgatctatttgatagtcgacttgataaagcaactgaaatgggtgcaacacatgtctttaatgctaaagaagtaaatcctgttgaagaaattcggaaattattcccaggtggagcagatgttgcaattgaagctgcaggtgtcgagtcaacatttaatcaagctattcaatcaactaaagttcgtggcacaatgatggttatcagcttccacacgcaagatatccaatttaatgttcctgcttcactaatctttagtggtgcaaaattaatggggtctgtaggatacagcaatgaaacttacaatgaggttattgaattatttgctaatggaagattacccgcgcaatcaattattacaagtaaaattgatatagataatattgctgaacaaggctttgaagcgttaattcatgataaatctcaagcgaaaattttagttaaattaagtggcgcacattaa

SEQ ID NO: 9779 - protein, 340 aa, Bacillus cereus ATCC 10987
MKAAVWYGERDIRIEERETKELQPNDVKVKVAWAGICGSDLHAYLHPGSVPINMNTVMGHEFSGEIAEVGSHVTKFKKGDRVCIYPMMLKDPSNAEIERFITLDAVGAQIDGGFAEYVILPQKTIFKIPDHLPLELAAMVEPAAVSFQSIKDSNVREGDTVVVYGAGPIGLFAVLGAKAAGASNIIVIDLFDSRLDKATEMGATHVFNAKEVNPVEEIRKLFPGGADVAIEAAGVESTFNQAIQSTKVRGTMMVISFHTQDIQFNVPASLIFSGAKLMGSVGYSNETYNEVIELFANGRLPAQSIITSKIDIDNIAEQGFEALIHDKSQAKILVKLSGAH

SEQ ID NO: 9780 - DNA, 1131 bp, Magnaporthe grisea 70-15
  CDS (1)..(1131)
atggcaacaataaaagcatcagtcctctacgggccgaaagatctgcgcgtcgaggagcgcacgatcccggccccggcggcgggcgaggtgcaagtctccatccgcgcgaccggcatctgcggctccgacatgcactactacgtgcacggcgccaatggcgactttaaagtgcgcgagccgctgtccctgggccacgagtcggccggcgtggtcgaggccgtcggtcccgacgtgacggacctcaaggtgggtgaccgcgtggccgtcgaggtcggcatcgcctgcgacgactgcgcgctctgcaagtccggccgctacaacctctgcaagggcatgaagttccggtccagcgcaaagatcttcccgcacttccagggcacgctgcaggaccgcatcaaccacccggcccggctgacctacaagctgcccgactcggcctcgctggccgagggagccctgctggagcccctgggcgtcgccatccacggcgtcaagcgcgccggcgagcaaaagggcaagacggcgctggtgctcggcgccggcgcggtgggtctgctgacggcggcggtgctgcgcgtcgagggcatcgagtccatcgccatcgccgacattgtgcccgagcgcgtgcagttcgccgtcgcccacggcttcgccgacaaggccgtcgtggtgcccagcaagcgcctgccgccgacggccagcgccgacgagaagctggccctggcgcgcgagacggccgcgctgctgacccgcgagggcaacggcggcgacgagtacgacaccacctttgagtgcacgggcgtcgagtcgtgcgtgcaggcggccatctacgccacggggcccggcggccgcgtcatgatgatcggcatgggcacgcccgtgcagacgctgcctctgggggcggcggcgctgcgtgaggttgatctgttgggcgtgtttaggtatgcaaacacgtacccgcgcggcatcgagttgttggcgggtagggagagcaacggcatgccggatattggattgctggcgacgcagaacgtcaaggggttggacagggcggaggatgcgtttgcgattgcggccaagccggtggatgcggatgggaagctggtgttgaaggtgattatcgagacttga

SEQ ID NO: 9781 - protein, 376 aa, Magnaporthe grisea 70-15
MATIKASVLYGPKDLRVEERTIPAPAAGEVQVSIRATGICGSDMHYYVHGANGDFKVREPLSLGHESAGVVEAVGPDVTDLKVGDRVAVEVGIACDDCALCKSGRYNLCKGMKFRSSAKIFPHFQGTLQDRINHPARLTYKLPDSASLAEGALLEPLGVAIHGVKRAGEQKGKTALVLGAGAVGLLTAAVLRVEGIESIAIADIVPERVQFAVAHGFADKAVVVPSKRLPPTASADEKLALARETAALLTREGNGGDEYDTTFECTGVESCVQAAIYATGPGGRVMMIGMGTPVQTLPLGAAALREVDLLGVFRYANTYPRGIELLAGRESNGMPDIGLLATQNVKGLDRAEDAFAIAAKPVDADGKLVLKVIIET

SEQ ID NO: 9782 - DNA, 1086 bp, Magnaporthe grisea 70-15
  CDS (1)..(1086)
atggcgtccgcaacagagggcaaatccaacctctcatttgttctcaacaagccgcacgatgtctgcttcgaggagcgcccgatgcccaagctcgcctctgagcacgacgtcctggtcgccgtgaactacacgggtatctgcggctccgacgtccactactggcaccacggctccatcggcgactttgtcgtcaaggaccccatggtcctgggccacgagtcagccggcaccgtcgtcgaggtcggctccgccgtcaagaccctccaggtcggcgatcgcgtcgccctcgagcccggctacccctgccgtcgctgccgcgactgcctcgccggccgctacaacctctgccccgagatgcgcttcgccgccaccccgccctatgacggcaccctggccggcttctggaccgcccccgccgacttttgttacaagctgcccgagtcggtcagcctgcaggagggcgccatgatcgagccgctggccgtcggcgtgcacattgtgcgccaggccaaggtttctcccggccagagcgtcgtggtaatgggcgccggacccgtgggtctactctgcgccgccgtcgccagggcctttggagccaccacggtcgtcagcgtcgacattgtagaatccaagctcgaggttgccaagcagatcgccgccacgcacacttacctgtcgcagcgcatctcgccgcaggacaatgccaaggccctgatcgccgccgccggcctcgaggacaacggcggtgccgatgtcgtcatcgatgccaccggcgctgagccctcgatccagaccagcatccacgccgtgcgcgtcggtggctcgtacgtccagggcggtatgggcaagcccgacatcaccttccccatcctggctttctgctgcaaggaggtcacggccagcggctcgttccgctactcggccggcgattataggctcgccatcgacctggtggccaatggcaaggtcaacctcaaggccctcatcacggagacggtgccctttgacaaggcccaagaggcctttaccaaggtcagcgagggacaggtcatcaaggttttgattgctgggcccaatgagaaatag

SEQ ID NO: 9783 - protein, 361 aa, Magnaporthe grisea 70-15
MASATEGKSNLSFVLNKPHDVCFEERPMPKLASEHDVLVAVNYTGICGSDVHYWHHGSIGDFVVKDPMVLGHESAGTVVEVGSAVKTLQVGDRVALEPGYPCRRCRDCLAGRYNLCPEMRFAATPPYDGTLAGFWTAPADFCYKLPESVSLQEGAMIEPLAVGVHIVRQAKVSPGQSVVVMGAGPVGLLCAAVARAFGATTVVSVDIVESKLEVAKQIAATHTYLSQRISPQDNAKALIAAAGLEDNGGADVVIDATGAEPSIQTSIHAVRVGGSYVQGGMGKPDITFPILAFCCKEVTASGSFRYSAGDYRLAIDLVANGKVNLKALITETVPFDKAQEAFTKVSEGQVIKVLIAGPNEK

SEQ ID NO: 9784 - DNA, 1119 bp, Magnaporthe grisea 70-15
  CDS (1)..(1119)
atgagcgcaacaaacggtagcgccgcggcagcgccgtccaagaagaacatcggcgtcttcacaaaccccaaacatgatctctggatcaacgaggccgagccgagtctggagagcgtgcaaaagggtagcgatgagctcaaggagggccaggtcaccattgccatccggagcacaggaatctgcggctccgacgttcacttctggcaccacggttgcatcggccccatgattgtccgtgaagaccacatccttgggcacgaatcggcaggcgagatcattgccgtccacccttccgtcacatctctcaaggttggcgaccgcgttgcggtggagccgcaggtcatctgctacgagtgcgagccgtgcctgacaggacgctacaacggctgcgagaaggtcgacttcctgtccacgcccccggtgcctggtctgctgcgacgctacgtcaaccatccggccgtttggtgccacaagattggtgacatgagctgggaggacggcgcgatgctggagccgctgagcgtcgcgctggcgggcatccagcgcgcaggcatcaccctcggtgaccctgtgctcgtgtgtggcgcgggtcccatcggtctcatcacattgctgtgcgccaaggcggcgggtgcgtgcccgctcgtcatcaccgacatcgacgatggccgcctcaagttcgccaaggagctggtacccgacgtcatcaccttcaaggtcgagggccggccaacggccgaggacgcagccaagtctatcgtcgaggcatttggcggcgtggagccgaccctggccatagagtgcacaggtgtggagagcagcattgccagcgccatctgggcggtcaagttcggcggcaaggtgttcgtcattggagtcggccgcaacgagattagcctaccgttcatgagggcgtctgtgcgtgaggttgacctgcagttccagtaccgttattgcaacacgtggccgcgggcgatccggttgatccagaataaggtcatcgacctgaccaagcttgtcacgcaccgattcccgctggaggacgcgctcaaggcgttcgagacagcggctgatcccaagactggcgccatcaaggtacagatccagagcttggagtga

SEQ ID NO: 9785 - protein, 372 aa, Magnaporthe grisea 70-15
MSATNGSAAAAPSKKNIGVFTNPKHDLWINEAEPSLESVQKGSDELKEGQVTIAIRSTGICGSDVHFWHHGCIGPMIVREDHILGHESAGEIIAVHPSVTSLKVGDRVAVEPQVICYECEPCLTGRYNGCEKVDFLSTPPVPGLLRRYVNHPAVWCHKIGDMSWEDGAMLEPLSVALAGIQRAGITLGDPVLVCGAGPIGLITLLCAKAAGACPLVITDIDDGRLKFAKELVPDVITFKVEGRPTAEDAAKSIVEAFGGVEPTLAIECTGVESSIASAIWAVKFGGKVFVIGVGRNEISLPFMRASVREVDLQFQYRYCNTWPRAIRLIQNKVIDLTKLVTHRFPLEDALKAFETAADPKTGAIKVQIQSLE

SEQ ID NO: 9786 - DNA, 1128 bp, Gibberella zeae PH-1
  CDS (1)..(1128)
atgagtccctcagcagttgaaggtaacggagtcgtggacgtcaagacgactctaaagcccaatgttggtgtttataccaaccccaaccatgacctctgggttgctcctgctgagccctccgccgaagctgtcaagtctggttccgacttgaagcaaggtgaggtcagtgttgctatccgaagcactggtatttgcggatccgatgttcacttctggcacgctggctgtatcggtcccatgattgtcgagggcgatcacatcttgggccacgagtctgctggcgaggttattgccgtgcacccttctgtcagccatctcaaggttggcgacagagtcgccatcgagcccaacattccctgcggtacctgcgaaccctgccttactggccgatacaatggttgcgagaccgtccagttcctgtctacccctcccgtcccaggcatgctccgccgatacatcaaccaccccgctgtctggtgtcacaagattggaaacatgtcatatgagaacggcgctcttctcgagcccctcagtgttgctctggccggtatgcaaagggccgaggttcgcctgggagaccctgttctgatctgcggtgctggacctatcggattgatcacacttcagtgttgcgctgctgctggtgcttcgcccattgtcatcactgatatttcagagagccgattggcatttgccaaggagctctgccctcgcgttatcactcataaggtcgagagactatctgctgaggattctgcaaaggccattgtcaagagcttcggtggtgtcgagccaactgtcgctatggagtgcactggtgttgagagcagcatcgctgctgcggtctggtctgtcaagtttggcggcaaggtcttcatcattggtgtcggaaaaaatgagatcaacattcccttcatgcgcgcaagtgttcgggaggtagacattcagttacagtaccgatactgcaacacctggccccgagccatccgcctggtcgagaacaacgtggttgacctttctaagctggttacccacaaattcaagcttgaggacgccatcaaggcgtttgagacgtcggcggatcccaagaccggagcgatcaaggtcatgatccagagcttggaataa

SEQ ID NO: 9787 - protein, 375 aa, Gibberella zeae PH-1
MSPSAVEGNGVVDVKTTLKPNVGVYTNPNHDLWVAPAEPSAEAVKSGSDLKQGEVSVAIRSTGICGSDVHFWHAGCIGPMIVEGDHILGHESAGEVIAVHPSVSHLKVGDRVAIEPNIPCGTCEPCLTGRYNGCETVQFLSTPPVPGMLRRYINHPAVWCHKIGNMSYENGALLEPLSVALAGMQRAEVRLGDPVLICGAGPIGLITLQCCAAAGASPIVITDISESRLAFAKELCPRVITHKVERLSAEDSAKAIVKSFGGVEPTVAMECTGVESSIAAAVWSVKFGGKVFIIGVGKNEINIPFMRASVREVDIQLQYRYCNTWPRAIRLVENNVVDLSKLVTHKFKLEDAIKAFETSADPKTGAIKVMIQSLE

SEQ ID NO: 9788 - DNA, 1071 bp, Gibberella zeae PH-1
  CDS (1)..(1071)
atggctgaaacaaacccgtcttgtttactatacggccctggggatgccaggtttgaagatagaccattccctcagatcgaggacccgcacgatgtaattgtcaagattgcatacacaggtgtctgtggaagcgatgtccatttctggaccgaaggcggctttgcaagaaaagtcagtcaacagcagcctctagtgatgggtcacgaagcttcaggcataatctataaagtcggcccagcagtttcccaactcaagccgggcgaccgcgtggctatagaaccaggattcccatgcaaaagctgcaattactgcaagtccggacgatacaatctgtgccgcaagatgaagttcgctgcagaccctccattcactcacgggacactttctcgattttttaagatccccgaggactttacctacaaagtcccccactcaatcagtctcgaggaagctgttcttgtggagccgctcggtgttgctgttcatggcgttcgcctagctgatatacgacctggccagaatgtcattgtacaaggagctggaactgtcggatgtctaactgcagcaaccgcaaaggcctatggggccaagactgttgttatcacagatatcaaccctgagaagctttcctttgcgaaaggtgttgtggagtgttacacgttccagccccggctgtacgcaactcctgaacaagaagctgccagactgaagcaagaggcgggtttcgatctaggcgccgataccgtgctcgaatgcaccggggttgaaatatcagcacatactggcatcttggctctggcaccaggcggcgtttttgtgcaaatcggactgggcaaacccatacagtcgttgcctttacattctatgtgcgagaaggagatgacgatgaagacttgtttccgttacggccctggtgattttgaaattgctctcgagctgcttgaatcatgcaaggtgtccgtttcgtcgtttataagcagcattgtaccatttgagaaggcgcctgaggcgtgggttagaactatgaaaggagagggaattaagaatcttattaagggagtggaggattga

SEQ ID NO: 9789 - protein, 356 aa, Gibberella zeae PH-1
MAETNPSCLLYGPGDARFEDRPFPQIEDPHDVIVKIAYTGVCGSDVHFWTEGGFARKVSQQQPLVMGHEASGIIYKVGPAVSQLKPGDRVAIEPGFPCKSCNYCKSGRYNLCRKMKFAADPPFTHGTLSRFFKIPEDFTYKVPHSISLEEAVLVEPLGVAVHGVRLADIRPGQNVIVQGAGTVGCLTAATAKAYGAKTVVITDINPEKLSFAKGVVECYTFQPRLYATPEQEAARLKQEAGFDLGADTVLECTGVEISAHTGILALAPGGVFVQIGLGKPIQSLPLHSMCEKEMTMKTCFRYGPGDFEIALELLESCKVSVSSFISSIVPFEKAPEAWVRTMKGEGIKNLIKGVED

SEQ ID NO: 9790 - DNA, 1062 bp, Gibberella zeae PH-1
  CDS (1)..(1062)
atgtccagcaatctctccttcgtcctcaacaaaccaggtgacgtctccttcgaggaacgtcccaagccctccctcgcaagccctcacgatgtcctcgtcgccgtcaactacaccggtatctgcggttccgacgtccactactgggtccacggctccatcggcaagttcgtcgtcgaggaccccatggttctaggccacgagtccgccggaactgttgttgaggttggcgacaaggtcaagaccctcaaggctggtgatcgcgtcgctcttgagcctggatacccttgccgtcgctgccagaactgcctcgctggcaagtacaacctctgccctgatatggtctttgccgctacgccgccttatcacggtaccttgactggtttctggtctgcccccgccgacttttgcttcaagcttcccgacaatgtttctctccaagagggagccttgatcgagcctctcgccgtcgctgtccacatcgtcaagcaggcgcgcgtcaagcctggtgactctgtcgttgtcatgggcgctggtcccgtcggtcttctctgcgctgccgtcgcaaaggcctacggtgcttccaagattgtcagcgtcgacattgtccagagcaagctcgatttcgccaaggactttgcttccacacacgtgtacgcctcgcagcgcatcgcacccgaggagaacgccaagaacatctgtgatctggccggtcttcccgacggtgctgatgtagttatcgacgcgagcggtgccgagccctcaatccaagcttctatccacgtcctcaagaacggtggcagctatgtgcagggcggtatgggcaaggccgacattactttccccatcatggctttctgcatcaaggaggccaccgcgagcggatccttccgatacggcgctggcgattaccctcttgctgttgagcttgttgccaccggcaaggtggatgtcaagaagctcatcactggtatcgtcgactttaagcaggccgaggaggctttcaagaaggtcaaggagggagaagcgattaaggttcttattaagggacctaatgagcagtaa

SEQ ID NO: 9791 - protein, 353 aa, Gibberella zeae PH-1
MSSNLSFVLNKPGDVSFEERPKPSLASPHDVLVAVNYTGICGSDVHYWVHGSIGKFVVEDPMVLGHESAGTVVEVGDKVKTLKAGDRVALEPGYPCRRCQNCLAGKYNLCPDMVFAATPPYHGTLTGFWSAPADFCFKLPDNVSLQEGALIEPLAVAVHIVKQARVKPGDSVVVMGAGPVGLLCAAVAKAYGASKIVSVDIVQSKLDFAKDFASTHVYASQRIAPEENAKNICDLAGLPDGADVVIDASGAEPSIQASIHVLKNGGSYVQGGMGKADITFPIMAFCIKEATASGSFRYGAGDYPLAVELVATGKVDVKKLITGIVDFKQAEEAFKKVKEGEAIKVLIKGPNEQ

SEQ ID NO: 9792 - DNA, 1191 bp, Gibberella zeae PH-1
  CDS (1)..(1191)
atgtgttcccttgcagcctctcaaccgctaacaaacagctcaaattccacaacccaggaacacaagatcaacaattttctcgaccatgctcagaccctccaggctcctctaccaaacccctctctgcaggtaacagccgaccacaatttgaaaagagtcgacgcaccagtatatgcacctcaggctggcgaggttcttcttcacattaaggccactggtatctgcggttcagatgtacatttttggaaaacaggacgtattggatctcttgttttcgagggcgattgtatcattgggcatgaggcggctggcgtagtgatacaagttggcgaggatgttgacaacttcaagcctggcgatcgggtggctgttgagcctggcgttccttgtgggcattgtttcctctgcaaggatggtcgatacaacctctgtgaagatgtccagttctcgggtgtctacccttatgctggaactctacagcgatacaaagtccatccttctaagtggctccataagcttcctgacaatgtatccttcgctgaaggcgcccttctggagcccttgagcgttgtcctacacggcatcaactcagcccccatcaccctcggaacacccgtcgttatctgcggcgccggccccataggtcttctcgctctcgcttctgcacgagcttcgggtgcccatccacttgtcatcactgacgtggagcccaagcgattggcgtttgctaaagaaatggtccctacagtgaaaacctaccaagtcgacactactaagagcaacgaggagaatggtaaaaatgtgaggcgtttgtttggcgagacggagtatgttcagcctcgagttgtttttgaatgcacgggcattgagagcagcgtatgttcggctgctttcatggtgcgtcgtggaggtgttctcatggttgtcggtgtgggcagatccattatgaacaacctaccatttatgcacttgtcacttgctgagattcaaattcgattcatcaaccggtacaaagacacgtggcctgcgggtatcgcgtgccttgaaggaggccttgttgatgcgaagaagcttgtaacacatgtctttcctttggagcaggcacttgaaggcttgactttatcatcagaccccaaaaatggatgcatcaaggtccaaattgttgatgatacagaaaccacattcttctaa

SEQ ID NO: 9793 - protein, 396 aa, Gibberella zeae PH-1
MCSLAASQPLTNSSNSTTQEHKINNFLDHAQTLQAPLPNPSLQVTADHNLKRVDAPVYAPQAGEVLLHIKATGICGSDVHFWKTGRIGSLVFEGDCIIGHEAAGVVIQVGEDVDNFKPGDRVAVEPGVPCGHCFLCKDGRYNLCEDVQFSGVYPYAGTLQRYKVHPSKWLHKLPDNVSFAEGALLEPLSVVLHGINSAPITLGTPVVICGAGPIGLLALASARASGAHPLVITDVEPKRLAFAKEMVPTVKTYQVDTTKSNEENGKNVRRLFGETEYVQPRVVFECTGIESSVCSAAFMVRRGGVLMVVGVGRSIMNNLPFMHLSLAEIQIRFINRYKDTWPAGIACLEGGLVDAKKLVTHVFPLEQALEGLTLSSDPKNGCIKVQIVDDTETTFF

SEQ ID NO: 9794 - DNA, 1092 bp, Gibberella zeae PH-1
  CDS (1)..(1092)
atgacatcaacacaatcagtaaaggctgtccgctatcacggtcaacaagacatccgtcttgaatccgtaccagtcaaacctctagaccccactaccgttcgcattgctcccaaattttgtggaatctgcggtacagatgtccatgagtatctcggcggtaacaatctcattcccaaacccggcaccccgcacggcatcactggtgagacgtcaccacttactctgggccacgaattcagcggcatcgttgaagaagtcggcagtgaagtcacacgtcttcaaaagggtgaccgtgtttgcgtgcaacctatcatctacgacaacgagtgtcgttcatgcaagcgtggtcttcagaactgttgcgatcagaacggctttatcggtttgagtggttggggaggtggattggccgaatcaactgttgtgccacaagatgctgtcaagaagctaccggataatgtctccctcgaagttggcgctttggtcgagccgcttgctgttggatggcacgcaaccaagatttcgccctatgaagatggcaactcggctttcgttgtcggcggcggaccaattggactggctgttgtccaggccctcgtcggacgaggatgcaagaacatcatgttgactgaagtcagctccaagaggcgagagtttgccaagaagtttggtgcgcatcacgtattcgatcctacaaaggacgacgtcgtggcgatggtgaagaagttgacaggaggtctgggagcagatgttggtttcgacgctgcaggttcgcaacatgctattgatgtggcgttcgattgcttgaaggctagggcagtgttggtgaacattgctgtgtgggagaagagggcgcagttgaacatgaaccagattgtgttccgagagagatcttatgttggatgtgcaacatacgccctcggagattttgaagaagttatcgatgctctatcgaatggcaagattaaacctgagggaatgatcaccaaggtcatcaagatggacaaggttgttgaggagggcttccaaacactcatcaacgacaaggataaccacgtcaagatcttggttgatgttagcgctggagtatag

SEQ ID NO: 9795 - protein, 363 aa, Gibberella zeae PH-1
MTSTQSVKAVRYHGQQDIRLESVPVKPLDPTTVRIAPKFCGICGTDVHEYLGGNNLIPKPGTPHGITGETSPLTLGHEFSGIVEEVGSEVTRLQKGDRVCVQPIIYDNECRSCKRGLQNCCDQNGFIGLSGWGGGLAESTVVPQDAVKKLPDNVSLEVGALVEPLAVGWHATKISPYEDGNSAFVVGGGPIGLAVVQALVGRGCKNIMLTEVSSKRREFAKKFGAHHVFDPTKDDVVAMVKKLTGGLGADVGFDAAGSQHAIDVAFDCLKARAVLVNIAVWEKRAQLNMNQIVFRERSYVGCATYALGDFEEVIDALSNGKIKPEGMITKVIKMDKVVEEGFQTLINDKDNHVKILVDVSAGV

SEQ ID NO: 9796 - DNA, 1143 bp, Gibberella zeae PH-1
  CDS (1)..(1143)
atggcaactgatcgtgtcaaagcctccgtcctccacggtgagaaggacctaagactggaagagcgtgaactccccaagccttccagcaacgaagttcaagtggctgtccaatccactggtctttgcggctcagatcttcactactacaaccactttcgcaacggcgacatcatcgtgcgagaacctctgactctaggtcatgagtcggcaggcacagtcgtagccgttggttcagaagtcacacacctcaaacctggggaccacgttgcccttgaagttggtcttccttgcgagacctgcgagctctgtgatgagggccgctacaacatctgccgcggtatgaagttccgaagctcagcaaaggccaaccctcatgcccaaggaacgcttcaggagcgaattaaccaccctgccaagtggtgtcacaagatgcccgaacatgtcaccctcgatctcggtgctcttgttgagcctctatctgtcgccatgcacgctcgagaccgcgcctccctccctaaaggctcaacagttctggttctcggcgccggggccgttgggcttctagcagccgctgtcgccaaggccgaccaggcaaagacagtcataatcgccgacattctcaaggaccgcctggattttgccacaagcaatggctttgccgacgcctcagtagttgttcccatggaacgcccgcaaactatcgaggacaagctggctttcgctcaaaaggttgctgccatggtcaaggagactcaaatcgatggagaggctattggtgaggttacagctgtctacgaatgcacaggtgtcgaaacttgtgttcaaaccgccatctacgctaccaagcctggaggcaaagtcatgattatcggtatgggcactccagtactcaccatccccatgtcagctgctgcccttcgcgaagtagacatcgtgggtgtcttccgttatgccaacacatacaaggagatcattgagctcctctccaacccccctgcgaatatgcccgatgttagccgtctggtcactcaaaggtatagcggcatggacaagatcgaggaagctttcaagatggcggggaaggtgagggacgaacaaggcaaccttgtcatcaaggttgtcgtggacttcagcgaaaaatga

SEQ ID NO: 9797 - protein, 380 aa, Gibberella zeae PH-1
MATDRVKASVLHGEKDLRLEERELPKPSSNEVQVAVQSTGLCGSDLHYYNHFRNGDIIVREPLTLGHESAGTVVAVGSEVTHLKPGDHVALEVGLPCETCELCDEGRYNICRGMKFRSSAKANPHAQGTLQERINHPAKWCHKMPEHVTLDLGALVEPLSVAMHARDRASLPKGSTVLVLGAGAVGLLAAAVAKADQAKTVIIADILKDRLDFATSNGFADASVVVPMERPQTIEDKLAFAQKVAAMVKETQIDGEAIGEVTAVYECTGVETCVQTAIYATKPGGKVMIIGMGTPVLTIPMSAAALREVDIVGVFRYANTYKEIIELLSNPPANMPDVSRLVTQRYSGMDKIEEAFKMAGKVRDEQGNLVIKVVVDFSEK

SEQ ID NO: 9798 - DNA, 1287 bp, Gibberella zeae PH-1
  CDS (1)..(1287)
atggccccagttgctacgggagagaccgccccggcgcatcttcccgttggctccccaaagccgttgagcatcagtgcttctgtcttgcatggtccccgcgatctgcggatggaaactagaatcattgaggctccagcagcaggtgagcttcagattgctgtcaaagcaacaggtatctgcggctcggatgtttcctattacaagaaattcgccaatggcgacctttgcgcctgtcatccattgtccctaggtcatgaatcttccggcgaagttgttgctatcggtccacaagtgaacggcttcaaattgggagatcgagttgctctcgaggttggcgttgcttgtggaaactgcggtacttgccgcaaaggtcggtacaatctgtgcaaaaagttgcgtttcaggagtagtgccaaaacgtatcctcattaccaaggcacactgcaagagaggatcaatcatcctgccgtttggtgccacaagctcccagacaacgtttcatatgaggccgctgctcttcttgaaccattgtcggtagctattcatgcagtgaaccgcgcaagaccagagcccggctctactgctattgttatcggagccggcaccgttggattgttgactgccgcaatggctcgccaatctggctgtacctcagtgactatcactgacattgacgctggccgtgtcaactacgctgtgagccaaggattcgcaacgcacgggttcgtgacccctatctcacgtttaaattcgtccaactactcctctgggatatcgacgcctgccactggtgctttaacacctgccagcacattttcgacagcaagccgctttgatggagcaaaatccctggctgcagacatacttgcctcttcgaactcccctggctccttcatacttgaagaggatgaagatggcgtcgatgtcacatttgaatgcactggaaaagaggtttgcatgcacacaagcttgtacacaaccaaagctggtggtaaagtcatcatggtaggcatgggaactcctatacagactctccctctgtcagtggcccaccttcgtgagattgacattttgggcgtcttccgatactccaatacctatcctactggaattcgcctgttatgttcccaagctgcgaatccatctggctgtggtctgccttcactagacggcatggtgacgcatcgattcaaggggcttgacaaggcacaggctgcttttgagcttgcaacacgcaccagcgacgatgagggcaaccttgttttaaagattgtgattgaagcgtga

SEQ ID NO: 9799 - protein, 428 aa, Gibberella zeae PH-1
MAPVATGETAPAHLPVGSPKPLSISASVLHGPRDLRMETRIIEAPAAGELQIAVKATGICGSDVSYYKKFANGDLCACHPLSLGHESSGEVVAIGPQVNGFKLGDRVALEVGVACGNCGTCRKGRYNLCKKLRFRSSAKTYPHYQGTLQERINHPAVWCHKLPDNVSYEAAALLEPLSVAIHAVNRARPEPGSTAIVIGAGTVGLLTAAMARQSGCTSVTITDIDAGRVNYAVSQGFATHGFVTPISRLNSSNYSSGISTPATGALTPASTFSTASRFDGAKSLAADILASSNSPGSFILEEDEDGVDVTFECTGKEVCMHTSLYTTKAGGKVIMVGMGTPIQTLPLSVAHLREIDILGVFRYSNTYPTGIRLLCSQAANPSGCGLPSLDGMVTHRFKGLDKAQAAFELATRTSDDEGNLVLKIVIEA

SEQ ID NO: 9800 - DNA, 1065 bp, Kluyveromyces lactis NRRL Y-1140
  CDS (1)..(1065)
atgtcaggcacacaaaaggcggttgtgcttcaaaagaagggagaaattaccttcgaagatattccagctccagagatcaccgattctcattatgtcaaaattcacgtcaagaagaccggtatctgcggttcagatatacattattatacacatggttcaattggtgagttcgtggtgaagaaaccaatggttttgggtcatgaatctagtggtgtggttgttgaagttggtaaagatgtcactttagttcaagtcggcgaccgtgttgctatagaacctggcgttccaagcagatactccgatgaaactaagtctggacactataacttgtgtccacatatggcatttgccgcaactccaccatacgacggtactttagttaagtattatttagcaccagaggatttcttggtgaaattgccggatcatgtctcattcgaagaaggtgcatgcgctgagcctcttgctgttggtgttcatgcaaacagattggctgagaccagttttgggaaaaatgttgttgtttttggtgcaggtccagtgggtttggtcacaggtgccgttgctgcagcctttggtgcctctgctgtcgtttacgttgatgtctttgagaataaattagaaagatctaaggactttggtgccaccaatactattaattctacgaaatacaagtccgaagacgaattgactgaagtcatcaaatctgaattgaagggtgaacagcccgaaattgccattgattgttctggtgcagaaatttgcattagaactgccatcaaagtcttgaaggcaggtggctcctatgttcaagtaggtatgggtaaagacaatattaatttcccaattgccatgatcggtgccaaagaattacgtgttttagggtccttcagatactattttaatgactacaaaattgctgtgaagttaatttctgagggtaaagtcaacgttaagaaaatgataacccatacgttcaagtttgaggaagctattgatgcctacaactttaacttagagcatggcagcgaagttgtcaagacaatgatcgatggcccggaatag

SEQ ID NO: 9801 - protein, 354 aa, Kluyveromyces lactis NRRL Y-1140
MSGTQKAVVLQKKGEITFEDIPAPEITDSHYVKIHVKKTGICGSDIHYYTHGSIGEFVVKKPMVLGHESSGVVVEVGKDVTLVQVGDRVAIEPGVPSRYSDETKSGHYNLCPHMAFAATPPYDGTLVKYYLAPEDFLVKLPDHVSFEEGACAEPLAVGVHANRLAETSFGKNVVVFGAGPVGLVTGAVAAAFGASAVVYVDVFENKLERSKDFGATNTINSTKYKSEDELTEVIKSELKGEQPEIAIDCSGAEICIRTAIKVLKAGGSYVQVGMGKDNINFPIAMIGAKELRVLGSFRYYFNDYKIAVKLISEGKVNVKKMITHTFKFEEAIDAYNFNLEHGSEVVKTMIDGPE

SEQ ID NO: 9802 - DNA, 1092 bp, Debaryomyces hansenii CBS767
  CDS (1)..(1092)
atgacacctaacccatccttagtattaaataaaatcaacgatatttcatttgagaaatatgatgctccagaaatcacggaacctaatgatgtcattgtcgaggtcaaaaagactggtatttgcggttcagatattcactactatacccacggagcaattggtgggtttatcttgaaatctccaatggtattgggccatgaatcctcagggattgtttctgccgttggaaaaggtgttacatcgttgaaagtaggcgacaaggttgcaatcgaaccaggtgtgccatccagacacagtgacgcatacaaaggcggtcattacaatttatgccctcatatggtttttgctgccactcctaactcggaagatggaggcgtcaatcctcctggtactttatgtaaatactacaagagtcctgaagatttcttggtcaaattgccagaccatgtttctttggaattaggtgcattagttgaaccattgactgttggtgtccacgccgctaagttgggatccatcaagtttggtgatgtcgttgttgtatttggggctggtcctgttggtttgttggctgctgcagttgccaccaagtttggcgcaactaaagtcatggtggtcgatgttttcgaatcgaaattggaaatggctaaacaaattggtgttgcaactcacaccttcaaccctaagctgggaagcaataaggatttagttgctgctttcgacaacactgaaccttccgttgtaatggaatgtagtggtgcggaaccatgcattaagagtgctgttgacatcttgagagttggcggacgttatatccaaatcggtaatagtgcgaagccggtttctttcccaatgacagagtttgctactaaagaattgactttatttgggtcatttagatatggcttcaatgactacaagaccagtgtagctatcttggacgaaaattatagaaatggaaaagaaaacgcagccatcgactttgaaagcttgattactcatagatttaaattcgatgatgctattgacgcttatgaccttgttaagggtggtaatggctgtgtcaaatgtatcatcagtggtcccgaatag

SEQ ID NO: 9803 - protein, 363 aa, Debaryomyces hansenii CBS767
MTPNPSLVLNKINDISFEKYDAPEITEPNDVIVEVKKTGICGSDIHYYTHGAIGGFILKSPMVLGHESSGIVSAVGKGVTSLKVGDKVAIEPGVPSRHSDAYKGGHYNLCPHMVFAATPNSEDGGVNPPGTLCKYYKSPEDFLVKLPDHVSLELGALVEPLTVGVHAAKLGSIKFGDVVVVFGAGPVGLLAAAVATKFGATKVMVVDVFESKLEMAKQIGVATHTFNPKLGSNKDLVAAFDNTEPSVVMECSGAEPCIKSAVDILRVGGRYIQIGNSAKPVSFPMTEFATKELTLFGSFRYGFNDYKTSVAILDENYRNGKENAAIDFESLITHRFKFDDAIDAYDLVKGGNGCVKCIISGPE

SEQ ID NO: 9804 - DNA, 1074 bp, Debaryomyces hansenii CBS767
  CDS (1)..(1074)
atgacattgacttatcaaaacccgtcccttcaagttactaaagaccatagaatagaactcaaagaagcacctgttaaacctccattaaaaggtcaagttttaattcatgttagagctactggaatatgtggttcggacattcatttctggaaatctggatctattggtgatttgaaggtactagataactgtatactagggcacgaagctgcaggagacgtcgtggagattggagaaggggttacaaatgtctctgtaggagatagggttgccattgaaccaggtgtaccttgtggaaattgtttcttgtgtagtcaaggagattataatctttgtgaagatgttcaatttattggggttttcccttatcatgggtcgatgcaaagatatattactcataattcaaggtacgtttatcgtttacccgataatatgacatattcccagggtgccttagttgaaccaatatcagtcgcgtatcatggtatcgaacgagctaatttgaagctaggtgaaggggtactaattgctggtgctggcccaattggcttagtagctctacttttagcaaaagcttctggttgcactcccttatgtattacagatttaagcaaagaaaaattggaatttgccaaaactttggttcctcaagtaagaacatataaagttaatacgaagttatcaccacaagagaatgctaaggaggtcagaagtatatttggtgaccaagaatgtaatttccctcatgtcacattggaatgcacgggagttgagtcgagtataattacatgcgcttatgtcactagaagatcaggtacattaatggttattggagtgggaaaggatattattaataactttccattcatgaggttatcattagctgagattgatgtgaaattcattaacaggtaccacgattcatggccaactgttattagattactaagccacggtattattaatgctgatttgttaattacacatcggtttacattagagaacgccattgaggcactcacattatcatccgatgcttgtaatggtagcatcaaagttattattgaagattaa

SEQ ID NO: 9805 - protein, 357 aa, Debaryomyces hansenii CBS767
MTLTYQNPSLQVTKDHRIELKEAPVKPPLKGQVLIHVRATGICGSDIHFWKSGSIGDLKVLDNCILGHEAAGDVVEIGEGVTNVSVGDRVAIEPGVPCGNCFLCSQGDYNLCEDVQFIGVFPYHGSMQRYITHNSRYVYRLPDNMTYSQGALVEPISVAYHGIERANLKLGEGVLIAGAGPIGLVALLLAKASGCTPLCITDLSKEKLEFAKTLVPQVRTYKVNTKLSPQENAKEVRSIFGDQECNFPHVTLECTGVESSIITCAYVTRRSGTLMVIGVGKDIINNFPFMRLSLAEIDVKFINRYHDSWPTVIRLLSHGIINADLLITHRFTLENAIEALTLSSDACNGSIKVIIED

SEQ ID NO: 9806 - DNA, 1116 bp, Debaryomyces hansenii CBS767
  CDS (1)..(1116)
atggctccgattttgcatagctcagaatgtgagacactgcctgtctcaaacccatgtttgattgttacgccagatcataaacttatagcaggtaatgctccaattccacaatgtcaacctaatcaagttaaaatacatattaagtgtacgggtatttgtggatctgatattcatctttggaaagagggaggtatcggtgatttagtggttactgaaaatttagtgttgggtcatgaaacagccggacaggttattgaggttggtagagaagtcaccaatgatattaaagttggcgatagagttgcaatagaaccacaagctccatgtatgaaatgctacttatgtttagatggtcattataatttgtgtgaagatgtagccttcttaggagttcctcctaccaatggttccatgcaaaggtatttatgtactgatccaaactttgttcataaattgccagacaatatgtcttacgaacaaggtgccttgtcggaaattgtttccgttgctttccatggtattagaaaggctggaggattaaatccaggagaaccttgtatgattgctggatgtggaccaattggattagctaccttattactcgctgatgtttcgggggcgtatcccatagttgtatctgatatatctgacgaaagattggaatttgccaagacattagtcccttctgttatgacatacaaaaacgatacatctatatcccctaaaaagaatgctaaaaatatccggaaaatgtttggaactactgaatatgtcatgcctcctgttgttttagagtgcactggttttgcttcttccattaattcgtgttgctatgtagtcagaagaaatggagttttgacaattttgggtgtttcggggaaaaatgaattggatggatttccctttatgccattatctctaggcgaggttgatgttaggttcattaatagatatactgatacctggcctgccgtgattaatttgataagttcgggcaaaattaatgttgacaagtttgtcactcatgtatttcaattagaagaagccgctaaagcattagaatgtgttgttgatcgaaatgtgccaactattaaagttatgattaaggacgattga

SEQ ID NO: 9807 - protein, 371 aa, Debaryomyces hansenii CBS767
MAPILHSSECETLPVSNPCLIVTPDHKLIAGNAPIPQCQPNQVKIHIKCTGICGSDIHLWKEGGIGDLVVTENLVLGHETAGQVIEVGREVTNDIKVGDRVAIEPQAPCMKCYLCLDGHYNLCEDVAFLGVPPTNGSMQRYLCTDPNFVHKLPDNMSYEQGALSEIVSVAFHGIRKAGGLNPGEPCMIAGCGPIGLATLLLADVSGAYPIVVSDISDERLEFAKTLVPSVMTYKNDTSISPKKNAKNIRKMFGTTEYVMPPVVLECTGFASSINSCCYVVRRNGVLTILGVSGKNELDGFPFMPLSLGEVDVRFINRYTDTWPAVINLISSGKINVDKFVTHVFQLEEAAKALECVVDRNVPTIKVMIKDD

SEQ ID NO: 9808 - DNA, 1059 bp, Debaryomyces hansenii CBS767
  CDS (1)..(1059)
atgaccaccaaacaaaatattggggttttcacaaatccaaaacacgaactttacgtcacagaaattgatactccacaagctgcggatcttacagaggatgaagtattagtccatgtcaaatgtacaggtatctgtggttcagacattcactttcaaaagcatggatgtataggaccaactatggtggtcgagggcgaacatatattagggcacgaatcgtctggggaaattttggctgtgggtaacaaagttaccaatttaaaaacaggtgacaaggttgctcttgaaccgggtgttccatgcaaatcttgtaaggcctgcttaaccggtaaatataatggatgcgagaaagtgttgttctcctctactccccctgtggcagggtttttgagaagatacatcaagcatccagctcaattttgtcacaagatcaattctctcacctatcagcaaggtgctctcttggaacctctctcagttctgtactgtggagtgagacatattggacttcaattaggacaatcagtacttgtatgtggggcaggtcctattggttatgtaacggcaaaatgtgcggaactggctggagcgttcccaatcgttgtaactgatattgaacagtctaaacttgactttattaaaaaggaaatcccaagcgtcaccactgttcttgttactggctctttacaagaaaacttaaaaaaggtagcatctgcgacagagagcttcgatgttgccattgattgcacaggtgtagagccatcactcgagcttgcaacacatgcccttgatttcggcggaaaattacatatcatcggggttggtagagagttccaaaaattcccttttatgatcttgtctgttaaggaaattcatgtaactttccaatatagatatgccaacacctggcctactgttgtaaagttgatgcaagcaggcatcattaatttagacaaattgattacccattcatttgcattagaggatgccgaagaggcctttaagttagcagctgaccccaagtcaggggcgatgaaaattattatcgaagatgcataa

SEQ ID NO: 9809 - protein, 352 aa, Debaryomyces hansenii CBS767
MTTKQNIGVFTNPKHELYVTEIDTPQAADLTEDEVLVHVKCTGICGSDIHFQKHGCIGPTMVVEGEHILGHESSGEILAVGNKVTNLKTGDKVALEPGVPCKSCKACLTGKYNGCEKVLFSSTPPVAGFLRRYIKHPAQFCHKINSLTYQQGALLEPLSVLYCGVRHIGLQLGQSVLVCGAGPIGYVTAKCAELAGAFPIVVTDIEQSKLDFIKKEIPSVTTVLVTGSLQENLKKVASATESFDVAIDCTGVEPSLELATHALDFGGKLHIIGVGREFQKFPFMILSVKEIHVTFQYRYANTWPTVVKLMQAGIINLDKLITHSFALEDAEEAFKLAADPKSGAMKIIIEDA

SEQ ID NO: 9810 - DNA, 1062 bp, Debaryomyces hansenii CBS767
  CDS (1)..(1062)
atggctactaaacaaaatattggagttttcacaaaccctaaacacgacctttacgtttcagaaattgagacacctgatgttggagatctttccgaagaggaagtattggtccatgttagaagcacaggaatctgcggatcggatgttcactttcagaagcatggttgcataggaccaaccatggtcgttgaggacgaacacattttgggacacgaatcggcaggagaagttttggctgttggcaacaaagttaaaattttgaaagtaggagacaaggttgctcttgagccaggtgttccatgtcacacttgcaaaccatgtttgacagggaaatacaatggatgtgagaatgtagaattttattctacacctcctgttcacggctttttaagaagatatatcaagcatccagctgctttttgccacaagatcaatttacttacttatgcgcaaggtgcacttttggagcctctttcagttgtgttttgtggaattagacatatcaatcttatattaggtcaatcagtcctcgtttttggcgctggtcctattggatttgcaactgcaaaggcagctgaagcagctggagcataccctatcatggtcactgatatagaacaatcgaagctagattttatcaagaaggaaattccaagtgctatcactgcacttgttaatggatctttaaaagaaaacgtagcaaaagtaacggacgatggtataaacaattttgatgttgcaatcgagtgcactggtgtggagcaatcgcttgagcttgcaactcacgcccttgattttggtgcaaaattacatatcattggtgtcggaaaagatcatcaaaagttccctttcatgctcttgtctgtgaaggaaatcaatattacatttcaatacagatatgccaacacatggccaaccatcatcaaattggtagaagcaggcattattaagttagataacttagtaactcataggttcaagctcgaagatgctgttgacgctttcaagcttgccggaaatccaaaatctggagcaatgaaaatccttattgaagattcctaa

SEQ ID NO: 9811 - protein, 353 aa, Debaryomyces hansenii CBS767
MATKQNIGVFTNPKHDLYVSEIETPDVGDLSEEEVLVHVRSTGICGSDVHFQKHGCIGPTMVVEDEHILGHESAGEVLAVGNKVKILKVGDKVALEPGVPCHTCKPCLTGKYNGCENVEFYSTPPVHGFLRRYIKHPAAFCHKINLLTYAQGALLEPLSVVFCGIRHINLILGQSVLVFGAGPIGFATAKAAEAAGAYPIMVTDIEQSKLDFIKKEIPSAITALVNGSLKENVAKVTDDGINNFDVAIECTGVEQSLELATHALDFGAKLHIIGVGKDHQKFPFMLLSVKEINITFQYRYANTWPTIIKLVEAGIIKLDNLVTHRFKLEDAVDAFKLAGNPKSGAMKILIEDS

SEQ ID NO: 9812 - DNA, 1143 bp, Debaryomyces hansenii CBS767
  CDS (1)..(1143)
atgtcagactctaccactggtaaaactattatatgtaaggctgcaattgcctgggaagcaggtaagccattaactattgaagatattgaagttgctccaccaaaggcccacgaagttcgtatcaaaattttgcacaccggtgtttgtcacactgatgcttacacattgagtggtgttgacccagaaggtgctttcccagttgttttgggacacgaaggtgccggaattgtggaaagtgttggtgaaggggttgacaatgtcaaggtaggtgatagtgttgttgctttatacactcctgaatgtaaggaatgtaagttctgtaagtcaggaaagaccaacttatgtggtaagatcagatccacccaaggtaagggtgttatgcctgatggcacttcaagatttaagtgcaagggtaaggagttgttgcacttcatgggatgttcgactttctcccaatacacggtcgtagctgacatctcagttgttgctgttaatccaaaggctcagccagacaagacctgtttgttgggttgtggtattacaactggttatggtgctgctaccatcactgcgaatgttggcgagggtgacaacattgctgttttcggtgctggatgtgttggtttatcggttgttcagggtgcccttcaaagaaaggcagcaaagattatagtcgttgatatcaatgactccaagaaagaatgggctgaaaaattcggtgccactgactttgtaaactctgccaaattacctagcgacaccaccattgtcgacaaattagtcgaaatgaccgatggtggctgtgacttcactttcgactgtactggtaacgtcaacgtcatgagaaatgccttagaagcgtgccataaaggttggggtacctctgtcgttatcggagttgctgctgctggtaaagaaatctccaccagacctttccaattggtcaccggtagagtatggaagggtgctgcattcggtggtgtcaagggcagatctcaattgccagacatagtcgaaaactacatgaatggcggtttgaaggttgacgaattcatcactcacagacacgagttagagaatatcaacaccgcgtttgatgatatgcatgctggtgactgtatcagagctgttattaacatgtaa

SEQ ID NO: 9813 - protein, 380 aa, Debaryomyces hansenii CBS767
MSDSTTGKTIICKAAIAWEAGKPLTIEDIEVAPPKAHEVRIKILHTGVCHTDAYTLSGVDPEGAFPVVLGHEGAGIVESVGEGVDNVKVGDSVVALYTPECKECKFCKSGKTNLCGKIRSTQGKGVMPDGTSRFKCKGKELLHFMGCSTFSQYTVVADISVVAVNPKAQPDKTCLLGCGITTGYGAATITANVGEGDNIAVFGAGCVGLSVVQGALQRKAAKIIVVDINDSKKEWAEKFGATDFVNSAKLPSDTTIVDKLVEMTDGGCDFTFDCTGNVNVMRNALEACHKGWGTSVVIGVAAAGKEISTRPFQLVTGRVWKGAAFGGVKGRSQLPDIVENYMNGGLKVDEFITHRHELENINTAFDDMHAGDCIRAVINM

SEQ ID NO: 9814 - DNA, 1074 bp, Yarrowia lipolytica CLIB122
  CDS (1)..(1074)
atgtcttctaacccgtcatttgttcttcgaaagccattggatctcgtctttgaggatcggcccgaccccaagatccaggacccccactccgtcaaggtggcagtcaaaaagaccggagtttgcggctcggatgtccactactatctgcatggaggaatcggcgacttcattgtcaaggctcccatggttctaggccatgaaagtgccggagaggtggttgaggttggtcctgaagtcaaggacctcaaggtgggagatcgagtggctctcgagcccggagtgccgtctcgattgtcacaggagtacaaggagggacgatacaacctgtgtccttgcatggtgtttgctgccacccctccctacgacggtactctgtgtcgtcactacatcattcccgaggacttttgtgtcaagctgcctgatcatgtgtctctcgaggagggagctcttgtggagcctctgtccgtggctgtccactgcaacaagctggccaagaccactgcccaggacgtggttattgtgtttggagctggcccagtcggactgctagccgtgggagtggccaatgcctttggatcatctaccattgtgtgtgttgatcttgttcccgagaagctggagctcgccaagaagttcggtgccactcatacgtttgtacccactaagggagacagtcccaacgagtctgctgacaagatccgagctctgatcaagggcgctggtctctctgactcgcccaatgtggctttggagtgcaccggagctgagccttctattcagactgctgtttctgtgctggccacttccggtcgacttgtgcaggtcggcatgggcaaggatgacgtcaacttccctatcaccaaatgcattgtaaaggagattaccgtgctcggatcgttccgatactgccatggtgactatcccctggctgttcagctggttgcttctggcaagattgacgtcaagaagctggtgaccaaccggttcaccttcaaggaggctgagcaggcgtacaagacggcggccgagggcaaggccatcaagatcatcattgacggtcccgaggaggagtag

SEQ ID NO: 9815 - protein, 357 aa, Yarrowia lipolytica CLIB122
MSSNPSFVLRKPLDLVFEDRPDPKIQDPHSVKVAVKKTGVCGSDVHYYLHGGIGDFIVKAPMVLGHESAGEVVEVGPEVKDLKVGDRVALEPGVPSRLSQEYKEGRYNLCPCMVFAATPPYDGTLCRHYIIPEDFCVKLPDHVSLEEGALVEPLSVAVHCNKLAKTTAQDVVIVFGAGPVGLLAVGVANAFGSSTIVCVDLVPEKLELAKKFGATHTFVPTKGDSPNESADKIRALIKGAGLSDSPNVALECTGAEPSIQTAVSVLATSGRLVQVGMGKDDVNFPITKCIVKEITVLGSFRYCHGDYPLAVQLVASGKIDVKKLVTNRFTFKEAEQAYKTAAEGKAIKIIIDGPEEE

SEQ ID NO: 9816 - DNA, 1146 bp, Yarrowia lipolytica CLIB122
  CDS (1)..(1146)
atgtctaccgaaggaaagaccatcacttgcaaggccgccgttgcctgggaggccggcaagcccctgacccttgaagacgtcgaggttgctcctccccaggcccacgaggttcgagtcaaggtcacctacactggtgtctgccacaccgacgcctacactctcagtggctctgatcccgagggaatcttcccctctgttctgggccacgagggtgccggtatcgtcgagtctatcggcgagggcgtcaccagcgtcaagcccggagactccgtcattctgctctacactgccgagtgcaaggagtgcaagttctgcaagtccggcaagaccaacctgtgccagaaggtgcgagccacccagggtaagggtgttctgccagacggaaccacccggttcaagtgcaagggcaaggatctctattcgtatatgggctgctcttccttctcccagtacactgtggttgctgacgtctccctcgtcgccgtcgacccctctgctccccaggaccgaacctgtctgctcggctgcggtgtcaccaccggctacggagctgccaccgtcaccgccaatgtccagaagggcgacaatgttgctgtcttcggcgctggctgtgtcggtctggccgtcgtgatgggcgccaaggagcgaggagccgccaagatcattgtcattgacatcaatggcaacaaggaggcttgggcttacaagtttggtgccactgactttgtcaaccccaccaagctacccgagggcaccactattgttgacaagctggtggagatgaccgacggaggttgcgacttcacctttgactgtaccggaaacgtgactgtcatgcgacaggctctggaggcctgccataagggctggggtgagtcgatcatcatcggcgttgctgctgctggccaggagattgccacccgacctttccagctcgtcaccggccgagtgtggaagggctctgcctttggcggtgtcaagggccgaacgcagctgcccgagattgtcaagcgatacaaggacggctctttcgagattgacaacttcatcacccactccaagcccctcaaggacatcaactctgccttcaccgacctgcacaagggcgactgcattcgaaccgtcgtcgacatgtggcaggtttag

SEQ ID NO: 9817 - protein, 381 aa, Yarrowia lipolytica CLIB122
MSTEGKTITCKAAVAWEAGKPLTLEDVEVAPPQAHEVRVKVTYTGVCHTDAYTLSGSDPEGIFPSVLGHEGAGIVESIGEGVTSVKPGDSVILLYTAECKECKFCKSGKTNLCQKVRATQGKGVLPDGTTRFKCKGKDLYSYMGCSSFSQYTVVADVSLVAVDPSAPQDRTCLLGCGVTTGYGAATVTANVQKGDNVAVFGAGCVGLAVVMGAKERGAAKIIVIDINGNKEAWAYKFGATDFVNPTKLPEGTTIVDKLVEMTDGGCDFTFDCTGNVTVMRQALEACHKGWGESIIIGVAAAGQEIATRPFQLVTGRVWKGSAFGGVKGRTQLPEIVKRYKDGSFEIDNFITHSKPLKDINSAFTDLHKGDCIRTVVDMWQV

SEQ ID NO: 9818 - DNA, 1176 bp, Aspergillus nidulans FGSC A4
  CDS (1)..(1176)
atgtctagcactctcgaaattgcgacagacaacgaaaacatgccgctcatgaaagcgctccagttccatggccccagggacgtaagggtcgaacagattgaagagcctgtctgcggaaagggccaggtgaagctgcgaaacacatactgcgggatctgcggcagcgacctccatgagtatacctccggacccgtcttaataccgaagggagcacatagcatcaccaaagctaccgcgccggttgtcatgggtcacgagtttggtggagtcgtcgaggaagtgggagaaggcatcacacacctcaagccgggacagaaggcggttgtgcgcccgaccatattcgacaggaagtgccccccatgcaaaattggctacgagtattgctgcgagaatattggcttcatcggactatctggtatgctctttttcagaatcaagcaagctgtacgatctggacaagctaacgtcccaatgcgaacaggttacggcggtggttttgccgagaaaatagtcgcgcctgcagaacacttctaccccattcctgataatgttacgccggaatccatggccatgatcgaaccactggcggtcgcatggcacgccgtcaacttgtcgccattcaaggagggtgacaatgtcttggtcgtcgggggcggtcctcttggtctatgcatcctgcaagtgctgaagatgcgaggcgccaacttcacgatcattgctgaattgacagaaacccgaaagaagtctgcgaaatactttggcgccacgcatatcctcgatcctagggaagtcgacatcccagacaatgtccgcgggttgaccgacggcgtcggcgcggatgtggtcttcgacacagcgggcgtggagaaggcgcttgacggagccattggtgcctgccgcgtccatggtacgatcgttaatgtcgctgtgtgggagaagaaaccgcagatcaaggtcaacgagatgatgtaccacgaggtgaaatatcttggctcggcattatacgatgagaagtcatttcaagacactatcgacgctatctcgaagggcctactgaaaccggagtccatgattacggataaaattaaactggaagatgtggtggagaagggattcaagacgctgctgcaggacaggaatacgcactgcaagatccttgtcgatccacagatatga

SEQ ID NO: 9819 - protein, 391 aa, Aspergillus nidulans FGSC A4
MSSTLEIATDNENMPLMKALQFHGPRDVRVEQIEEPVCGKGQVKLRNTYCGICGSDLHEYTSGPVLIPKGAHSITKATAPVVMGHEFGGVVEEVGEGITHLKPGQKAVVRPTIFDRKCPPCKIGYEYCCENIGFIGLSGMLFFRIKQAVRSGQANVPMRTGYGGGFAEKIVAPAEHFYPIPDNVTPESMAMIEPLAVAWHAVNLSPFKEGDNVLVVGGGPLGLCILQVLKMRGANFTIIAELTETRKKSAKYFGATHILDPREVDIPDNVRGLTDGVGADVVFDTAGVEKALDGAIGACRVHGTIVNVAVWEKKPQIKVNEMMYHEVKYLGSALYDEKSFQDTIDAISKGLLKPESMITDKIKLEDVVEKGFKTLLQDRNTHCKILVDPQI

SEQ ID NO: 9820 - DNA, 1203 bp, Aspergillus nidulans FGSC A4
  CDS (1)..(1203)
atggccacctgtcaagccctcgtcctccacggcgcaaaagacctccgcttggaacccagaccggtctcgtctcccagtgacggagaagttcagatcgccattcgctcaacaggtatttgcggctcagacctgcactactacagccacggccgcaatggtgacttcgttgttcgcgagcccatgtgtcttggccacgaatcttccggcatcgtcacagccatcggccccaatgtacacaacctgaaagtcggtgatcgcgtcgccctcgaagtcggtcttccctgccgcaaatgcgccctctgtttgtcgaacccaagccgctacaacctctgtccggagatgaagttccgcagctcagcgaagatattcccccatctggacggcacgctcatgcaactcaccacccaccctgagaacatgtgccataagcttcctgatactgtttcgtacgctggtggtgcgctcgtagagccgttggccgtctgtttacacgctatccgccgctcgaacccccctgctcaatcctccctcccaccaaactacaaaagcacagccctcatcttcggtgcaggcgcaatcggtctgctcctcgccggagccctcgcagcccaagagacattcgcgcacatcgtcattgcagacatcgatgactcacgcctgaaaatcgcatcaaccatgtctctccccaacctttccaccttccagattcctaagccctcgacaccgcctcccccgcgcgacgccccgcacgccgaacaaaccgcctttgccctatcaaacgcgcaagccacggcctcttcactcaaatccgccatttcatcccttgacccctccggtctgggcttcactcgcgtttatgactgcacgggtgtgcccgcttgcgttcagaccgggatttacgccgcctcgccgggttcagtcctcgtacagattggcatggggaaccccgtgcagacgttgccggttggcgcagcggcattgcgtgaagtcgatatcattggagtgttccggtacgatggacatgcgtatccggccgcaattgagctgatggcgagtgggaagatggatgttgttgaaaagtctgttgtgacgcatcggcttgggttgcaggatgggatcagagcgtttgacattgctgggaagggtgttgatgagggaggcaggccagttgttaaggttcttattgaaagcgagtccccctaa

SEQ ID NO: 9821 - protein, 400 aa, Aspergillus nidulans FGSC A4
MATCQALVLHGAKDLRLEPRPVSSPSDGEVQIAIRSTGICGSDLHYYSHGRNGDFVVREPMCLGHESSGIVTAIGPNVHNLKVGDRVALEVGLPCRKCALCLSNPSRYNLCPEMKFRSSAKIFPHLDGTLMQLTTHPENMCHKLPDTVSYAGGALVEPLAVCLHAIRRSNPPAQSSLPPNYKSTALIFGAGAIGLLLAGALAAQETFAHIVIADIDDSRLKIASTMSLPNLSTFQIPKPSTPPPPRDAPHAEQTAFALSNAQATASSLKSAISSLDPSGLGFTRVYDCTGVPACVQTGIYAASPGSVLVQIGMGNPVQTLPVGAAALREVDIIGVFRYDGHAYPAAIELMASGKMDVVEKSVVTHRLGLQDGIRAFDIAGKGVDEGGRPVVKVLIESESP

SEQ ID NO: 9822 - DNA, 1161 bp, Aspergillus nidulans FGSC A4
  CDS (1)..(1161)
atggctaccgcgaccgttctcgagaagcccaacattggggttttcaccaaccccaaacatgacctgtgggtggccgagtccaagccgaccctcgaagaggtgaagagtggtgaaagcctcaagcctggagaagtgaccatcgaagtgcgcagtaccggaatctgcggatccgacgtgcacttttggcatgcaggatgcattggtcccatgatcgtcacgggggaccatattctaggtcacgagtcggctggagacgttatcgcggtcgcgccggatgttacttcactcaaagttggagatcgagttgcgatcgaacccaacgttatttgcaatgcatgcgagccatgcctgactggtcgctacaacggctgtgagaaagtcgccttcctgtcgacaccaccagtggatggcctgctgcgacgttacgtcaatcaccccgcagtttggtgccacaagattggcgatatgagctatgaggatggtgctttgttggaacctctcagtgtgtcactagctgccgtcgagcgcagcggtctccgtctaggcgacccttgtctgatcactggcgccggtcctatcggtctcatcaccctgctcagcgcgcgcgctgcgggtgcaactccactggtcatcactgatatcgatgaaggtcgcttgaagttcgctaaagaactcgtgcctgaggtccgcacctacaaggtggagatcggtttctccgccgaagagactgcagagggtatcatcaatgcgttcaacgacggtcagggagccggccccgatgctttgaggccccgtatcgcccttgagtgcactggagttgaaagcagtgttgcatctgccatctggagcgtcaaattcggcggcaaggtgttcgtgattggagtcggcaagaatgagatgaagattccatttatgcgcctgagcactcaggagattgatctccagtaccaataccggtactgcaacacctggccccgagccatccgtctcgtaaagaatggtgtgatcaaccttcagaagctagttacccaccgctacgcactggaagacgcgctcaaggcttttgagacggcggcaaaccccaagacaggagccattaaggtccagattatgagttcgactgctgacgtcgaagctgcctccgctggtcagaaaaattaa

SEQ ID NO: 9823 - protein, 386 aa, Aspergillus nidulans FGSC A4
MATATVLEKPNIGVFTNPKHDLWVAESKPTLEEVKSGESLKPGEVTIEVRSTGICGSDVHFWHAGCIGPMIVTGDHILGHESAGDVIAVAPDVTSLKVGDRVAIEPNVICNACEPCLTGRYNGCEKVAFLSTPPVDGLLRRYVNHPAVWCHKIGDMSYEDGALLEPLSVSLAAVERSGLRLGDPCLITGAGPIGLITLLSARAAGATPLVITDIDEGRLKFAKELVPEVRTYKVEIGFSAEETAEGIINAFNDGQGAGPDALRPRIALECTGVESSVASAIWSVKFGGKVFVIGVGKNEMKIPFMRLSTQEIDLQYQYRYCNTWPRAIRLVKNGVINLQKLVTHRYALEDALKAFETAANPKTGAIKVQIMSSTADVEAASAGQKN

SEQ ID NO: 9824 - DNA, 1122 bp, Aspergillus nidulans FGSC A4
  CDS (1)..(1122)
atgactatcccattatacgaccagctgctaagtcatcaggctgtaaatgaggcctttgtcctctatcccggaggctccttcggctatgaaaaacgggatataccaactctacaggcagaacgcgatgtgctcgttcgcgtggtagcgactggactctgtggatcagatgtacactactggcaacatggacggatcggacgatatgtcgtcgaggaccccattgtccttggtcatgagtcttcaggcattgtagtgcaatgtggaagccaatcgggattgacggtgggcgatcgcgtcgtgctcgaaccaggtatcgcctgcaacacttgccatttttgccgcgccggtcgctacaacctctgccgggaaatgcgcttcgcagcaactccgccatacaacggcactctggcgacgtattacagagtacccgcagaatgctgctacaagctgccgtcacatgtatcgctacgggacggggctttgatagaacctctcagtgttgctgtacatagttgccgactggctggcgatatgcaggaaaagtcagtggttgtatttggagcaggcccggtcgggttactctgtgcgggtgttgcgcgtgcctttggagcatcgacggtagtcgtggtggacgtggtaatgagtcggctccaatctgccgtgaagtacggcgccactcacacacaccaggcaacctcggagtccgcagaagaaaatgctattgccatcttgggcaccgcgggattggggctaggcgcagacatcgttctcgatgccaccggtgctgaaccttgtatgaacagcggcattcacgcattagcacctggaggaacgtttgtgcaggtgggcttggggcgcccaaatccttccctgccggtaggccagatctgcgacaaagaaattgtcttcaagggcagtttccgatatggcccaggagattataagaccgcgatcggtcttgtgagctcccaccgcatcaggcttgaaggtctcgtcacccacgaattttctttctcccaggcggaggaggctttccataatgtcgccagtcgcgcaggagtcaaaagcgtcatttacggaccaggggtagacgagcacgtggccagagccacattatcatag

SEQ ID NO: 9825 - protein, 373 aa, Aspergillus nidulans FGSC A4
MTIPLYDQLLSHQAVNEAFVLYPGGSFGYEKRDIPTLQAERDVLVRVVATGLCGSDVHYWQHGRIGRYVVEDPIVLGHESSGIVVQCGSQSGLTVGDRVVLEPGIACNTCHFCRAGRYNLCREMRFAATPPYNGTLATYYRVPAECCYKLPSHVSLRDGALIEPLSVAVHSCRLAGDMQEKSVVVFGAGPVGLLCAGVARAFGASTVVVVDVVMSRLQSAVKYGATHTHQATSESAEENAIAILGTAGLGLGADIVLDATGAEPCMNSGIHALAPGGTFVQVGLGRPNPSLPVGQICDKEIVFKGSFRYGPGDYKTAIGLVSSHRIRLEGLVTHEFSFSQAEEAFHNVASRAGVKSVIYGPGVDEHVARATLS

SEQ ID NO: 9826 - DNA, 1284 bp, Aspergillus nidulans FGSC A4
  CDS (1)..(1284)
atggagatccttcaaaagaagcccaagaatatcgccatccatacaagtcccgtccacgatctccgggtggtcgactgtgagatcccccggcttgctcccgacgggtgcctgatccatgtccgtgcaactggtatctgcggctcagacgtgcatttctggaaacatggccgtattggccctatggtcgtgacgggggataatggcctggggcacgagagtgccggagtcgtcctgcaggtgggcgacgcggtcacccgatttaagcctggcaagtaccacgcctgcccagacgtcgtcttcttttcgacgcctccccaccacggcactctgcgacggtaccacgcccacccagaggcctggctgcatcgtctccccgaccacgtctcctttgaagagggcgcccttctcgagccgctaacggttgccctggctggcattgaccggtccgggctgcgtctggccgacccgctggtcatctgtggtgccgggccaatcggcctcgtcaccctcctggcggccaatgcagccggggcagcaccaattgtcatcaccgatatcgacagcaaccgtctcgccaaggccaaagagctcgtgccgcgcgtgcagccggtgctggtccagaaacaggagtctccacaagagctggctgggcgtatcgtccagcggctcggacaggaggcgcgactggttcttgaatgcactggggtggagagcagtgttcatgcagggatctatgcaacccggttcggaggcacggtgttcgtcatccgcgtcggcaaggacttccagaatatccccttcatgcacatgtcggccaaggagatcgacctgcggttccagtaccgctatcatgacatctaccccaaggcaatcagcctggtcaacgcggggctcgtcgacctgaagccgttagtgtctcaccgatacaagctggaggacggccttgaagcgtttgctaccgcaagcaatacagctgccaaggccatcaagttaggcactagctctagggagccatattccggcatctgccccaaggatgaggtcgtgcctaccgttttgaccaagcctgggactcgtttccttagagactgcacaacgcacattgcgcttcacggttcgtccccatcttcaaacgtctatggcaaacccggaattgaatgtttacggagaagtgccgagcatacaagagaacagcagtggaccttgcaattcgacggctgttcctctttggcttcaagtggatcaggggaacgactaggacaggccagaccagagccagtatag

SEQ ID NO: 9827 - protein, 427 aa, Aspergillus nidulans FGSC A4
MEILQKKPKNIAIHTSPVHDLRVVDCEIPRLAPDGCLIHVRATGICGSDVHFWKHGRIGPMVVTGDNGLGHESAGVVLQVGDAVTRFKPGKYHACPDVVFFSTPPHHGTLRRYHAHPEAWLHRLPDHVSFEEGALLEPLTVALAGIDRSGLRLADPLVICGAGPIGLVTLLAANAAGAAPIVITDIDSNRLAKAKELVPRVQPVLVQKQESPQELAGRIVQRLGQEARLVLECTGVESSVHAGIYATRFGGTVFVIRVGKDFQNIPFMHMSAKEIDLRFQYRYHDIYPKAISLVNAGLVDLKPLVSHRYKLEDGLEAFATASNTAAKAIKLGTSSREPYSGICPKDEVVPTVLTKPGTRFLRDCTTHIALHGSSPSSNVYGKPGIECLRRSAEHTREQQWTLQFDGCSSLASSGSGERLGQARPEPV

SEQ ID NO: 9828 - DNA, 1092 bp, Aspergillus nidulans FGSC A4
  CDS (1)..(1092)
atgccctacctcgcgaatccctctctccaggtcaccgccgaccaccagatcaagctcgtcgaagcccctgttcacgagccgggcaagggcgaggtcctcgttcatatcaaagcgacgggagtctgcggctcagacattcatttctggaaaaccggtcgcatcggcgagctgatcttccacggcgactgcatcatcggccatgaagcggcgggcgttgtcctgaaatgcggagagggtgtcacagatctgcaaccaggcgaccgcgtcgccatcgaaccaggcgtcccctgcgaaaactgcttcctttgcgacgagggacggtacaatctctgtgaggacgtcgcattcgccggggtctacccttatgcaggcacaatccaacgctacaaagtccacccggccaaatggctacataaactcccccctagcctgtcctacctcgacggcgccctcctcgaacccctcagtgtcgtcatgcgcggtattcaagttgcgcaactcgaactcggccgcggcgtcgtcatctgcggcgccgggcctatcggcctgatcgcggccgcagcagcgcgcgcatcaggcgcccacccggtcgtaatcacagacatcgatcccagccgtctgtccttcgcaaggcggtttctccctaccatccagacataccagaacaatccgacactcgacgcacaagggaacgccaaagcaatccgcgcgttatttggagacaacgagtacaatgccccagaccgggtcctcgaatgcaccggcgtcgaaagcagcatctgcacagcggcgtacacggctcggagaggcggtcttgttgttgtcgttggtgtcggcaaggaaatcatcaacaatgtcccgtttatgcatctgtccctcgcagagatcgatctcaagttcatcaaccgctatcgcgatacatggccgcgcgcaatttcgtgcatggctgccggaatcataacggatctgaagccgttaatcagccatacgtttccgctggaacgagcggacgaggcgctcgagctgtgtgctgacatggggcggccaagcattaaagtaacgattgtggatgagggcgatgcgacggtgtag

SEQ ID NO: 9829 - protein, 363 aa, Aspergillus nidulans FGSC A4
MPYLANPSLQVTADHQIKLVEAPVHEPGKGEVLVHIKATGVCGSDIHFWKTGRIGELIFHGDCIIGHEAAGVVLKCGEGVTDLQPGDRVAIEPGVPCENCFLCDEGRYNLCEDVAFAGVYPYAGTIQRYKVHPAKWLHKLPPSLSYLDGALLEPLSVVMRGIQVAQLELGRGVVICGAGPIGLIAAAAARASGAHPVVITDIDPSRLSFARRFLPTIQTYQNNPTLDAQGNAKAIRALFGDNEYNAPDRVLECTGVESSICTAAYTARRGGLVVVVGVGKEIINNVPFMHLSLAEIDLKFINRYRDTWPRAISCMAAGIITDLKPLISHTFPLERADEALELCADMGRPSIKVTIVDEGDATV

SEQ ID NO: 9830 - DNA, 1083 bp, Candida albicans SC5314
  CDS (1)..(1083): transl_table=12
atgacaaacccttctttagtgcttaacaaaatcgacgacatttcgtttgaagattacgaatccccagaaatcacctcccccagagacgttatcgtcgaggtaaagaaaaccggtatttgtgggtcagatatccattactatgcccatggcctgatcgggccttttgttttgagaaaaccaatggtgttgggccacgagtcggccggtgtggttgttgccgttggtgacgacgtaaccaacttgaaagtgggcgacaaggtcgccattgaaccaggtgtcccgtcaagatacagcgacgagtacaagtcaggaaactaccacttgtgtccacacatggcatttgctgctacgccaccagtcaaccccgacgaaccgaacccaccaggtactttgtgcaaatactacaaagctccagctgatttcttgttcaaactcccagaccacgtttctttggagttgggcgctatggtcgagccattgacggtcggcgtgcacgcctgtaagttggccaacttgaagtttggcgaaaacgttgttgtgtttggggctggccccgttgggttgttgacagctgctgttgccaaaaccattggcgccaaaaacattatggtcgtcgacatttttgataacaaattgcaaatggcaaaagatatgggtgctgccacccacaccttcaactccaagaccggcgacgatttggtaaaagcgtttgacggtattgagccttcggtggtcttagaatgcagtggcgccaagcagtgtatctacaccggtgtcaaaatcttaaaagccggcggcagattcgtccaggtcggtaatgctggtggcgacgtcaacttcccaattgccgatttctcaactagagagttgactttgtacgggtcgttcagatacgggtatggcgattaccagacctcaattgatatcttggacaaaaactacatcaacggcaaagaaaacgcaccaatcaattttgagttgttgattacccaccggttcaagtttaaagacgccatcaaggcctacgacttggtcagaggcggtaacggcgccgtcaagtgtttaatcgatggcccagaataa

SEQ ID NO: 9831 - protein, 360 aa, Candida albicans SC5314
MTNPSLVLNKIDDISFEDYESPEITSPRDVIVEVKKTGICGSDIHYYAHGSIGPFVLRKPMVLGHESAGVVVAVGDDVTNLKVGDKVAIEPGVPSRYSDEYKSGNYHLCPHMAFAATPPVNPDEPNPPGTLCKYYKAPADFLFKLPDHVSLELGAMVEPLTVGVHACKLANLKFGENVVVFGAGPVGLLTAAVAKTIGAKNIMVVDIFDNKLQMAKDMGAATHTFNSKTGDDLVKAFDGIEPSVVLECSGAKQCIYTGVKILKAGGRFVQVGNAGGDVNFPIADFSTRELTLYGSFRYGYGDYQTSIDILDKNYINGKENAPINFELLITHRFKFKDAIKAYDLVRGGNGAVKCLIDGPE

SEQ ID NO: 9832 - DNA, 1452 bp, Ustilago maydis 521
  CDS (1)..(1452)
atggctcctgttgctgtcacagaatctactccaattgctccaactgcggccaagctcaacggagctgccacgcacaacggcgacatgaacggcaccatcaccaacactactggcccaagcttgttcggttccaacacgtcggctgtacttcacggcgcgaaggaccttcgaatcgaagagcgtccttacgccgcacctatcggtgacgaggtgcagatccgcgttcgggctaccggtctctgcggttccgatcttcactactacctccacggccgcaatggcgacttcgcacttcaacactccatgtgtctcggccatgaatctgcaggagaaatcgtcgctgtcggtcccaacgtccctgcttccctcggccttgctgtcggtgatcgcgtagccatcgaagcaggacgcttctgcggttcatgccttaaatgtcgcgatggacgctacaacctctgcaaacagatgcgtttcgcctcgtcggctaaaactcaccctcatctcgatggaacgttgcaaaagtacatgaactggccatcttggctggtgcacaagctaccagcgaatgtttcgttgacttcggcggcgttgtgcgaaccactgagtgtggtgttgcaggggatcagaaggagtcagctgcaaccaggacagagcgttctggtgtacggagcgggtgcggtcgggttgctggcttgtgcagctgccaaggcgagtggtgctagctttgttgctgcggtggatatcgatcagggaagattggcgtttgctgctgcgaatgggtgggcggatgctacctacctgcttcctcgtgctgcgcccgctgcagtagatggagagcagacgaatgttggtgctcgtcgtgcggcggaagacaaagcggcgatctcgtcggcgagtgcgtctgccgcaagcctgctcaaagcgctttcctcttccgacccttcctcttcacagcagacaagctacgctattcaaccagcacccctcgacctttccagcgaaggtttcgacgtggtgttcgaatgtactggtgttccaacctgcgttcaaaccggcatctttgccacgaaagcaggaggaaaagttgttctgatcggtatgggcaaccccatccaaaccctgcccgtcggatcagcctcgctccgcgaagttgacatcgtcggcgtcttccgatacgccaacacctaccccgtcgctcttggcctgctagccggcggaacgctgcgtgcccaaggcggcggtctccatgcccaagctgtaggtctccccaccaacctcgacaccaacgaaggccacggcccaggaaggaagatgggcggtatcgaaaacctcgtctctcacactttccccctcaagcacgccataaaggctttcgaaaccctcgccaacggcaaagatcccgaacacggtcgaggcgtcgtcaaggttttcatcacggacgatgacgcttaa

SEQ ID NO: 9833 - protein, 483 aa, Ustilago maydis 521
MAPVAVTESTPIAPTAAKLNGAATHNGDMNGTITNTTGPSLFGSNTSAVLHGAKDLRIEERPYAAPIGDEVQIRVRATGLCGSDLHYYLHGRNGDFALQHSMCLGHESAGEIVAVGPNVPASLGLAVGDRVAIEAGRFCGSCLKCRDGRYNLCKQMRFASSAKTHPHLDGTLQKYMNWPSWLVHKLPANVSLTSAALCEPLSVVLQGIRRSQLQPGQSVLVYGAGAVGLLACAAAKASGASFVAAVDIDQGRLAFAAANGWADATYLLPRAAPAAVDGEQTNVGARRAAEDKAAISSASASAASLLKALSSSDPSSSQQTSYAIQPAPLDLSSEGFDVVFECTGVPTCVQTGIFATKAGGKVVLIGMGNPIQTLPVGSASLREVDIVGVFRYANTYPVALGLLAGGTLRAQGGGLHAQAVGLPTNLDTNEGHGPGRKMGGIENLVSHTFPLKHAIKAFETLANGKDPEHGRGVVKVFITDDDA

SEQ ID NO: 9834 - DNA, 1149 bp, Ustilago maydis 521
  CDS (1)..(1149)
atggctcctgttgcaaacaccaaatcttcggtggagctctccgctcttaaggacaatctcatcctcatggctacgcacaaaaaggagcttgagctgatcaaatccacacctgctgctccagggccgggaatggctctggtccacgttcgcgctacgggcgtgtgtggttccgacgtgcacttctggaagcatgccggactcggaccttggaagatcgaatcacagtgcgctctaggtcacgaatctggaggaatcgtcattgcggtcggtgaaggcgtcgacaacgtggtccctggtgatcgcgtagccattgagcctggggttccatgcttcaaagctacgtgcgacttttgtcgtacaggaaagtacaatctctgccccaccgtcgacttttactcggtccctcctaaggatggaacgctcaaacgataccacgagcacccagcgggctggctgcacaaggttccagacaacatgtcgtacgaagaaattgcgcttctcgaacctctttcggtcactttgcaggctacacttcaagccgaaatctcgctgggaacgccggtgctaatcacgggagcaggtccaattggaatcgtccagctgctgtgtgcaagtgctgcaggtgctacaccgatcgtcatcactgacgtcgtcaaggaccgactcgatttcgcccaaaagattgtccctggaactttcacctatcaaatcgaccccaagaaatctccgctcgaaagcgccactgagatctgcaaggtcttctccaaggcaagcggaaaacacatcgcccaaggtgagcgtgacgtccaacccgccatcacaatggaatgcaccggcattgaaagctcgatccaaaccgcttcgtacgccaccgcagccagcggcttagtctttgtgattggtgtaggtgccaacttgcaacaaattcctttcatgcacctttccaccaacgaaatcacgctcaaattcttgttcaggtacagggacacttggcccagagcaatcagattggtcagcagcggcaagatcgatgtcaagcaaatcgtgaccagccgcttcccgctagaaaaggcaaaggaggctgtagaacatgcggcggataggtccaagtttagtgtcaagacaatcatctatgatgatcaggagtag

SEQ ID NO: 9835 - protein, 382 aa, Ustilago maydis 521
MAPVANTKSSVELSALKDNLILMATHKKELELIKSTPAAPGPGMALVHVRATGVCGSDVHFWKHAGLGPWKIESQCALGHESGGIVIAVGEGVDNVVPGDRVAIEPGVPCFKATCDFCRTGKYNLCPTVDFYSVPPKDGTLKRYHEHPAGWLHKVPDNMSYEEIALLEPLSVTLQATLQAEISLGTPVLITGAGPIGIVQLLCASAAGATPIVITDVVKDRLDFAQKIVPGTFTYQIDPKKSPLESATEICKVFSKASGKHIAQGERDVQPAITMECTGIESSIQTASYATAASGLVFVIGVGANLQQIPFMHLSTNEITLKFLFRYRDTWPRAIRLVSSGKIDVKQIVTSRFPLEKAKEAVEHAADRSKFSVKTIIYDDQE

SEQ ID NO: 9836 - DNA, 1164 bp, Ustilago maydis 521
  CDS (1)..(1164)
atgccaggaaaagtcgctcccaacaactcgctcgctaccgaacctgccgagcgcaacgtctcattcgtgttgcaagagatcgagaaagtctcgttcgaagaacgccccatcgttgcgcccaagcctggtcaggtgcaagtcaacatccgtcaaactggtctgtgcgcttccgactgtcactaccttcaccatggtcgtatcggtgactttgtggttcgcaagcccatggtgctcggtcacgagtcgagcggcatcgtcactgccgtcggagagggtgtcaccacgcacaaggtcggcgatcgcgttgctctcgagcctggcgttccttgccgatcgtgccaggtctgcctgaacggcatgtacaatcaatgtgcccatcttgagttcgctgctacacccccttacgatgggacgctgtgcacatattacaacatccagagctcgtttgcgcaccatgtgcccgatcacatgtctctcgaggaggcttccctcatggagcctctttccgtagctgtctactcggctggtatgcgcggtcaggtcaaggctatggagaacgtcctcgttttcggtgctggtcccattggtctgctcaacgctgccgtctgcaaggcctactctgctaaacgagtggtggtcgttgatgtggtggaaagcaagctcgagttcgctaaagagtggtgtgccacttctactttcaagccttcgctgccccaggagggcgaaaccaaggccgaaacagccgcacgcaatgcacagcacctcatcagctcgctcggtgacgatgtagcagcacgcgaaggcttcgacctcgtactcgagtgtaccggtgctgagccctgcatcaacatgggcatccaggcccttcgaccacagggtcgctttgtccaggtcggtatgggcagatctgaagtcgaattccccatcacgcgtgtctgcgtcaaggagatcaacgtcactggctccttccgctacggagctggcacctacaaaacctcgatcaaccttgtcagcaccggcgccatcgacgtcaccaagatggtcacccatcgtttcctcttcaaggacgctgtcaaggcgtttgagaccacaacaaaaggtgtcggtgaggacggaaagacagcaatcaaggttcagattagccagggcgagggcaaacagtga

SEQ ID NO: 9837 - protein, 387 aa, Ustilago maydis 521
MPGKVAPNNSLATEPAERNVSFVLQEIEKVSFEERPIVAPKPGQVQVNIRQTGLCASDCHYLHHGRIGDFVVRKPMVLGHESSGIVTAVGEGVTTHKVGDRVALEPGVPCRSCQVCLNGMYNQCAHLEFAATPPYDGTLCTYYNIQSSFAHHVPDHMSLEEASLMEPLSVAVYSAGMRGQVKAMENVLVFGAGPIGLLNAAVCKAYSAKRVVVVDVVESKLEFAKEWCATSTFKPSLPQEGETKAETAARNAQHLISSLGDDVAAREGFDLVLECTGAEPCINMGIQALRPQGRFVQVGMGRSEVEFPITRVCVKEINVTGSFRYGAGTYKTSINLVSTGAIDVTKMVTHRFLFKDAVKAFETTTKGVGEDGKTAIKVQISQGEGKQ

SEQ ID NO: 9838 - DNA, 1203 bp, Cryptococcus neoformans var. neoformans B-3501A
  CDS (1)..(1203)
atgtgctcttctcacgccactgctgtcgagtccgtctctcccgctccccgaaaaagccaatacgaggtcaagtacgacccggatcttgttctcaagagcgccgaattcaaggagctgaagcaaggggacaaggagcttgaggatcctaaggccaaccttgcctgcgcctacgatgagaaacacaacgtgaagatgatcaacaagcccattcctaaagccaggcaggatgaggtcgtcgtgcacatcaaagccactggtatctgtggttccgacgtccatttctggaagcacggtcagattggtcccaccatgatcgtcactgacacttgtggtgctggccatgaatctgccggtgaagtcgtcgaggtgggtcccggagtcgaacagtggaaagtcggagacagagttgccatcgaatgtggcgttccctgcggacaagccagttgtggtccttgcgtgactggcaggtataacgcttgccctcaagtcgtcttcttctcgacgcccccttatcacggtactttgacccgttatcacgcccaccctgcctcttggctccatcgactccccgacaacctctcgtacgaagaaggtgctttgtgcgagcctcttgccgttgcattggcggctcttgaaagggctggtaaccgtctgggtgaccctgttttgatttgcggtgctggacctattggtttggttactcttctcgcttcccacgctgctggttgtacgcctattgttatcaccgacttgcaagcatcccgtcttgaggtcgccaagaagcttatcccaaccgtgaagactgtccagatcgaacgtagctggacttcaaaggagacctctgaagctatcaaggaggctgctggcaccggtattcgtgttgccattgatgccactggcttcgaaagctcaattactgctgctatctattctgttgtgtttggcggaaaagtcttcgtcattggtgccggtccttctgagcaaaagtatcccttcggttactgctctgccaatgagattgacctccaattccaataccgttacgcacaccaataccctaaagccctccgcattgtttctggcggcctcatcaacttaaagccgcttctcactcacactttcccccttaacaaagctgttgaagctttccatgtcgcagctgatcccaccaagggggctatcaaggtacagattattgattaa

SEQ ID NO: 9839 - protein, 400 aa, Cryptococcus neoformans var. neoformans B-3501A
MCSSHATAVESVSPAPRKSQYEVKYDPDLVLKSAEFKELKQGDKELEDPKANLACAYDEKHNVKMINKPIPKARQDEVVVHIKATGICGSDVHFWKHGQIGPTMIVTDTCGAGHESAGEVVEVGPGVEQWKVGDRVAIECGVPCGQASCGPCVTGRYNACPQVVFFSTPPYHGTLTRYHAHPASWLHRLPDNLSYEEGALCEPLAVALAALERAGNRLGDPVLICGAGPIGLVTLLASHAAGCTPIVITDLQASRLEVAKKLIPTVKTVQIERSWTSKETSEAIKEAAGTGIRVAIDATGFESSITAAIYSVVFGGKVFVIGAGPSEQKYPFGYCSANEIDLQFQYRYAHQYPKALRIVSGGLINLKPLLTHTFPLNKAVEAFHVAADPTKGAIKVQIID

SEQ ID NO: 9840 - DNA, 1128 bp, Cryptococcus neoformans var. neoformans B-3501A
  CDS (1)..(1128)
atgtggactatggagggggaagagagggatatccccgagcccaaggcggatgaggtgcaaatcaaggtggcaatgacgggcatgtgtggatctgacctccactactacctccacggtgcgaacggcactttcaagattcgagaacccctcgtcctcggtcacgaatcctgtggtgtcatcaccgctgtcggctctaatgtcaactccggtttcaacctcaaagtcggtgacagggtcgctatggaagttggtgtctactgcaagacctgtaagatgtgccgacggggcaggtacaacctttgtgcgaacatgcgattcgcaagctctgcgaagacctaccctcatttggacgggacattgcgagaggtcatgacgtggcctgctgaattggtttacaagctcccccctaaccttgaactccccctcgctgctcttgccgaacccctctccgtcgttctccacgcttaccgacgagctcacctcagtcctggttctcgaatccttgtcatcggcgctggtgccgtcggtcttctcacctgtgccctcgcccgagcgagcggatgcaccaccgtcgttgccgtcgacattgaacagggcaaactcgactttgccgctcaacaaagctggacaacaaacactttctgcttgcctaaaggccccagagttagcggtgcggaggctttggaggttgctggtaagcagtgggatgctttaaaggccagtgatgcggtgcaatctgtggagggtttggaagatgggttcgatgctgttttcgaatgtactggtgttgagagctgtatgcagatggcccctatggccgctgctatcggcaccaaggtccttttcgtcggtatgggcaccaaggtcctcgctcttccctgtggcccctcccttctctccgaagtcgacctcatcggtgtcttccgatactgcaacacctaccccgacgccctcgctctccttgcttccggtaagctcggtgacgtcagcaagatggcgagccactactactctctcgaccaggctgccgaagcgtttgaggatttgaagcgaggtaaggacaaggatggcaggacggttatcaagcctatggttgggaacttggagatgtgtggcatcaagaagtaa

SEQ ID NO: 9841 - protein, 375 aa, Cryptococcus neoformans var. neoformans B-3501A
MWTMEGEERDIPEPKADEVQIKVAMTGMCGSDLHYYLHGANGTFKIREPLVLGHESCGVITAVGSNVNSGFNLKVGDRVAMEVGVYCKTCKMCRRGRYNLCANMRFASSAKTYPHLDGTLREVMTWPAELVYKLPPNLELPLAALAEPLSVVLHAYRRAHLSPGSRILVIGAGAVGLLTCALARASGCTTVVAVDIEQGKLDFAAQQSWTTNTFCLPKGPRVSGAEALEVAGKQWDALKASDAVQSVEGLEDGFDAVFECTGVESCMQMAPMAAAIGTKVLFVGMGTKVLALPCGPSLLSEVDLIGVFRYCNTYPDALALLASGKLGDVSKMASHYYSLDQAAEAFEDLKRGKDKDGRTVIKPMVGNLEMCGIKK

SEQ ID NO: 9842 - DNA, 1179 bp, Cryptococcus neoformans var. neoformans B-3501A
  CDS (1)..(1179)
atgaccattgcggctacatctatccctaccaccaagtacgaggcgcactacgaccccgcaaaggtcattcagcatcccgagttccaaacgctcagtgaagatgctcctgagctttccgaccccaagctcaacatcgcctgtgcgtacaacccggctcatgagatccacatggtcaagaagcctcgattcgagcccggtcctggtgaagtgacaatccacgtccgtgccacaggaatctgcggttctgacgttcacttctggaaacacggccatattggacctaccatgattgtcacagatgagtgcggagcaggacatgaatcggcaggcgaaatcgttgccgttggagaaggcgtcgcacaatggcaggtcggtgacagggtagctgttgaagccggtgttccatgcggtctcgcctcatgtgacccttgtcgtaccggtcgttacaacgcttgtcctgctgtcgtcttcttctccacccctccttaccatggtacactcactcgatatcacaatcacccggctgcttggtgccaccgtctcgccgataacgtgtcttatgaagaaggatccctgtgtgagcctcttgcagtggcgctggccggtcttgacagggctggtgtgagattgggggaccctattgccatttgcggggcgggccctatagggttagttactcttcttgctgcgcatgctgcaggttgtacgcccattgtcatcaccgatctcttcccatcccgacttgagttcgccaagaagcttcttccaactgtcaagactgtacagattgagaagactgcaaagcccgaagaggttgcgaagcagatcaagggcgcggcgggtatgcagctttcgcttgcatttgactgtacaggagtggagagcagtatcagatctgctatcttctctgtcaagtttggaggcaaagtctttgtaattggtgtcggaccttcagagcaaagctacccattcggctattgtagcgccaacgagatcgatctccaattccagtacaggtacaacaatcaatacccgaaagccattcgactcgtcgctggcgggcttgtcgacctgaaaccacttgtcacccaccgtttcgctttgaaggaggctgttaaggctttccacgtcgccgctgatccctctcaaggagctatcaaggttcagatccgtgattag

SEQ ID NO: 9843 - protein, 392 aa, Cryptococcus neoformans var. neoformans B-3501A
MTIAATSIPTTKYEAHYDPAKVIQHPEFQTLSEDAPELSDPKLNIACAYNPAHEIHMVKKPRFEPGPGEVTIHVRATGICGSDVHFWKHGHIGPTMIVTDECGAGHESAGEIVAVGEGVAQWQVGDRVAVEAGVPCGLASCDPCRTGRYNACPAVVFFSTPPYHGTLTRYHNHPAAWCHRLADNVSYEEGSLCEPLAVALAGLDRAGVRLGDPIAICGAGPIGLVTLLAAHAAGCTPIVITDLFPSRLEFAKKLLPTVKTVQIEKTAKPEEVAKQIKGAAGMQLSLAFDCTGVESSIRSAIFSVKFGGKVFVIGVGPSEQSYPFGYCSANEIDLQFQYRYNNQYPKAIRLVAGGLVDLKPLVTHRFALKEAVKAFHVAADPSQGAIKVQIRD

SEQ ID NO: 9844 - DNA, 1035 bp, Clostridium thermocellum ATCC 27405
  CDS (1)..(1035): transl_table=11
atgttacaatcggttatggtatctcctggaaagattgagttccatgaggtggaaaaaccggaactaaaacctggacaagtactaataaagattatgagaattggcatatgtggttcggatattcatgtaaatcatggaaaacatcctttcacaaagtatccggtaactcaaggacatgaagtaagtggaaaaatcgtcgaagttgcagaagatgtggagcatctgaaagttggccagaaagtgactatagagcctcaggttgtatgtggtaaatgtcatccgtgccgtacaggaaaatataacctctgtgaggaactaaaagttatgggattccagaccgttggcgcaggcagcgaatattttgctgttgatgcgaagaatgtaacgactgtccctgaccatctttcttatgacgaggccgcgatgattgagcctttggctgttaccgttcatgcggcaaacagagtcggtgatgtgaaggataaggacattgtagtaataggtgcgggtcctataggaattttgctggttcagaccctgaaagcaaaaggtgcccgcaaggtaatggttacggatgtaagcgattatcgtttggaattggcgctcaagtgtggtgctgattttgcagtcaataccaaaaaagaagatttcggagaagcgatgcttcgctgttttggacctgataaagcagatgttatatatgattgtgcgggcaacaatacaacaatggaacaagccataaaacattcccgcaagggaagcataattgttctggttgcagtatttgaaggtatggcaacagtcgatcttgcaactcttaacgataaggaactggatttgaatacgacaatgatgtatcggcatgaggactatgtggaagccattgagcttgttgaagcgggtaaagtaaaattaacccctctgatgagcaagcattttgcttttagagattgggaaaaagcctatgagtatattgacaataatcgtgaaattactatgaaagtcctcattgatgttaataacgatgatgattaa

SEQ ID NO: 9845 - protein, 344 aa, Clostridium thermocellum ATCC 27405
MLQSVMVSPGKIEFHEVEKPELKPGQVLIKIMRIGICGSDIHVNHGKHPFTKYPVTQGHEVSGKIVEVAEDVEHLKVGQKVTIEPQVVCGKCHPCRTGKYNLCEELKVMGFQTVGAGSEYFAVDAKNVTTVPDHLSYDEAAMIEPLAVTVHAANRVGDVKDKDIVVIGAGPIGILLVQTLKAKGARKVMVTDVSDYRLELALKCGADFAVNTKKEDFGEAMLRCFGPDKADVIYDCAGNNTTMEQAIKHSRKGSIIVLVAVFEGMATVDLATLNDKELDLNTTMMYRHEDYVEAIELVEAGKVKLTPLMSKHFAFRDWEKAYEYIDNNREITMKVLIDVNNDDD

SEQ ID NO: 9846 - DNA, 1044 bp, Clostridium thermocellum ATCC 27405
  CDS (1)..(1044): transl_table=11
atgaaaggaaaaatgaaggtttgtgtgttgacaggcaaagaaaagctggagtgggtagaacgcgatattccacagccgggaaggggggaattgcagatcaagctgaaacatgtgggcgtgtgcggttcagacttacatttttacaaagaaggacgtcttgcaaactgggaacttgacggaccgctggcattgggacatgaacccggaggaattgtatcagccataggtgaaggtgttgaaggctttgagattggtgacaaggtggcattggaaccgggagtgccgtgcggtgaatgtgaagactgtagaaaaggacattacaatttgtgcaaacatatcaaatttatggccattcctcatgaaaaagacggtgtgtttgccgagtactgcgttcatagtgcaagcatgtgctacaaactgcctgagaatgttgacacaatggaaggtggccttatggaaccgctttctgttgcgcttcatgctactgaactgtcaaacgctaaaataggcgaaacagctattgttttaggaagtggctgcattggtttgtgcacagttatggctcttaaggcacggggagtaagtgaaatttatgttactgatgtggtggacaagaggcttgagaaggcacttgaagtcggagcaacccgggtatttaacagtcagagggaagacattgtggagtttgcaaaaactctgcccggcggcggtgcggatcaggtttacgaatgtgcgggaagccgtgtgacaactctgcagacatgcaaactgatcaaacgtgccggaaaagtcacattggttggtgtgtcaccggagcctgttttggaactggatatcgccactttgaacgcaatggaaggtaccgtatattccgtatatcgttacagaaatatgtatcctattgcaatagcagccgtgtcttcaggagtaattccgcttaagaaaattgtatcccatgtgttcgattttaaggattgcatagaggcgattgaatacagtacaaatcacaaggatgaagttataaaatctgttattaaattttaa

SEQ ID NO: 9847 - protein, 347 aa, Clostridium thermocellum ATCC 27405
MKGKMKVCVLTGKEKLEWVERDIPQPGRGELQIKLKHVGVCGSDLHFYKEGRLANWELDGPLALGHEPGGIVSAIGEGVEGFEIGDKVALEPGVPCGECEDCRKGHYNLCKHIKFMAIPHEKDGVFAEYCVHSASMCYKLPENVDTMEGGLMEPLSVALHATELSNAKIGETAIVLGSGCIGLCTVMALKARGVSEIYVTDVVDKRLEKALEVGATRVFNSQREDIVEFAKTLPGGGADQVYECAGSRVTTLQTCKLIKRAGKVTLVGVSPEPVLELDIATLNAMEGTVYSVYRYRNMYPIAIAAVSSGVIPLKKIVSHVFDFKDCIEAIEYSTNHKDEVIKSVIKF

SEQ ID NO: 9848 - DNA, 1026 bp, Mycobacterium sp. JLS
  CDS (1)..(1026): transl_table=11
atgacagagaccgttgacggcaccatgcgtgccagcgtgatgaccggggtcggcacgctgcggatcgaggagcggccggtgccgtctcccggaccgcacgaggtgctcgtcgaggtggccgcggtcggggtgtgcggttcggatgtgcactactaccgtcacggccggatcggcgatttcgtcgtcgaggagccgatgatcctcggccacgaactatccgggcggatcgccgccgtcggtgagggcgtcgatcccggacgagtgggtgagcgcgtcgccgtcgaaccacagcatccctgccgtcgctgcaagcagtgcaaggccggccggtacaacctgtgccccgagatgaagttctacgccaccccaccgatcgacggcgcgttctgccgttacgtcgtcatcgacgacgacttcgcccatccggtgcccgagtccatgtccgatgacgccgccgcgctgctcgaaccgctctcggtggcgatcgccacgatgcggaaagcgggagtggtccccggatccaccatcctgatcgccggcgccggtcccatcggcgtcatctgcgcgcaggccgcccgagccttcggtgccgcccgcatcgtcgtcaccgacctggttccgtcgcgccgggagatggcgctgaagttcggcgccacggaggtgctggatccggccgccgtggacgtctcggcgatcgaacccgtcgacgcgttcgtcgacgccaccggcgtacccgcggcggtggtcagcggtatcaaggccgtcggcccggcgggcagggtggtgctggtcgggatgggtgccgatgagtacgcgctgccggtcagccacatcgcgaacctcgagatcaccgtcaccggcgtgtttcggtacaccgacacctggcccgccgcaatacatctcgtgaactccggcgcggtggatctcgacgcgatggtgacgggccgctacgacctcgaacacgtggccgacgccctcgacagcgacaccgaccctgccagcctcaagtcgattgtgaacccctga

SEQ ID NO: 9849 - protein, 341 aa, Mycobacterium sp. JLS
MTETVDGTMRASVMTGVGTLRIEERPVPSPGPHEVLVEVAAVGVCGSDVHYYRHGRIGDFVVEEPMILGHELSGRIAAVGEGVDPGRVGERVAVEPQHPCRRCKQCKAGRYNLCPEMKFYATPPIDGAFCRYVVIDDDFAHPVPESMSDDAAALLEPLSVAIATMRKAGVVPGSTILIAGAGPIGVICAQAARAFGAARIVVTDLVPSRREMALKFGATEVLDPAAVDVSAIEPVDAFVDATGVPAAVVSGIKAVGPAGRVVLVGMGADEYALPVSHIANLEITVTGVFRYTDTWPAAIHLVNSGAVDLDAMVTGRYDLEHVADALDSDTDPASLKSIVNP

SEQ ID NO: 9850 - DNA, 1053 bp, Clostridium difficile 630
  CDS (1)..(1053): transl_table=11
gtgaagtcagttagattctatggtataagagacacaagagtggaggatgtggatgtaccaaaaatattagaaaaagatgatgtaataattaaagtaaaagtagctggaatatgtggttctgatatatcaaaatattcaaagacaggtccacatatggttggagaaattttagggcatgaattttctggagaagtggcacaggttggtaaagaagtaaggagttttaaaataggagatagagttgctgtttgtccagctatgccatgttttgaatgtgatgaatgtaaaaaaggcttgtattcaagatgtaataatgtagcaataataggaaataaagaacttggaggttgttttgcagagtatacaaaggtgaaagagagaaatttaataaaaataccagatgagataagttatgagactgccgctgcgctagaaccagtatgtatagcaggacatggtctttttaggtcagaagctaaagttggagatacagttgtagtacttggtacaggtccaataggattattttcaatacaatgggcaaaaatatttggttctacaaaaataatagctgtggatgtatttgatgagaagttagacttggcaaaagagttaggggcagatatttgtataaatgcaaaagaaaagaatattgtagaagaaataaaaaggttaactgatggagatggtgcagatattgttattgaatcggctggtactccactgacatgtggtcaagtactgttgctagctaaaaagggaggtacagtattgtatgcaggtgtaccatatggggatgtagctttgactagagagcaatttgaaaagatagtaagaagtgaattaactgtaaagggaacttggtttggaaactcctttccattcccaggaaaagaatggagtgctggattgtatcatatgcaaaagggtgatatgaatgttgaaaaattagtaacacatagaataaatttagaagaagcaccagcttattttgaaaaagtatacaaaagggatattttctttggtaagataatgattaatatagataattag

SEQ ID NO: 9851 - protein, 350 aa, Clostridium difficile 630
MKSVRFYGIRDTRVEDVDVPKILEKDDVIIKVKVAGICGSDISKYSKTGPHMVGEILGHEFSGEVAQVGKEVRSFKIGDRVAVCPAMPCFECDECKKGLYSRCNNVAIIGNKELGGCFAEYTKVKERNLIKIPDEISYETAAALEPVCIAGHGLFRSEAKVGDTVVVLGTGPIGLFSIQWAKIFGSTKIIAVDVFDEKLDLAKELGADICINAKEKNIVEEIKRLTDGDGADIVIESAGTPLTCGQVLLLAKKGGTVLYAGVPYGDVALTREQFEKIVRSELTVKGTWFGNSFPFPGKEWSAGLYHMQKGDMNVEKLVTHRINLEEAPAYFEKVYKRDIFFGKIMINIDN

SEQ ID NO: 9852 - DNA, 1059 bp, Clostridium difficile 630
  CDS (1)..(1059): transl_table=11
atgggaaataaaatgagagcatcagtattgtataatgtaggtgatgtcagatatgaaatggtagatataccagaaataacagatacgcaagtgcttgtaaatgtaaaatatgttgggatatgtggttcagatttacctaggtctatggtaagtggtttgagtggaaatacaaaatatccattgattttagggcatgaattttctggtgaagttgttaaaattggagaaaaagtaaagcatattaatgtaggagatagagtagctgttgcaccattagtaccttgtggaaaatgtgattattgtaatgaaggtaattttggcttgtgtgatgattacaatataattggaacaagagtaaatggagcgtttgcagaatatgtaagagttccagaagaacatattttaaaactaccagatacattggattatgaaactgctgccggaattgaaccagcaactatagcttatcatgggatttcaaagtctaatattagagtaggagatagtgtagttgtgttaggatgtggtccaataggtcagtttgttatacaatgggcaaaggtgtttggtgcatctaagattatagcagttgatatttttgatgaaaaattagaactttctaaacttctaggagcaaactatatacttaactcaaaagaagtaaatgtaatcaaagaaataaaaaaaataacaaatggtggtgctgatgttgtaatagaaactgctggtagccgatttacacaagaacaatctctatttgtagcaaaaaagagaggaaatatagtgtttgtaggtatatcacacacagaattaccacttagtgcagacgctactgagtgtatattacgtggagaacttaccttgaaaggttcttggaattcatatacaagcccttatcctggaagagcatggactgcaacattggattttatggaaaaaggtgacattatttttaaacccatgatttcagataaaataggtcttaatgaagtgggtgactttttaagtaaaatgagcaagagagaaattaatttcaataaaatcctagtagaaatataa

SEQ ID NO: 9853 - protein, 352 aa, Clostridium difficile 630
MGNKMRASVLYNVGDVRYEMVDIPEITDTQVLVNVKYVGICGSDLPRSMVSGLSGNTKYPLILGHEFSGEVVKIGEKVKHINVGDRVAVAPLVPCGKCDYCNEGNFGLCDDYNIIGTRVNGAFAEYVRVPEEHILKLPDTLDYETAAGIEPATIAYHGISKSNIRVGDSVVVLGCGPIGQFVIQWAKVFGASKIIAVDIFDEKLELSKLLGANYILNSKEVNVIKEIKKITNGGADVVIETAGSRFTQEQSLFVAKKRGNIVFVGISHTELPLSADATECILRGELTLKGSWNSYTSPYPGRAWTATLDFMEKGDIIFKPMISDKIGLNEVGDFLSKMSKREINFNKILVEI

SEQ ID NO: 9854 - DNA, 1098 bp, Burkholderia vietnamiensis G4
  CDS (1)..(1098): transl_table=11
gtgagtacaccggcaccgcataccgcccccagcatgaaggccgccgtctggcacggccgcaacgacatccgcgtcgaggaggttcccgtccccggacacccgccggccggctgggtccagatccgcgtgcactggtgcgggatctgcggctccgacctgcacgaatacgtcgccgggccggtgttcatccccgtcgatgcgccgcacccgctcacgggcctgaaaggccagtgcatcctcggccacgaattcagcggcgaaatcgcggcgctcggcgcgggcgtcacgggcttcgcgctcggcgagcgcgtgacggccgacgcgtgccagcattgcggcacctgctggtattgccggcacgggatgtacaacatctgcgagaacctggcgttcaccgggctgatgaacaacggtgcgttcgcggagtacgtgaacgtgccggccgaactgctgtacaagctgcccgacaactttccgaccgaggccggggcgctgatcgagccgctcgcggtcgggatgtacgcggtgaagaaggccggcaacatcgtcgggcagaccgtcgtcgtggtcggcgccggcacgatcggcctgtgcacgatcatgtgcgcgaaggccgcgggcgccggacgcgtgatcgcgctggaaatgtcggccgcgcgcaagcagaaggcgctcgaagtgggcgcgacggtcgtgatcgacccgaaggcgtccgacgcgatcgccgaggtcaaggcgctgacgggcggctacggcgccgacgtgtcgttcgaatgcatcggccacacggccaccgcgaagctcgcgatcgacgtgatccgcaaggccggcaagtcggtgatggtcggcatcttcgaggagccgacgtcgttcaacttcttcgacatcgtgtcgaccgagaaggaagtgatcggctcgctcgcgtacaacggcgaattcgcggacgtgatccgcttcatcgccgacggccgcatcgacgtgcagccgctcatcaccggacgcatcgcgctcggcgacatcgtcgcgcgcggcttcgaggagctggtcaaccacaaggaccgcaacgtgaaaatcattgtccagcccgtggcagcctga

SEQ ID NO: 9855 - protein, 365 aa, Burkholderia vietnamiensis G4
MSTPAPHTAPSMKAAVWHGRNDIRVEEVPVPGHPPAGWVQIRVHWCGICGSDLHEYVAGPVFIPVDAPHPLTGLKGQCILGHEFSGEIAALGAGVTGFALGERVTADACQHCGTCWYCRHGMYNICENLAFTGLMNNGAFAEYVNVPAELLYKLPDNFPTEAGALIEPLAVGMYAVKKAGNIVGQTVVVVGAGTIGLCTIMCAKAAGAGRVIALEMSAARKQKALEVGATVVIDPKASDAIAEVKALTGGYGADVSFECIGHTATAKLAIDVIRKAGKSVMVGIFEEPTSFNFFDIVSTEKEVIGSLAYNGEFADVIRFIADGRIDVQPLITGRIALGDIVARGFEELVNHKDRNVKIIVQPVAA

SEQ ID NO: 9856 - DNA, 1047 bp, Listeria monocytogenes str. 4b F2365
  CDS (1)..(1047): transl_table=11
atgaaagctttaaaattatatggaaaaagagatttgcgttatgaagaagcggatatgccaacaatcgaacagccagatgatgtgattttgaaagtgaaaacggttgggatttgcggatctgatatttcgagatacagtaaacttggtccgtatgtaccaggaatggtgtggggacatgaattttcaggagaagtgattgaggttggtagtgaggttacagatattgagattggtgatagggctgccggatgcccagcactctattgcggagagtgtgaatactgtaaaaaaggcgaattcgcccgctgtcggaagctaacagtaatcggagcaagacatcccggagcctatgctgagtatatcaaacttccagcagaaaatgtagtaaaaataccagacgaattagattatgaagctgctgcacttgtcgagccttccgcagtggtcgttcatgggttttatcatacgaaattacaagcaggcgatgatgtcgtcgttgtcggaagcggcaatataggtttgctagcaattcaatgggcaaaagtttttggcgcaaaaagagttattgcaattgatgtagacgataaaaagttagctcttgcaaaagaagtaggagcagacgtcgttattaattctttaaaagaagatccattagaagtagtcgcagcacatacagatggtctaaacgctgatttagttgtagaagctgcgggatcacctattacatctgcccaagtttttgcctatgcgaaaaaaggtggaggcgtcgttttcctagggattccatacgccgatgtaacaatcgaacgtttctattttgaaaaaattgttcggagtgagcttactgtttggggctcatggaatgcaatttctgcaccatttccaggaaaagaatggcaaacaaccattcatttcctagccaataaacaaatcaacattgaaccaatgattacacatcgtctttcacttgctgaaggaccagaagtttttgagcgaatctatgaaagaaatgaatttttcgggaaagtattatttttcccagaataa

SEQ ID NO: 9857 - protein, 348 aa, Listeria monocytogenes str. 4b F2365
MKALKLYGKRDLRYEEADMPTIEQPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGAKRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 9858 - DNA, 1032 bp, Listeria monocytogenes str. 4b F2365
  CDS (1)..(1032): transl_table=11
ttgaaagcagtagtaaaaacaaaccccggatatgatcaaatggagctaagagatgtagaagaaccacaagtctatggcgacaaagtaaaaatcaaagtagcattcactggtatttgcggatcagacatccatacgtttaaaggtgaatacaaaaatccaacaactcccgtcacactgggacatgaattttctggtgtcgttgtagaagttgggccagatgtaacaagtatcaaagtgggagaccgtgtcacaagtgaaacaacttttgaaacttgtggagaatgtatttattgtaaggaacgtgattacaatttatgtagcaatcgtcgcggcattggtacgcaagcaaatggtagttttgcagaatttgttttatctcgcgaagaaagttgtcacgtgcttgatgaacgtatttcgctcgaagcagcagcactaacagaaccgcttgcatgttgtgtgcattcggcgcttgaaaaaacaacgattcgtccagatgacacagtacttgttttcggaccaggtccaattggtttgttactagctcaagttgtgaaagcgcaaggggcaacggtgattatggcaggaattaccaaagatagtgaccgcttacgtctagcaaaagagcttggaatggaccggattgtcgatactttaaaagaagacttggctgaagttgtgcttggcatgacagatggttacggagcggaacgcgtatttgattgttctggcgcagtacccgctgtaaatcaaggattacctctaacgaagaaaaaaggcgattttgttcaagtaggactttttgccgaaaagaaaaatgcgattgatgaagaatccattatccaacgtgaaattgcttatatcggcagccgttcgcaaaaaccatcttcttggattttagcgctcgacttactagcaaatggcaaaatcaatacggataaaatgattactaaagtatacggtttggatgactggcgcgaggctttcgaggcagttatggcaggaaatgaaattaaagtattagtgaaatcttaa

SEQ ID NO: 9859 - protein, 343 aa, Listeria monocytogenes str. 4b F2365
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 9860 - DNA, 1116 bp, Acinetobacter sp. ADP1
  CDS (1)..(1116): transl_table=11
ctgtgtaaggtcatacagtttaaagggtttcaacaaagttttaaaaggaagataacaatgaaagcagcacgtttttatgatcgtggcgacatccgtattgaggatattcctgagcctgaagtaacggcaggaacagtgggcatacaggtggcgtggtgtgggatctgtggaacagatttacacgagtttatggaaggcccgatttttattccaccatgtggacatccgcatccaatttcgggagagtcagcacctatcaccatgggccatgaattttcgggtgtggtatacgctgtgggtgaaggcgtagatgatattcaggtaggccagcatgtggtggtcgagccatatatcgtggcagatgatgttccaacaggtcctggtgaaaattatcatctttctaagaatatgaactttattggtctgggtggtcgtggtggtggcttatcggaaaagattgcagtccagcgccgttgggtacatccaatttcagaaaatattccacttgatcaagccgcattaattgaaccactctctgtcggacatcatgcctatgttcgaagtggtgcgaaagcaggtgacgtggcattggtgggcggcgcaggcccgattggtctactgctctctgcaattttaaaggccaaaggtttgacggttatcattaccgaattaagcagcaagcgaaaagaaaaagccaaagaatctggcgttgcggactatattctcgatccgactcaagtcgatgtgattgcagaagtcatgaaaattacgcaggacaaaggtgcagacattgcatttgagtgcagcagtgtgaataaagtattagacacactggttgcttcaacaaaaccaacaggtgttattgtcattgtatcgatctggagccaccctgcaaccgtaaatgtacatagtgtggtgatgaaagagctggatattcgcggaacaattgcctatgtcaatgatcatcaggaaacgattaaactggtcgaacaaggtaaaattaatctggcgccgtttattacgcagcgcattaaattagatgatctgatttctcaaggatttgagacattgatccataacaatgaatcggctgttaaaattattgtgcatccttaa

SEQ ID NO: 9861 - protein, 371 aa, Acinetobacter sp. ADP1
MCKVIQFKGFQQSFKRKITMKAARFYDRGDIRIEDIPEPEVTAGTVGIQVAWCGICGTDLHEFMEGPIFIPPCGHPHPISGESAPITMGHEFSGVVYAVGEGVDDIQVGQHVVVEPYIVADDVPTGPGENYHLSKNMNFIGLGGRGGGLSEKIAVQRRWVHPISENIPLDQAALIEPLSVGHHAYVRSGAKAGDVALVGGAGPIGLLLSAILKAKGLTVIITELSSKRKEKAKESGVADYILDPTQVDVIAEVMKITQDKGADIAFECSSVNKVLDTLVASTKPTGVIVIVSIWSHPATVNVHSVVMKELDIRGTIAYVNDHQETIKLVEQGKINLAPFITQRIKLDDLISQGFETLIHNNESAVKIIVHP

SEQ ID NO: 9862 - DNA, 1053 bp, Bacillus cereus E33L
  CDS (1)..(1053): transl_table=11
atgaaagcattactttggcataatcaacgtgatgtaagagtagaagaagtaccagaaccaactgtaaaaccaggagcagttaagattaaagttaaatggtgtggtatctgcgggacagacctgcatgaatatttagcaggacctatttttattccgacagaagagcatccattaacacatgtaaaagcaccggttattttaggtcatgagtttagcggtgaggtagttgaaatcggtgaaggtgttacatctcataaagtgggagaccgcgtcgttgtagaaccaatttattcttgtggtaaatgtgaagcttgtaaacatggacattacaatgtttgtgaacaacttgttttccacggtcttggcggagaaggtggcggtttctctgaatatacagtagtaccagaagatatggttcaccatattccagatgaaatgacgtatgaacaaggtgctcttgtagaaccagcagcagtagcggttcatgcagtacgtcaaagtaaattaaaagaaggggaagcagtagcagtatttggttgtggtccaattggacttcttgttatccaagcagctaaagcagcaggagcaactcctgttattgcagttgaactttctaaagagcgtcaagagttagcaaaattagcaggcgcagattacgtattgaatccagcgactcaagatgtattagctgaaattcgcaacttaacaaatggtttaggtgtaaatgtaagctttgaagtgacaggtgttgaagtagtacttcgtcaagcaattgaaagcacaagctttgaaggacaaactgtaattgttagtgtatgggaaaaagacgcaacaattactccaaataatcttgtactaaaagaaaaagaagtggttggtattttaggataccgtcatatcttcccagctgttattaaattaattagctctggccaaattcaagcagagaaattaattacgaaaaaaatcacagtggatcaagttgttgaagaaggatttgaagcacttgtaaaagataaaacacaagtgaaaattcttgtttcacctaaataa

SEQ ID NO: 9863 - protein, 350 aa, Bacillus cereus E33L
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 9864 - DNA, 1044 bp, Mannheimia succiniciproducens MBEL55E
  CDS (1)..(1044): transl_table=11
atgatggaaataaagacattatcttgtgttgtccgaggccctaaagacgtgggcgtaatggaacaatccattaattatgacgagtccagtaaagaacaaactttagttaaaatcacccgcggcggtatttgcggctctgatttgcattactatcaatacgggaaagtcggtaattatgaaattaaacatccgatgattcttggccatgaagttatcggtacggtagttaaaaccaatgcacctgacttatatgtcggtcaaaaagtggctattaatccgagtaagccctgtttaacctgtaaatactgtttatccggcgataccaatcaatgcgaaacgatgcgttttttcggtagcgctatgtacaaccctcatgttgacggcggctttacccaatataaagtagttgataacagtcaatgtattgattatccgcaggatgtttctgatgacattatggcatttgccgaacctctcgcggtgactattcatgcagcaaaacaagccggagatcttgcgggcaaacgcgtgtttgtttccggtgtcgggccaatcggctgcttggcggttgcagcaattaaagccagcggtgcaaaagaaattgtggtttccgatttaagccgacgctgtctggatcttgccttggaaatgggggctaccaaagcattaaacgcaaaggatgatttctccgaatacatggcacataaaggtgaatttgacgtttcgtttgaggcttccggtcatccttcttcgattgaacgctgccttgcggttacaaaagcaagaggcaccattattcaaatcggcatgggcggagcgattcccgagtttcctatcatgacattgattgccaaagaaatttgtctgaaaggttcattcagatttattgaagaatttaacacttcggtagaatggttaagttcgggcaaagtcaatccgttgccattactatcggcaaccttcccatatacggaattagaaaaagccttaattatcgccggtgataaagataatatttctaaagtgcaactttcatttgaatga

SEQ ID NO: 9865 - protein, 347 aa, Mannheimia succiniciproducens MBEL55E
MMEIKTLSCVVRGPKDVGVMEQSINYDESSKEQTLVKITRGGICGSDLHYYQYGKVGNYEIKHPMILGHEVIGTVVKTNAPDLYVGQKVAINPSKPCLTCKYCLSGDTNQCETMRFFGSAMYNPHVDGGFTQYKVVDNSQCIDYPQDVSDDIMAFAEPLAVTIHAAKQAGDLAGKRVFVSGVGPIGCLAVAAIKASGAKEIVVSDLSRRCLDLALEMGATKALNAKDDFSEYMAHKGEFDVSFEASGHPSSIERCLAVTKARGTIIQIGMGGAIPEFPIMTLIAKEICLKGSFRFIEEFNTSVEWLSSGKVNPLPLLSATFPYTELEKALIIAGDKDNISKVQLSFE

SEQ ID NO: 9866 - DNA, 1050 bp, Silicibacter pomeroyi DSS-3
  CDS (1)..(1050): transl_table=11
atgcacacccgcgtctgccgcatccatgccgcccgagatatccgggtcgaaaccgatcccctgcccgagcccggccccgcccaggtgatcgtcgccatggcggcggcaggcatctgcggctcggacctgcattattaccacgacggcggctttggcccgatccgggtgcgcgaaccgatgatcctcggccacgagggcgcgggcgtggtcgccgcccttggcccgggcgtgaccggtctggcggtgggcgaccgcgtggccgtcaaccccagccgcccctgcggcacgtgcagctattgcgtcgaggggctgacgacccattgcctcaacatgcggttctacggctctgccatgcgctttccccatgaacagggcctgtttcgcgacaagctgctgaccgatgccgcgcaatgccacaagctgtccgatcatgtcacgatctccgaaggggcctgcgccgagcctctggcggtgtgcctgcatgcccgtcacatggccggagaggtcaggggcaagcgcgttctggtcaccggatcggggcccatcggggtgctctgcgccgccgtcgccgccgaggccggagccgcggaaattgtggtgaccgaccttcaggacgccccgctggaggtagcccgccggatgggcgccacccgcacggtaaatatcgcgcgcgaggtcgaggcgatggccgcctatgcggtcgacaagggccatttcgatctggtcttcgaatgctctgccgccgcaccggccatacattccgccattgccgccctgcgccctcagggcacctatgtgcaggtgggggttaccggcgacgtgccgctgcccgtcaacctgatcgtcggcaaggaactgtgccttcagggcacccagcggttccgggccgaagagtttgccgaggcggtgcggctcatctcctcccggcgcatcgacctgcgggcgatgatttcgggcagcttcccgctggaacaggcggaagaggcgtttcggatggccgcagaccgcagccgcgcggtcaaggttcacctgacctttgccgacagctag

SEQ ID NO: 9867 - protein, 349 aa, Silicibacter pomeroyi DSS-3
MHTRVCRIHAARDIRVETDPLPEPGPAQVIVAMAAAGICGSDLHYYHDGGFGPIRVREPMILGHEGAGVVAALGPGVTGLAVGDRVAVNPSRPCGTCSYCVEGLTTHCLNMRFYGSAMRFPHEQGLFRDKLLTDAAQCHKLSDHVTISEGACAEPLAVCLHARHMAGEVRGKRVLVTGSGPIGVLCAAVAAEAGAAEIVVTDLQDAPLEVARRMGATRTVNIAREVEAMAAYAVDKGHFDLVFECSAAAPAIHSAIAALRPQGTYVQVGVTGDVPLPVNLIVGKELCLQGTQRFRAEEFAEAVRLISSRRIDLRAMISGSFPLEQAEEAFRMAADRSRAVKVHLTFADS

SEQ ID NO: 9868 - DNA, 1050 bp, Bacillus clausii KSM-K16
  CDS (1)..(1050): transl_table=11
atgagagcagccgtatggtacaaagagaaagatatccgtgtagaggaaagagaacctgcgaaactaggcgcccgtgatgtaaaagtgcgcgtagcgtgggctggtatttgcggaagtgatcttcacgaatacttgcacggtccggtgattatcccaaaaggagaacctgatcctattactggcggcgaatcaccccttacattagggcacgaatttgccggtgtgattgaggaagtaggaacggaggttaaatcctttcagaagggggatcgtgtcgtcattaatccactctttacctacggaaataagcctgcttcagttgatctctatgatggtttctcgtttgctggtcttgctacagatggaggatttgctgattttgcagtactcccagagaaaaatgtatataaattgcctgataacttaacgttggaagaaggagcactcgttgagccgatggcagtggcggtgcaagcggtaaaagaagccgattttaaatttggacaatcagttgccgtctttggggcggggccaattggtttgtttaccattattgctgctaaggctgcaggggctagcaaaatcatcgtttttgatttatcggaagaaaggctggaaaaagcacggcttgtcggcgccacccatacatttaattctggcgcagtcgatcccgttgaaaaagtaaaaagccttgtcccagatggggtcgatgtaagctttgaagtggctggcgtaaatgcaacatttaaccagtctatccaagtagccaagtcacggggagtcgtcgtcgttgtttccatttttgccaaaccgattgagttcaatccaatggatcttacgggcagtggcgttaagattacgtccactttggcttatgaaccggaagtattccaaacgactattgatttaatggcagagggagccttaaatccgaaaggcgttataaccgatcggattgagctagaaaatattgtagagtctgggtttgaagtgttaacaaacgataaacgccaggctaaaattctcgtgaaacttagcggcgagaaataa

SEQ ID NO: 9869 - protein, 349 aa, Bacillus clausii KSM-K16
MRAAVWYKEKDIRVEEREPAKLGARDVKVRVAWAGICGSDLHEYLHGPVIIPKGEPDPITGGESPLTLGHEFAGVIEEVGTEVKSFQKGDRVVINPLFTYGNKPASVDLYDGFSFAGLATDGGFADFAVLPEKNVYKLPDNLTLEEGALVEPMAVAVQAVKEADFKFGQSVAVFGAGPIGLFTIIAAKAAGASKIIVFDLSEERLEKARLVGATHTFNSGAVDPVEKVKSLVPDGVDVSFEVAGVNATFNQSIQVAKSRGVVVVVSIFAKPIEFNPMDLTGSGVKITSTLAYEPEVFQTTIDLMAEGALNPKGVITDRIELENIVESGFEVLTNDKRQAKILVKLSGEK

SEQ ID NO: 9870 - DNA, 1038 bp, Bacillus clausii KSM-K16
  CDS (1)..(1038): transl_table=11
ttgcgagcaattgaagtaagaaagccaggggacattcacgtagttgaagtccaaaagccagagcttgaaacggacaaggatgtgctggttaaagtgcaagctgtagggatatgtggttcggacatgcacatttaccatggcagtaacccgtttacggtttatccgcgcattatcggccatgaagtcggaggcattgttgaagaagtggggagcggtgtccatggccttcgtcggggcgaccgtgtagcgcttgagcccatttcatcatgcggcgtatgctacgcttgcaagaaaggccgcccgaatgtttgcgcaaagttggaggtgtttggcgtacaccgtgatggggggatgcgtgaatggatggtcgctcctgaagcgaactggcacaaagtaaacggggatttgccttttgaagcagctgctcttgtcgaaccaatgacaatcggcgcccaggcggcatatcgtggaaacattgagcctggagacactgtttttatcatgggggcagggccgacgggcatcgcctgtttaatcatggcgaagcaaaaaggcgcaacggttttcatttctgatttacaagccaaccgactcgattatgccaaacaagtaggcgctgattttacgattcatttgccgcatgaaaagccggaagcagtcctatttgaaaaaaccgatggcgaattcgcgaatgttgtcattgacgcagtcggtacgagtaccacatttgctgaagccgttaagcttgcttcagttgctggaaccgtagtgacattaggattcaatgaaacgccctcggatattccgtctttgttgttaacgaaaaaagaattaactgtagcaggctcaaggctgcaaacaaaccaatttcccgacgttattaggcaagtaaatgagcaaaaggttgacccagcctcgattatatctcatcgttttgactttgatgaggtgaagaaggcaattgagttgcttgaaaaggagcctgctcatgtccgtaaagcagtgttaatctttgaaagagaggatgagagcaagtga

SEQ ID NO: 9871 - protein, 345 aa, Bacillus clausii KSM-K16
MRAIEVRKPGDIHVVEVQKPELETDKDVLVKVQAVGICGSDMHIYHGSNPFTVYPRIIGHEVGGIVEEVGSGVHGLRRGDRVALEPISSCGVCYACKKGRPNVCAKLEVFGVHRDGGMREWMVAPEANWHKVNGDLPFEAAALVEPMTIGAQAAYRGNIEPGDTVFIMGAGPTGIACLIMAKQKGATVFISDLQANRLDYAKQVGADFTIHLPHEKPEAVLFEKTDGEFANVVIDAVGTSTTFAEAVKLASVAGTVVTLGFNETPSDIPSLLLTKKELTVAGSRLQTNQFPDVIRQVNEQKVDPASIISHRFDFDEVKKAIELLEKEPAHVRKAVLIFEREDESK

SEQ ID NO: 9872 - DNA, 1041 bp, Bacillus clausii KSM-K16
  CDS (1)..(1041): transl_table=11
atgagagcatccgtgttaaaagctttaaaaacgattgagttggaagagcggaccaagccaaagccaggagcaggcgaagttttgattcagatgaaagccgtcggtatttgtgggtcagacctccattattacgagcatggccgcataggagagagggtcgcaaagccgccatttgtccttgggcatgaatgtgcaggcgtagttacaaaagtcggcccagaagtagcagatttaaacgtaggcgaccatgttgtcattgagcctggattgccgtgcggcgaatgttcttcgtgccgagtaggtcactataacctttgcccaaaagtattgtttctttccagcccgcctaatgacggcgtattgatggaatatatatgccatccagctaaatttacatataaaatgccagaaggcctgtcgtttgaattagcttctcttgcggaacctctttctgtagggttgtacacagcccaaaagacatcgattcaaccaggttcgaatatcgtcattatgggaatggggcctgtaggattgtgcatgatccttgcagccaaatggtacggagcgtccaacattgtcgtcacagacatcgaaccgtaccgactagaaatcgccaaaaagattggcgcaatggatacaattcaagtcaaccatgaagcagacagggctggccttttggctgaagccgatcgtttaggcgggtttgatatggtcattgatacgtctggtgcagaagctgcatttgatatggcagtgaacttgctaaaaaggggaggcactatcggcggaattggctttcctggaggagcaaagtctacgattccgttgctgaagatgatgcagagggaaattgtttaccaaccgatctaccgttaccgccatacgtttaaacatgcgttggccttattggaaaaggaacaagaagcggcccaattgttattgaccgattttttcccgatgagtcaaataagcgctgcatttgactacgctgcatcaaataaagacaaaagcataaaagtcatcatccacccagataaataa

SEQ ID NO: 9873 - protein, 346 aa, Bacillus clausii KSM-K16
MRASVLKALKTIELEERTKPKPGAGEVLIQMKAVGICGSDLHYYEHGRIGERVAKPPFVLGHECAGVVTKVGPEVADLNVGDHVVIEPGLPCGECSSCRVGHYNLCPKVLFLSSPPNDGVLMEYICHPAKFTYKMPEGLSFELASLAEPLSVGLYTAQKTSIQPGSNIVIMGMGPVGLCMILAAKWYGASNIVVTDIEPYRLEIAKKIGAMDTIQVNHEADRAGLLAEADRLGGFDMVIDTSGAEAAFDMAVNLLKRGGTIGGIGFPGGAKSTIPLLKMMQREIVYQPIYRYRHTFKHALALLEKEQEAAQLLLTDFFPMSQISAAFDYAASNKDKSIKVIIHPDK

SEQ ID NO: 9874 - DNA, 1086 bp, Bacillus clausii KSM-K16
  CDS (1)..(1086): transl_table=11
gtggaggctttaaatttatatggtgctggcgacatccgttttgagcaatcgccaaagccaacgatcatgaatgacaatgaagtcatcgtccgtgtagaaacggcagggatttgcggatcagacttatcccgttataaaaaactagggccttatatttcggggacgacgtttggccatgaatgttcaggtacgattgaggaagtaggcagcaatgtcagccatttaaaggagggaatgcgagtcgccgtatgccctgctctcccgtgcggcgactgcacccaatgtcggcaaggggctttttcacggtgcccgtcgctaaccgttatcggagctgtccagccaggggcgtttgcagaatatgtgaagttgcctgctgaaaatgtcctcccattgccgaatgaaattgatgctgatacggcggcgttcattgagccggctgctgttgtggcacacggtttttacaagacggcgattgaaccaggagcagatgtggccattatcggctgtggaagcatcggcttgcttgcgattcaatgggcaaaattgtttggtgccagatatgtatacgcaattgatatcgatgaacaaaaattaaaagtggctaaagaacttggcgccgaccaacgagtgaatccacttgatggcccagtgcatgaacaaattcacgatttaactgctggagaaggggtagatgtggcgattgaagcagcggggactccgattacttctgcccaagcattagcattgccaaagaaaggcggagaagttgtttttcttgggattccatacggggacgtgacaatcgagcgtttttactttgaaaaaattgtacgaaacgaattgcgtgtccatggttcttggaatgggctgtccgccccatttccgggcaaagaatggaaaacggcgattcattctttgcaaacaggagcattgcaagtaaacccactcattacacaccggttgcctttatccgatgggccatttgtttttaaggaaatggccagcggttcccctgggtatataaaaacgttgctttatccagggaaaacagggcaaaaagaacgagccatcaatcatctgaaatag

SEQ ID NO: 9875 - protein, 361 aa, Bacillus clausii KSM-K16
MEALNLYGAGDIRFEQSPKPTIMNDNEVIVRVETAGICGSDLSRYKKLGPYISGTTFGHECSGTIEEVGSNVSHLKEGMRVAVCPALPCGDCTQCRQGAFSRCPSLTVIGAVQPGAFAEYVKLPAENVLPLPNEIDADTAAFIEPAAVVAHGFYKTAIEPGADVAIIGCGSIGLLAIQWAKLFGARYVYAIDIDEQKLKVAKELGADQRVNPLDGPVHEQIHDLTAGEGVDVAIEAAGTPITSAQALALPKKGGEVVFLGIPYGDVTIERFYFEKIVRNELRVHGSWNGLSAPFPGKEWKTAIHSLQTGALQVNPLITHRLPLSDGPFVFKEMASGSPGYIKTLLYPGKTGQKERAINHLK

SEQ ID NO: 9876 - DNA, 1029 bp, Bacillus clausii KSM-K16
  CDS (1)..(1029): transl_table=11
ttgaaagcattagtgaaaacagcacctggatttggacatgttgaactccaaaacaagcccgaacctgctccaggggaaaagcaagtcaaaattaaagtcaaatatgcgggcatttgtgggtccgatatccatacgtatgaaggccattataaagtggccttcccggtaacacttggccatgaatttgcaggagaaattgttgaagtcgggcctggcgttcagtcttttaaagtaggggatcgggtcacctctgaaaccactttctccatttgtgggcaatgtccctattgccaaacgaaagactacaacctttgcagcgagcgcaaagggcttggtacccagcaagatggcgggttcgctgagtatgtacttgcccgggaagagagtttgcatcttttgccagacaatgttgatttccgttcagcagcgatgacagaaccgttagcctgcacgcaccatgcgctagcgaaaacaacaatcaacgcaggcgatttgtgtgttgtcattggtcctggtccgattggcttgctcgctgcccaagccgcgaaaagcaaaggtgcaaaagtcatgataaccggcctcaatcatgacaaggttcgccttgagaaggcgcgtgcccttgggattgattatgttgtcaatggcgaagaaacggatgtcggcgaagtcgtaaatgaactgacaaacggctacggagccgatgtggtgcttgaatgttcaggcgccgtaaaagcagccaatcaagggctaaagttattgcggaaaaaggggcagtatagccaagtcggcatttttgctgcatcagaaattccctttgacctcgaaacaattattcagaaagaaatacacgtcattggcagcagaagccagaagccagctgattgggaaccttctttgatgcttttaaaaacaggcaatgtcaacgctcgtgccctcgtcacccatgaatacgagcttcatcaatgggaggaagcttatcaggcgataaaaagtggagaagcgataaaggttcttttgaaaccagagtaa

SEQ ID NO: 9877 - protein, 342 aa, Bacillus clausii KSM-K16
MKALVKTAPGFGHVELQNKPEPAPGEKQVKIKVKYAGICGSDIHTYEGHYKVAFPVTLGHEFAGEIVEVGPGVQSFKVGDRVTSETTFSICGQCPYCQTKDYNLCSERKGLGTQQDGGFAEYVLAREESLHLLPDNVDFRSAAMTEPLACTHHALAKTTINAGDLCVVIGPGPIGLLAAQAAKSKGAKVMITGLNHDKVRLEKARALGIDYVVNGEETDVGEVVNELTNGYGADVVLECSGAVKAANQGLKLLRKKGQYSQVGIFAASEIPFDLETIIQKEIHVIGSRSQKPADWEPSLMLLKTGNVNARALVTHEYELHQWEEAYQAIKSGEAIKVLLKPE

SEQ ID NO: 9878 - DNA, 1059 bp, Bacillus clausii KSM-K16
  CDS (1)..(1059): transl_table=11
atgaaagcgctcgttctcgaagcgaatcaatcatttactataaaggacattgaaacccctgtccctaaagaggatgaggcattaatcaaggttgcttattgcggcatttgcggctctgatttggcacggtacttcgatggcaaagtccacaattacccgattgttctcggacatgaattttctggaacggtagaggctgtcggcgcaagcgtcgattcagtagcggttggtgaccgtgtagtcgtcgccccccttttgccaaataaagacgatccctttatgcaaaagggaagcccagctttaagtagctcatacagttttcttggttcccgggaaaatggcgcaatggccgaatacgtagtcgtaaaagcggaaaatctcctcgttttgccggaaacggtaacattagcggaggcggcgttaatcgaaccattgacagtcgcgatccacggaattgagcgaattgtgctaccggcaggcgaacacgtctgtgttctaggagccggaacgattggcattatgaccattctcgccttaaaagcacgcggggcagggaaagtaacagcgattgatatcaacgacgagaaactggcatttgccaaaaaaatcggcgcagacgacacgattaactctttaaaagaggacccggtttcatacgctagcaaacatggcaagcctggcgctgttatcgaaacagcaggcgtgccgagctcccaagagcaagcggtcgctttagttgagaaaaaagggaagattgtgtttgttggaacggcgtcaggggatgtgacgtttccagcagcgacgtttgagaaaattttacgtgaagaattggaaatcacaggttcttggatgagctattctggcccattccccggctatgaatggcaggctgcgattgattacatcgcgtctggcaaaatcgatgtcaagcctttgatccatgacgtgtttaagctagaagatggcgacaagccatttcaagcaatgaaagacccagacaatcattcaattaaactactatatcaaatcgcagaaaacgaagggcaggtgggcaaataa

SEQ ID NO: 9879 - protein, 352 aa, Bacillus clausii KSM-K16
MKALVLEANQSFTIKDIETPVPKEDEALIKVAYCGICGSDLARYFDGKVHNYPIVLGHEFSGTVEAVGASVDSVAVGDRVVVAPLLPNKDDPFMQKGSPALSSSYSFLGSRENGAMAEYVVVKAENLLVLPETVTLAEAALIEPLTVAIHGIERIVLPAGEHVCVLGAGTIGIMTILALKARGAGKVTAIDINDEKLAFAKKIGADDTINSLKEDPVSYASKHGKPGAVIETAGVPSSQEQAVALVEKKGKIVFVGTASGDVTFPAATFEKILREELEITGSWMSYSGPFPGYEWQAAIDYIASGKIDVKPLIHDVFKLEDGDKPFQAMKDPDNHSIKLLYQIAENEGQVGK

SEQ ID NO: 9880 - DNA, 1035 bp, Bacillus clausii KSM-K16
  CDS (1)..(1035): transl_table=11
atgaaagctgtttttgtagacgatgcagaaaaaattaacatcaaagaaatcgacataccggtcgtgaaggacaatgacgtgctcattaaagtggccgtggccggtatttgtggatcggacattcatacgtataaaggattgcacccgtttcgaaaaccgcctgtcgtcattggtcatgaagtggctggcgaagttgtgagcgttggccaagcggtaaaacgtgttcaagttggagaccgggtaacggttgaaccgcaaattggcacgggagagagcgaaggcgtaatgacaggccaggcgaacttgtccgataagcgtttggctcctggcatgggcgattggcttgggacaatggctgaatacttcgtctctcctgaggcgcaagtgattaagctgccggatgcggtcagttatgaaaaaggggtgttagttgagccgttggcggttggcgtccatgctgcacgtaaagggggtatccaaccaggggaccgtgtcgcaattttaggtgctggaccgattggcttgttgacgcttatggcggtaaaagcgaaaggtgcttcacacgttgtggtgaccgatgtgttagactactcccttgatgttgccaaacaaatgggggcaacggccgcgattaatataaagggcaagccggattggattgaggaagcaaaaagtaaagtcggccggtcattcgataaagtgctaattaccgctggcgtgccaggcatcattaatgattcattgaacttattaaaaaaagggggacgtgctgtaacggtcgcgatgtttcatggccaacaagattttgatgtggaacaactacagcaaaatgaaaaagaaattgttggctgcatgacatacaatcgtcccgatacggaagaagcgttggatatcatcgccaaaggtgcgcttccagttgaaaaagtgatttctcatcaattgtcttacgaacaggctgacaaagggtttgaaatggtcgataaaaagcaagacaactctgtaaaagtgattgtttcatttgaacaggagggctaa

SEQ ID NO: 9881 - protein, 344 aa, Bacillus clausii KSM-K16
MKAVFVDDAEKINIKEIDIPVVKDNDVLIKVAVAGICGSDIHTYKGLHPFRKPPVVIGHEVAGEVVSVGQAVKRVQVGDRVTVEPQIGTGESEGVMTGQANLSDKRLAPGMGDWLGTMAEYFVSPEAQVIKLPDAVSYEKGVLVEPLAVGVHAARKGGIQPGDRVAILGAGPIGLLTLMAVKAKGASHVVVTDVLDYSLDVAKQMGATAAINIKGKPDWIEEAKSKVGRSFDKVLITAGVPGIINDSLNLLKKGGRAVTVAMFHGQQDFDVEQLQQNEKEIVGCMTYNRPDTEEALDIIAKGALPVEKVISHQLSYEQADKGFEMVDKKQDNSVKVIVSFEQEG

SEQ ID NO: 9882 - DNA, 1053 bp, Staphylococcus epidermidis RP62A
  CDS (1)..(1053): transl_table=11
atgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcgtagaaaatgttggtaaagacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacatactgacaacggtgtagatgtgtcatttgaagttgctggtgtaggtattactttacaacaatctattgaagtaacacgtccacgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagataatattgttgaaagtggcttcaatcaacttgtaaacgataaatctcaagctaaaattttagtccgtttaaatggtgaccaaaaataa

SEQ ID NO: 9883 - protein, 350 aa, Staphylococcus epidermidis RP62A
MKAAVWYGQKDVRVEDREPKAIKDNEVQVKVSWAGICGTDLHEYLEGPIFISTDQPDPLLGQTAPVTLGHEFSGVVENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELDNIVESGFNQLVNDKSQAKILVRLNGDQK

SEQ ID NO: 9884 - DNA, 1065 bp, Neisseria gonorrhoeae FA 1090
  CDS (1)..(1065): transl_table=11
atgaaagcagcacgtttttacaacaaaggcgacatccgcatcgaagacatccccgaaccgaccgtcgcccccggcaccgtcggcatcaatgtcgcctggtgcggcatctgcggtaccgacctgcacgaatttatggaaggcccgattttcatcccgccctgcggtcatccgcatccgatttccggcgagtccgcgcccgtaacgatgggacacgagttctccggcgtggtttatgccgtcggcgaaggcgtggacgacattaaagtcggccaacacgtcgtggtcgaaccctacatcatccgcgacgacgtaccgaccggcgaaggcagcaactaccacctctccaaagacatgaactttatcggcttgggcggctgcggcggcggcctgtccgaaaaaatcgccgtcaaacgccgttgggtgcatccgatttccgacaaaatcccgttggatcaagctgctttgattgaacctctgtctgtcggacaccacgcctatgtacgcagcggcgcgaaagcaggcgatgtcgcattggtcggcggcgcaggcccgatcggtttgctgttggccgccgtgttgaaagccaaaggcatcaaagtcatcattaccgagttgagtaaagcacgcaaagacaaagcccgcgaatccggcgttgccgactacatcctcgacccgtccgaagtcgatgttgttgaagaagtgaaaaaactgaccaacggcgaaggcgtggacgtggcgttcgaatgtaccagcgtgaacaaagtgttggatactttggtcgaagcctgcaaacccgccgccaacttggttatcgtatccatctggagccaccccgccaccgtcaacgtccacagcgtcgtgatgaaagaactggatgtgcgcggcacgattgcctactgcaacgaccacgcggaaaccatcaaactggtcgaagaaggcaaaatcaacctcgaacccttcatcacccagcgcatcaagctggacaaactggtttccgaaggcttcgagcgtctgatccacaacaacgaatccgccgttaaaattattgtgaatccaaacctgtaa

SEQ ID NO: 9885 - protein, 354 aa, Neisseria gonorrhoeae FA 1090
MKAARFYNKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKAGDVALVGGAGPIGLLLAAVLKAKGIKVIITELSKARKDKARESGVADYILDPSEVDVVEEVKKLTNGEGVDVAFECTSVNKVLDTLVEACKPAANLVIVSIWSHPATVNVHSVVMKELDVRGTIAYCNDHAETIKLVEEGKINLEPFITQRIKLDKLVSEGFERLIHNNESAVKIIVNPNL

SEQ ID NO: 9886 - DNA, 1029 bp, Haemophilus influenzae 86-028NP
  CDS (1)..(1029): transl_table=11
atgaaggagcgaatcaaagcaatatgcttagaaaaaccaaacaatgtagttgttaaagaagtgccttatcccgagaaaagtgataatgatgtacttattcaggtagaatcaatggggatttgtggttctgatattggtgcatatagaggaactaatccattagtaacttatccaagaatacttgggcatgaaattgtagggagagtaattgaaagtggaattggtatgccggatagggtgagggttggagaccgagtaattgttgatccttatgttttttgtggtcaatgctatccttgttcaattggtagaaccaattgttgtgaatcattaaaggtaattggtgttcatattgatggaggtatgcaagaggtaattagacatcccgctcatcttttaactaaagtcccagataacctaccgattcatcaattacctttagctgaacctttaacaatagctttacatgctttacatagaacaactttaaaatcaggggaacacatagtaattattggagctggtgcaattggattaatggcagcattagcagcggttcaatatggagcaatcccaattttagttgatatattagaacaacgtcttgagtatgcaaaatccttgggaattgaacatattgtaaatccgcataaggaggatgacattaaaagaattaaggaaattacaagtggtcgtatggcagaagttgttatggaggcatctggtgctaatatttctatcaaaaatactctgcattatacctcctttgcaggaagaattgctttaacaggatggccaaaaacagaaactccattaccaacaaatttaattacctttaaagaattgaatatttatggttctagaacaagcaagggggaatttgaggaggcattggatatgcttgctactaataaaattaatgcatctcatatcattactaagtgtatcaaatttgaagaaattcctagttttatttctgatttatctgatcatccagaaaattatttaaaaattaatgcagttttctaa

SEQ ID NO: 9887 - protein, 342 aa, Haemophilus influenzae 86-028NP
MKERIKAICLEKPNNVVVKEVPYPEKSDNDVLIQVESMGICGSDIGAYRGTNPLVTYPRILGHEIVGRVIESGIGMPDRVRVGDRVIVDPYVFCGQCYPCSIGRTNCCESLKVIGVHIDGGMQEVIRHPAHLLTKVPDNLPIHQLPLAEPLTIALHALHRTTLKSGEHIVIIGAGAIGLMAALAAVQYGAIPILVDILEQRLEYAKSLGIEHIVNPHKEDDIKRIKEITSGRMAEVVMEASGANISIKNTLHYTSFAGRIALTGWPKTETPLPTNLITFKELNIYGSRTSKGEFEEALDMLATNKINASHIITKCIKFEEIPSFISDLSDHPENYLKINAVF

SEQ ID NO: 9888 - DNA, 1104 bp, Pseudomonas fluorescens Pf-5
  CDS (1)..(1104): transl_table=11
atgagtgtttccctcaagcctgtttccagcatgcgtgccgcggtctggcacggccgccacgatatccgcgtcgaagacgtaccgctgcccgacgcgccgcctgccggctgggtgcagatccgcgttgactggtgcggcatctgcggctccgacctgcacgaatacgtggccgggccggtgttcattccggtggacgcaccgcacccgctgaccgggatcaagggccagtgcatcctcggccacgagttctgcggcgaaatcgtcgccctgggcgaaggggtccagggtttcagcgttggccagccggtggccgccgacgcctgccagcactgcggcacctgctactactgcacccacggcctgtacaacatctgcgaaaacctggcctttaccgggctgatgaacaacggcgccttcgccgaattggtcaacgtgccggccaacctgctgtacgccttgccggccaactttcccgccgaggccggagcgctgatcgagccgctggcggtgggcatgcacgcggtgaaaaaagccggcagtttgttggggcagaacgtggtggtggtcggcgccggcaccatcggcctgtgcaccatcatgtgcgccaaggccgccggcgcggcccaggtgatcgccctggaaatgtccggcgcgcgcaaggccaaggccctggaggtgggcgcgacccacgtgctcgaccccaaggagtgcgatgccctggccgaggtcaagcgcctgaccggcgggctgggggccgatgtcagctttgagtgcataggcaacaagcacaccgccaagctggccatcgacctgatccgcaaggccggcaagtgcgtgctggtggggatattcgaagagcccagcgagttcaacttcttcgagctggtggccaccgagaaaacggtgctgggggccctggcctacaacggtgagttcgccgatgtgatcgcctttatcgccgatggccggctggatatttcgcccctggtgaccgggcgcatccagctggaagagattgtcggccagggcttcgaggaactggtcaacaacaaggagcacaacgtcaagatcatcgtgtcccccggtcagttgcgacgctcgtaa

SEQ ID NO: 9889 - protein, 367 aa, Pseudomonas fluorescens Pf-5
MSVSLKPVSSMRAAVWHGRHDIRVEDVPLPDAPPAGWVQIRVDWCGICGSDLHEYVAGPVFIPVDAPHPLTGIKGQCILGHEFCGEIVALGEGVQGFSVGQPVAADACQHCGTCYYCTHGLYNICENLAFTGLMNNGAFAELVNVPANLLYALPANFPAEAGALIEPLAVGMHAVKKAGSLLGQNVVVVGAGTIGLCTIMCAKAAGAAQVIALEMSGARKAKALEVGATHVLDPKECDALAEVKRLTGGLGADVSFECIGNKHTAKLAIDLIRKAGKCVLVGIFEEPSEFNFFELVATEKTVLGALAYNGEFADVIAFIADGRLDISPLVTGRIQLEEIVGQGFEELVNNKEHNVKIIVSPGQLRRS

SEQ ID NO: 9890 - DNA, 1026 bp, Colwellia psychrerythraea 34H
  CDS (1)..(1026): transl_table=11
atgaaatctttagctaaattaaaagcagaaccgggcatttggttaacgcgaaccgaaaaaccaaaactaggtcataatgatctgctaatcaaaattaaaaaaacggccatttgtggtacagatatccacatttataattgggatgaatgggcacaaaaaacagtgcctacgcctatggttgttggacatgagtacgcaggtgaagtggttggtatcggccaagaagttaaaggctttactttaggtgaccgggtttctggtgaaggccatattacttgtggtcattgccgtaattgtcgtggtggcagaactcatttatgtcgtaataccgttggtgttggggtcaatcgtgcggggtcatttgcagagtatctagtgatacctgcatacaatgcctttaaattacctgacgaaatttctgatgatttagcgtcaatttttgacccctttggtaatgcagttcataccgcattgtcatttgatttagtgggtgaggatgtattaatcaccggtgctggccctattggtattatggctgcagccgttgctaaacatgtaggtgctcgtcatgtcgttattaccgatattaacgaatatcgtcttgaccttgcaagaaaaatgggcgctactcgtgctgttgatgtgagtaaagaaagcttaaaagatgtcatgaccgatttggggatgaccgagggttttgatgttggtatggaaatgtcaggtgttccaatggcattcactagcatgttagaaagcatgaataatggtggtaaaattgccatgctgggtattcctggtagcgatatggctattgattggagccaagttatttttaaagggcttaccattaaaggtatttatggtcgtgaaatgttcgaaacttggtataagatggcaagtttgattcaatctggtttagatctcaccccgattattacccatcactacaatatcgatgactttcagcaaggctttgatatgatgcgttctggtcaatctggcaaggtcattttagattggacttaa

SEQ ID NO: 9891 - protein, 341 aa, Colwellia psychrerythraea 34H
MKSLAKLKAEPGIWLTRTEKPKLGHNDLLIKIKKTAICGTDIHIYNWDEWAQKTVPTPMVVGHEYAGEVVGIGQEVKGFTLGDRVSGEGHITCGHCRNCRGGRTHLCRNTVGVGVNRAGSFAEYLVIPAYNAFKLPDEISDDLASIFDPFGNAVHTALSFDLVGEDVLITGAGPIGIMAAAVAKHVGARHVVITDINEYRLDLARKMGATRAVDVSKESLKDVMTDLGMTEGFDVGMEMSGVPMAFTSMLESMNNGGKIAMLGIPGSDMAIDWSQVIFKGLTIKGIYGREMFETWYKMASLIQSGLDLTPIITHHYNIDDFQQGFDMMRSGQSGKVILDWT

SEQ ID NO: 9892 - DNA, 1131 bp, Colwellia psychrerythraea 34H
  CDS (1)..(1131): transl_table=11
atgtcagataaatttattaaatcgaaagctgctattgcttggggtcctaatcaacccttatccattgaagaagttgatgtaatgttacctcgtgaaggtgaagtgttagttaaggttgttgcatcgggcgtttgtcataccgatgcttttaccttatcaggcgatgatcctgaaggtattttccctgttattttagggcacgaaggtggtggtattgttgagcaaattggcgcaggcgttactagcgttaaagttggcgatcatgttatcccgttatacacaccagagtgtggtgagtgtaaattctgcttgtcaggtaaaacaaacctttgtcaaaaaattcgtgaaactcagggtaaaggtttaatgcctgatggcaccacgcgtttttataaagacggtcaacctatctttcattacatgggatgttcaaccttttctgaatacacagttctaccagagatctctttagctaaagtcaataaagatgcaccgttagaagaagtttgtttgcttggttgtggtgttactaccggtatgggcgcggtcatgaatacggcgaaagttgaagaaggtgcaacagttgcaatctttggccttggcggcattggtttatcagcggttattggtgcaactatggctaaagcgagtcgtattattgccattgatattaacgaaagtaaatttgagctagcaaaaaaattaggcgcaacagactttattaacccgaaagactatgacaagccaattcaagatgtgattgttgaaatgactgatggcggtgttgattattcttttgaatgtattggtaacgtaaacctaatgcgctcagcgctagagtgttgccataaaggctggggagaatcagtagtcataggtgttgcgggtgcaggacaagaaatctcaactcgtccattccagttagtgactggtcgtgtatggagaggatctgcatttggtggtgttaaaggccgtactgaattacctgattacgtagaacgttatttagcgggtgaattcaaattaagtgactttattactcatactatgcctcttgaagacattaatgaatcatttgaattgatgcataaaggcgaaagtatccgttcagtgattcattttgataaataa

SEQ ID NO: 9893 - protein, 376 aa, Colwellia psychrerythraea 34H
MSDKFIKSKAAIAWGPNQPLSIEEVDVMLPREGEVLVKVVASGVCHTDAFTLSGDDPEGIFPVILGHEGGGIVEQIGAGVTSVKVGDHVIPLYTPECGECKFCLSGKTNLCQKIRETQGKGLMPDGTTRFYKDGQPIFHYMGCSTFSEYTVLPEISLAKVNKDAPLEEVCLLGCGVTTGMGAVMNTAKVEEGATVAIFGLGGIGLSAVIGATMAKASRIIAIDINESKFELAKKLGATDFINPKDYDKPIQDVIVEMTDGGVDYSFECIGNVNLMRSALECCHKGWGESVVIGVAGAGQEISTRPFQLVTGRVWRGSAFGGVKGRTELPDYVERYLAGEFKLSDFITHTMPLEDINESFELMHKGESIRSVIHFDK

SEQ ID NO: 9894 - DNA, 1113 bp, Pseudomonas fluorescens PfO-1
  CDS (1)..(1113): transl_table=11
atgatcaagtcgcgcgccgccgttgccttcgaggccaaaaagccgctggaaatcgtagaagtcgatgtcgccatgcccaaggccggtgaagtattgctgcgcgtggtggcttccggggtttgccacactgacgcttacaccctgtccggcgcggacccggaaggtatcttcccgtcgatcctcggccacgaaggcggcgctatcgtcgaagcgatcggcgaaggcgtgacatccgtggccgtcggtgatcacgtgattccgctttacaccccggaatgcggtcagtgcaaattctgtaagtcgggcaagaccaacctgtgtcaggcgattcgcgccacccagggcaagggcctgatgccggacggcacttcgcgcttttcctacaagggccaaacgattttccactacatgggtacttcgacgttctccgagtacaccgtgctgccggaaatctccgtggccaagatctccaaggatgcgccgctggaaaaggtctgcctgctcggttgcggcgtgaccaccggtatcggtgcggtgatcaacaccgccaaggtcaaaccgggtgacaccgtggccatcttcggtctcggcggcatcggactgtcggccgtgatcggcgcggtgaaggccaaggcctcacggatcatcgccatcgacatcaacccggccaagttcgaaatcgccaaacaattgggtgccaccgactgcgtgaacccgaaagacttcgatcgtccgatccaggaagtgatcgtcgacatgaccgatggcggcgtcgacttctccttcgaatgcatcggcaacgtgcaacttatgcgcgcagccctcgagtgctgccataaaggctggggcgagtcggtgatcatcggtgtggccggtgccggccaggaaatctccacccgtccgttccagctggtgaccggtcgcgtctggcgcggttccgcattcggcggcgtgcgtggtcgtaccgaattgccaagctacgtcgacatggcgcaaagcggcgaaatcccgctggatactttcatcactcacaccatgggcctggaagacatcaacaaggccttcgacctgatgcacgaaggcaagagcatccgtaccgtcattcatttctga

SEQ ID NO: 9895 - protein, 370 aa, Pseudomonas fluorescens PfO-1
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECGQCKFCKSGKTNLCQAIRATQGKGLMPDGTSRFSYKGQTIFHYMGTSTFSEYTVLPEISVAKISKDAPLEKVCLLGCGVTTGIGAVINTAKVKPGDTVAIFGLGGIGLSAVIGAVKAKASRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRTELPSYVDMAQSGEIPLDTFITHTMGLEDINKAFDLMHEGKSIRTVIHF

SEQ ID NO: 9896 - DNA, 1038 bp, Carboxydothermus hydrogenoformans Z-2901
  CDS (1)..(1038): transl_table=11
atgaaagctgcggtattaatggagccgaaaaaaataatttttaaagaagtcccagtaccagaactggaaaaaggtaaggtgcttattaaagtagaggcggttggcatttgtgggagcgatatgcatctttatcttgacgggcacataggggcaacagttctggataaaccattagtgttaggacatgaaatcgtaggcacggttattgaagtgggtgaaggagttaatagagaattattaggccaaagagtaattgttgatcctggtgaaaattgtggacaatgtgagcactgtcggacgggggcttataacctgtgttcattttccaaatttaaaggtattccaccagtagatggtggaatggcggagtatataacagcattggctacgcatgttataccgctacctgaaaaccttgattcaccaacagctacgttattagaaccatttagtgttggtttacaagctgtagatgtggctgattttcgagctggagctaaaattgcagttttaggtggaggacctgtaggagtgttaacagcaattgctgcaaaaattagagggtgtggtgacttatggctaactgaattatacgaaagaagaatagaaattgcccgaaaattgggaatagaaaaggtaatcaacgtagctcaagaggacccattgaaaacaataatggaagtcactaaaaaatcaggtgtggatgttgtttttgaaactactggaaatcctaaagctgtcgaacaagcgcttcagattgtaaaacggggaggtacggtggtatttctggggattggtgcaggaaaagtccctattaatattgatcaagtgacaagaacaggtcttaaacttttggggagttttcgctatcaatatcactttgctggagcagttgccttggtaaaaaaacataacctagacttttctccccttgtcaccaatatctacgactttgtagatatacctaaagctttagaagaagtttcaacttataaagacagaattatgaagggagtaatagtctttccccaaaaataa

SEQ ID NO: 9897 - protein, 345 aa, Carboxydothermus hydrogenoformans Z-2901
MKAAVLMEPKKIIFKEVPVPELEKGKVLIKVEAVGICGSDMHLYLDGHIGATVLDKPLVLGHEIVGTVIEVGEGVNRELLGQRVIVDPGENCGQCEHCRTGAYNLCSFSKFKGIPPVDGGMAEYITALATHVIPLPENLDSPTATLLEPFSVGLQAVDVADFRAGAKIAVLGGGPVGVLTAIAAKIRGCGDLWLTELYERRIEIARKLGIEKVINVAQEDPLKTIMEVTKKSGVDVVFETTGNPKAVEQALQIVKRGGTVVFLGIGAGKVPINIDQVTRTGLKLLGSFRYQYHFAGAVALVKKHNLDFSPLVTNIYDFVDIPKALEEVSTYKDRIMKGVIVFPQK

SEQ ID NO: 9898 - DNA, 1059 bp, Burkholderia sp. 383
  CDS (1)..(1059): transl_table=11
atgcgtatgcgttgcatgtgtgtcgtgatccacgggccgaacgacctgcgggtggaagagcaggacgcgggcgagatcggcccgggccaggtgcgtgtcgatgtcgcgatgggcggcatctgcggctccgatctccattacttccggcacggcggtttcggtgcgatccggctgcagcagccgatggtgctcggccacgaggtggccggcacggtcgcggaagtggcgccggacgtgacgtcggtgaaggtcggcgatcgcgtcgcggtcaatccgagccggccgtgcggcgcatgccgctactgcctcgaagggctgccgaaccagtgtctcgacatgcgcttctacggcagcgcgatgcggatgccgcacgtgcagggcgcgttccgcaatgcactcgtgtgcgacgcggtgcagtgcgtgaaggtcgccgatcacgtgccgctgtcgctcgcggcgctcgccgaaccgttcgcggtcgggctgcacgcggtgtcgcgcgcgggcccgctgatcggcaagcgcgtgctcgtgtcgggctgcgggccgatcggcgtgctggcggttgcggcggcgcgcgtgcacggcgcggcggagatcgtcgcgaccgacgtggtcgaggcgccgctcgaagtggcgagcgcgctcggcgccgaccgcacgatcaatgcggcgaccgatgccggctgggtcgagcgttacgctgccgacaagggcacgttcgacgtgatgatcgagtgttcgggcaatgcgcgcgcgttgcgcgacgggctggacgtgatgcgtccgcgcggcgtcgtcgtgcagctcgggcttggcggcgatgtcagcctgccgcagaacgtcgtggtcgcgaaggagctgtcgatctgcggatcgttccgttttcatgcggaattcgcgctcgcggtgcagctgatcaacgcggggcgcgtcgacctgcgcccggccgtcacgcgcgtgttcccgatgcgcgatgcgaacctcgcgttcgaactggccggcgaccggcagcgcgcgatgaaggtgctgatcgacttcgcggacgaggctgcatga

SEQ ID NO: 9899 - protein, 352 aa, Burkholderia sp. 383
MRMRCMCVVIHGPNDLRVEEQDAGEIGPGQVRVDVAMGGICGSDLHYFRHGGFGAIRLQQPMVLGHEVAGTVAEVAPDVTSVKVGDRVAVNPSRPCGACRYCLEGLPNQCLDMRFYGSAMRMPHVQGAFRNALVCDAVQCVKVADHVPLSLAALAEPFAVGLHAVSRAGPLIGKRVLVSGCGPIGVLAVAAARVHGAAEIVATDVVEAPLEVASALGADRTINAATDAGWVERYAADKGTFDVMIECSGNARALRDGLDVMRPRGVVVQLGLGGDVSLPQNVVVAKELSICGSFRFHAEFALAVQLINAGRVDLRPAVTRVFPMRDANLAFELAGDRQRAMKVLIDFADEAA

SEQ ID NO: 9900 - DNA, 1107 bp, Burkholderia sp. 383
  CDS (1)..(1107): transl_table=11
atgaagacgaaagcagcgattgcatggaaggcgggcgcgccgctgacgatcgaggaagtcgatctggaagggccgcgcgccggcgaagtgctgatcgaggtgaaggcgacgggcatctgtcacaccgactactacacgctgtcgggcgccgatccggaagggatcttcccggcgatcctcggccatgaaggcgcgggcgtcgtggtcgacgtcggccccggcgtcggcaccctgcgcaagggcgaccacgtgattccgctctacacgccggaatgccgcgagtgcaagttctgcctgtcgcgcaagaccaacctgtgccagaagatccgcgcgacgcagggcaaggggttgatgcccgacgcgacgtcgcgcttctcgctcgacggcaagccgctgttccactacatgggcacgtcgacgttctcgaactacatcgtcgtgccggagatcgcggtcgcgaaggtgcgcgaggacgcgccgttcgacaagatctgctacatcggctgcggcgtgacgacgggcgtcggcgcggtcgtgtactcggcgaaggtcgaagccggcgcgaacgtcgtcgtgttcggcctcggcggcattggcctgaacgtgatccagggcgcgaagatggtcggcgcggacaagatcatcggcgtcgacatcaacccgaagcgcgtcgaactcgcgaagaagttcgggatgacgcatttcatcaacccgaacgaagtcgagaacgtggtcgaccacatcgtgcagctgaccgacggcggcgcggactactcgttcgaatgcgtgggcaacgtgaagctgatgcgccaggcgctcgagtgcacgcacaagggctggggccagtcgttcatcatcggcgtggcggcagcgggcgaggaaatcagcacgcgtccgttccagctcgtgacgggccgcgaatggaagggctcggcgttcggcggcgcgcgcggccgcaccgacgtgccgaagatcgtcgactggtacatggaaggcaagatcaacatcgacgacctgatcacgcacacgctgccgctcgagcggatcaacgaaggcttcgacctgatgaaggccggcgagtcgatccgttcggtcgtgctgtactga

SEQ ID NO: 9901 - protein, 368 aa, Burkholderia sp. 383
MKTKAAIAWKAGAPLTIEEVDLEGPRAGEVLIEVKATGICHTDYYTLSGADPEGIFPAILGHEGAGVVVDVGPGVGTLRKGDHVIPLYTPECRECKFCLSRKTNLCQKIRATQGKGLMPDATSRFSLDGKPLFHYMGTSTFSNYIVVPEIAVAKVREDAPFDKICYIGCGVTTGVGAVVYSAKVEAGANVVVFGLGGIGLNVIQGAKMVGADKIIGVDINPKRVELAKKFGMTHFINPNEVENVVDHIVQLTDGGADYSFECVGNVKLMRQALECTHKGWGQSFIIGVAAAGEEISTRPFQLVTGREWKGSAFGGARGRTDVPKIVDWYMEGKINIDDLITHTLPLERINEGFDLMKAGESIRSVVLY

SEQ ID NO: 9902 - DNA, 1065 bp, Burkholderia sp. 383
  CDS (1)..(1065): transl_table=11
atgaaagctgccgtctggcacggccgccacgacatccgcgtcgaacaggttcccgttccggagcgcccgccggcaggctgggtcacgattcgcgtgcactggtgcgggatctgcggctccgacctgcacgaatacgtcgcgggccccgtcttcatcccggtcgacgcgccgcatccgctgacgggcctgaagggccaatgcatcctcggccacgagttcagcggcgagatcgccgaactcggtgcgggcgtgacgggcttcgcggtcggcgaccgcgtgacggccgacgcctgccagcattgcggcacctgctggtattgcaagcatgggctgtacaacatctgcgaaaacctcgcgttcaccgggctgatgaacaacggcgcattcgccgaatacgtgaacgtgccggccgagttgctgtacaagctgcccgacgatttcccgaccgaggccggcgcgctgatcgaaccgctcgcggtcgggctgcatgcggtgaagaaggccggcaacatcgtcgggcagaccgtcgtcgtggtcggcgcgggcacgatcggcctgtgcacgatcatgtgcgcgaaggccgcgggcgccgggcgcgtgatcgcgctggaaatgtcggccgcgcgcaagcagaaggcgctggaagtcggcgcgagcgtcgtcatcgatccgaagacgtccgatgcgatcgcggaagtcaaggcgctgaccggcggctacggcgccgacgtgtcgttcgagtgcatcgggcacaccaccaccgcgaagctcgcgatcgacgtgatccgcaaggccggcaagtcggtgatggtcggcatcttcgaggagcccgcgccgttcaacttcttcgacatcgtgtcgaccgagaaggaagtgatcggctcgctcgcgtacaacggcgaattcgcggacgtgatccgcttcatcgcggacggccgcatcgacgtgcagccgctcatcaccggacgcatcgcgctcggcgacatcgtctcgcacggcttcgaggaactggtcaaccacaaggaacggaacgtgaagatcatcgtccagcccgccctcgcctga

SEQ ID NO: 9903 - protein, 354 aa, Burkholderia sp. 383
MKAAVWHGRHDIRVEQVPVPERPPAGWVTIRVHWCGICGSDLHEYVAGPVFIPVDAPHPLTGLKGQCILGHEFSGEIAELGAGVTGFAVGDRVTADACQHCGTCWYCKHGLYNICENLAFTGLMNNGAFAEYVNVPAELLYKLPDDFPTEAGALIEPLAVGLHAVKKAGNIVGQTVVVVGAGTIGLCTIMCAKAAGAGRVIALEMSAARKQKALEVGASVVIDPKTSDAIAEVKALTGGYGADVSFECIGHTTTAKLAIDVIRKAGKSVMVGIFEEPAPFNFFDIVSTEKEVIGSLAYNGEFADVIRFIADGRIDVQPLITGRIALGDIVSHGFEELVNHKERNVKIIVQPALA

SEQ ID NO: 9904 - DNA, 1035 bp, Burkholderia sp. 383
  CDS (1)..(1035): transl_table=11
ttgaaagcgctcgtactcgaacgcacgcgcgagctcgcgctgcgcgacatcgacttgccgcaagaagtcggccccggcgacgtccggatcaaggtccacaccgtcggcgtgtgcggcagcgacgtgcattactacgttcacggcgggatcggcccgttccgcgtcgacgcgccgatggtgctcggccacgaggcgtccggtaccgtcgtcgagaccggcgccggcgtcacgcacctgcgggtcggcgaccgcgtgtgcatggagcccggcgtgccgcgcttcgattcgcccgcgacgctgcgcgggctctacaacctcgatcccgatgtgcgcttctgggcgacacctcccatacacggctgcctgacgccgtacgtcgtgcatccggccgcgttcacgtaccggttgcccgacaccgtgtcgttcgccgaaggcgcgatcgtcgagccgctgtcgatcggcctgcaggccgcgaaaaaagcggcgatgaagccgggcgacctcgcggtcgtgatcggcgccggcacgatcggcgcgatgacggcgcttgccgcgctcgccggcggcgccgcgcgcgtgatcctcgccgacgtcgtacccgacaagctcgcgctgttcgccgacaacccggccgtcacgaccgtcgacgtgcgcacgcagccgctcgccgacgtggtggccgaagcaacggacggctggggcgcggacgtcgtgttcgaggccagcggcagcgcgaatgcgtatgcgggcctcgtcgacctgatgtgcccgggcggctgcgcggtgctgatcgggatgccggtcgccccggtgccgctcgacgtggtcgcgctgcaggcgaaggaaggccgcatcgaatcggtgttccgctacgcgaacatctttccgcgcgcgctcgcgctgatcgcgtccggcgcgatcgacgtgaagccgttcatctcgcgcacgttcccgttttccgaaggcgtgcgcgcattcgaggaagcggcgagcggccacccgcgcgacgtcaagattcagatcgaaatggattga

SEQ ID NO: 9905 - protein, 344 aa, Burkholderia sp. 383
MKALVLERTRELALRDIDLPQEVGPGDVRIKVHTVGVCGSDVHYYVHGGIGPFRVDAPMVLGHEASGTVVETGAGVTHLRVGDRVCMEPGVPRFDSPATLRGLYNLDPDVRFWATPPIHGCLTPYVVHPAAFTYRLPDTVSFAEGAIVEPLSIGLQAAKKAAMKPGDLAVVIGAGTIGAMTALAALAGGAARVILADVVPDKLALFADNPAVTTVDVRTQPLADVVAEATDGWGADVVFEASGSANAYAGLVDLMCPGGCAVLIGMPVAPVPLDVVALQAKEGRIESVFRYANIFPRALALIASGAIDVKPFISRTFPFSEGVRAFEEAASGHPRDVKIQIEMD

SEQ ID NO: 9906 - DNA, 1122 bp, Burkholderia sp. 383
  CDS (1)..(1122): transl_table=11
atgcgagcacttcaatggcatggcccgcgcgacgtccgtctcgtggaaatcgacacgccgcgcgtcggcccaggcgacgtgcgcatcgcggtcgcgtattgcgggatctgcggcagcgacctgcacgaatatgcggacggcccgcacgcgatcccggtcgacacgccgcatccgctgtctcgccgtaccgcgccgctgacgctcggccacgagttctgcggcaccgtcgtcgaagtcggcgaaggcgtgacggcgctgcgcgcgggcgatcgcgtcgcggtcgagcccgagtatcgctgcagccagtgcgcgtactgccgctcggggtcgtacaacctgtgcgtgtcgatgggcttcgccgggctgatgggcgacggcggcatggccgacttcgcggtcgtgccggcgtacatgctgcatcgcttgcccgacggcgtgagtctcgaacaggccgcggtgatggagccggcggccgtcgcgctgcacgcgttgcggcgtggcgagctgcggctcggcgaaacctgtgcggtgttcggcctcgggccgatcggcctgttgctgatcatgctcgcgaagctgcagggcgcgaccacgatcgtggctgtcgatgtctcgcccgaacggctcgcggcggccacgcgcttcggcgcaacgcatacgttcgatgcacgcgcactcggtgcatccgcactgcaggacgcgatccgcgcggccacgggcgggctcggcgtcgatgcgagtttcgaagcggccgggctgcagacaacgttcgaatcggcgatgcacgcgctgcgcaagggtggacgcatcgtgatggtcggcctgatgccgcatgcgggcttcgacgcgttccgcgcggtcaacgacgagctgaccttcacggcgagcgtcggctaccggcatgcgtacgaagacctgctgcgcatcgtcgcgtcgggtgcgctcgacctcacgtcgatcgtcacgcgcaccgtgtcgctcgaagacgccgtcgccgacggcttcgacgcgctgctcgccgaccgcgcgcagatcaagatcctcgtttcacccgcgcaacggcctccccgtcgcgcgcacaccatcgggagcatcgagcatgagtcgtcagtgggcgtttga

SEQ ID NO: 9907 - protein, 373 aa, Burkholderia sp. 383
MRALQWHGPRDVRLVEIDTPRVGPGDVRIAVAYCGICGSDLHEYADGPHAIPVDTPHPLSRRTAPLTLGHEFCGTVVEVGEGVTALRAGDRVAVEPEYRCSQCAYCRSGSYNLCVSMGFAGLMGDGGMADFAVVPAYMLHRLPDGVSLEQAAVMEPAAVALHALRRGELRLGETCAVFGLGPIGLLLIMLAKLQGATTIVAVDVSPERLAAATRFGATHTFDARALGASALQDAIRAATGGLGVDASFEAAGLQTTFESAMHALRKGGRIVMVGLMPHAGFDAFRAVNDELTFTASVGYRHAYEDLLRIVASGALDLTSIVTRTVSLEDAVADGFDALLADRAQIKILVSPAQRPPRRAHTIGSIEHESSVGV

SEQ ID NO: 9908 - DNA, 1044 bp, Rhodospirillum rubrum ATCC 11170
  CDS (1)..(1044): transl_table=11
atgaaagtgacgggcgttgttctcgagcgtcagggtgcgctctcgcttagggatattgatattcccggcacattggcgcccggggccaatgaggtccgcattgccatcaaatccgtggggatttgcggcagcgatgtccactatttcaagcatggccgcattggcgacttcatcgtcaccgagccgatgatcctggggcatgaagcctcgggcgtcgtagaggaaatcggctcggcggtgacccatctgcgcgttggcgaccgggtgtgcatggagccgggcgttcccgacttctcgtcgatcgaaaccctgcgcggcatgtacaatcttgatccctcggtgcgcttctgggcgacgccgccctatcatggctgcttgaccgccgaggtcgtccaccccgcctcgctcacctatcgcctgcccgactccgtcagcttcgccgaaggcgccatggtcgaaccgctggccatcggcgtctatgccgccgccaaggcgcagatccgcccgggcgacatcgccgtcgtcaccggcgcgggcaccatcggcatgatggtggtcttcgccgcgctggccgccggctgcgccgaggtcatcgtcagcgatgtggcggccgagaagctggcccttttggccagccatcccgaggtcaccaccgttgacctcacccgcgaaagcctggccgacgccgtggcggcgcggaccgatggccgtggcgtcgacgtgttcttcgaagccagcggcagcacccgcccctatgagacgatgatcgatctgatcggccggggcggccgcatcgtcctcgtcggcatgccccaggaaaagccccagttggatgtagtcgccctgcaggtcaaggaaatcagcctgacgggcaccttccgctacgccaatgtctgggaccggaccttgaagctgcttggcagcggcaagatcgacctcaaaccgttgatttcggccaccttccccttcagtgactcggtccgtgccttcgaccgcgccgcccagcacctgccatccgacgtcaagatccagatctccctgtga

SEQ ID NO: 9909 - protein, 347 aa, Rhodospirillum rubrum ATCC 11170
MKVTGVVLERQGALSLRDIDIPGTLAPGANEVRIAIKSVGICGSDVHYFKHGRIGDFIVTEPMILGHEASGVVEEIGSAVTHLRVGDRVCMEPGVPDFSSIETLRGMYNLDPSVRFWATPPYHGCLTAEVVHPASLTYRLPDSVSFAEGAMVEPLAIGVYAAAKAQIRPGDIAVVTGAGTIGMMVVFAALAAGCAEVIVSDVAAEKLALLASHPEVTTVDLTRESLADAVAARTDGRGVDVFFEASGSTRPYETMIDLIGRGGRIVLVGMPQEKPQLDVVALQVKEISLTGTFRYANVWDRTLKLLGSGKIDLKPLISATFPFSDSVRAFDRAAQHLPSDVKIQISL

SEQ ID NO: 9910 - DNA, 1038 bp, Moorella thermoacetica ATCC 39073
  CDS (1)..(1038): transl_table=11
atgaaggctttagtgtttgagggacctaacgagcttaagctaagagatgtaccacttccggaaccgggagaggatgagattttagtaaaagttgctgcgtgtttaatctgtggtacagatcttagaatttttaggggggccaaaacaagaggggtccggataccctctattttgggccacgaatttgctggggttgttgaggcaactggagttaatgtaaaagaatttcatgttggtgatagagtaggtgtggcgcctgttattccctgccatacatgtttctattgtaaaaatggattagaaaacgtatgcgctaatcgtacagccctgggttacgagtatgaaggtgcatttgcagaatatgtatgtattccagcccctgcggttaaaggggggaatgtgtatcacttgccttccaacatttcccttgaggaagcagctttagcagagcctcttgcatgctgtttgaacggacatcataattctaaagtaaaattaggagatgtggttgtaattttaggcgcggggccaattggactaatgcacttgcaattagctaaaagttctggggccagttatgtaattatcagtgaacccaatgaacatcgacgtgctatagccaaagaattcggagcagatcgtgtagtagaccctcagaccgaggatctaaatagcatagttaaaaatgttactgatggattaggagcagatataatttttttggccataggcataccggccttagcacaggatgcccttacccttgtaaaaaaaggaggtacaattaatttctttgctggcttttctgttggtgacaaagcagcacttgatgtaaatctcattcattataacgaaataaaaatcactggtacaagtgctgcaaggcgtgatgactatagaaaggctctggatttaatcgcaaagggtaaagtaaaggcttctaaaatgatcacccatcgtttccctttagataaggcggaagaagcctttagaattgcaggatcaagtcaaggtattaaggtggcgattattccttga

SEQ ID NO: 9911 - protein, 345 aa, Moorella thermoacetica ATCC 39073
MKALVFEGPNELKLRDVPLPEPGEDEILVKVAACLICGTDLRIFRGAKTRGVRIPSILGHEFAGVVEATGVNVKEFHVGDRVGVAPVIPCHTCFYCKNGLENVCANRTALGYEYEGAFAEYVCIPAPAVKGGNVYHLPSNISLEEAALAEPLACCLNGHHNSKVKLGDVVVILGAGPIGLMHLQLAKSSGASYVIISEPNEHRRAIAKEFGADRVVDPQTEDLNSIVKNVTDGLGADIIFLAIGIPALAQDALTLVKKGGTINFFAGFSVGDKAALDVNLIHYNEIKITGTSAARRDDYRKALDLIAKGKVKASKMITHRFPLDKAEEAFRIAGSSQGIKVAIIP

SEQ ID NO: 9912 - DNA, 1035 bp, Burkholderia thailandensis E264
  CDS (1)..(1035): transl_table=11
ttgaaagccctcgtactcgaaaaggcgcgcgatctcgcgctgcgcgacatcgacctgccgctcgaggtcggccccgccgacgtcaagatccgcatccacacggtgggcgtctgcggcagcgacgtccactattacacgcacggcgggatcggcccgttccgggtcgacgcgccgatggtgctcggccacgaggcgtccggcacggtcgtcgaggtcgggcgcgacgtcacgcacctgcgcgcgggcgaccgcgtctgcatggaacccggcgtcccgcgcttcgattcgaaggcgacactgcacggcctctacaacctcgatccgtcggtgcgcttctgggcgacgccgcccgtgcacgggtgcctcgcgccctacgtcgtgcatccggcggcgttcacgtaccggctgccgcagaacgtgtcgttcgccgagggcgcgattgtcgagccgctcgcgatcgggctgcaggccgcgaagaaagcggcgatgaagccgggcgacatcgcggtcgtcgtcggcgcgggcacgatcggcgcgatgacggcgctcgccgcgctcgcgggcggcgccgcgcgcgtgattctggccgacgtcgtcaaggagaagctcgcgctgttcgcgtcgaaccgcgcggtgacgacggtcgacgcgagcacgcagtcgctcgccgacgcggtcgcgcacgcgaccgacggctggggcgcggacgtcgtgttcgaggcgagcggcaacgcgaaggcctatgcgggaatcgtcgatctgctgtgcccgaacggctgcctcgtgctggtcggcatgccgctcgaaccggtgccgctcgacgtcgtcgcgctgcaggcgaaggaggcgcggatcgaatcggtgttccgctacgcgaacgtctttccgcgcgcgctcgcgctgatcgaatccggcgcgatcgacgtgaagccgttcatctcgcgcacgttcccgttctcggacggcctgcgcgcattcgaggcggcggcgagcggccagccgcacgacgtgaagattcagatcgaaatggattga

SEQ ID NO: 9913 - protein, 344 aa, Burkholderia thailandensis E264
MKALVLEKARDLALRDIDLPLEVGPADVKIRIHTVGVCGSDVHYYTHGGIGPFRVDAPMVLGHEASGTVVEVGRDVTHLRAGDRVCMEPGVPRFDSKATLHGLYNLDPSVRFWATPPVHGCLAPYVVHPAAFTYRLPQNVSFAEGAIVEPLAIGLQAAKKAAMKPGDIAVVVGAGTIGAMTALAALAGGAARVILADVVKEKLALFASNRAVTTVDASTQSLADAVAHATDGWGADVVFEASGNAKAYAGIVDLLCPNGCLVLVGMPLEPVPLDVVALQAKEARIESVFRYANVFPRALALIESGAIDVKPFISRTFPFSDGLRAFEAAASGQPHDVKIQIEMD

SEQ ID NO: 9914 - DNA, 1017 bp, Saccharophagus degradans 2-40
  CDS (1)..(1017): transl_table=11
atgaaagctgcacaatatgcgggaaataaaagttttaacgttgtagatggcgctaaagtgccccccgcagaaggcgaggtgtgtctacaggttggttacactggtatatgcggtaccgatatgcatatttaccacggggttatggatcagcgtgtttctattccacaaattatcggccatgaaatgtcgggtacggtagtggaagtaggcgcaggggtgaccgactatacagtaggcgaccgcgtagttgttcggcctttagattactgtggcgattgcccagcgtgtaatgcagggcattctcatgtgtgccataacctaaagtttatgggcatagatagcccaggggccttccaaagctactggacagttaaagcgcgcacgcttcacgcattgccagacaatgtgagcttaaagcaaggtgcactaatcgagccgctgtctgttgcctgtcacgatgtagcgcgcacgcgtttgcaagcgggtgaaaaagcattagttattggtggtggcccaatcggtcaactcgtagccttagtagcaaaaagtgttggcgcagaggtaatgatttctgaggtgagcgaagcgcgcctaaagtttgccgcagagcgcggtattaaaaccgttaaccccgtaaccgacgatattgaagcggtagtaaaagagtggactggtggtaaaggcgcggacgcagtatttgaagtatctggcgtggctgcagcagtagaaaccatgaccaaagttgccgcagtgcgtggtcgtatttgtatggtggcaatccattcgcaaaagccacaggtagacctgtttcagttcttctggaaagagctagaactgctgggcgcgcgagtatacgaatcggcggacttcgagcacgctattgagcttgtggccagcggcaaaattgatgtggattcatttattagctcggtaaccagtttgaacgatataggtaccgcatttgccagcatggataacaacccagccggaatgaaagcgttagtggagtgtaattaa

SEQ ID NO: 9915 - protein, 338 aa, Saccharophagus degradans 2-40
MKAAQYAGNKSFNVVDGAKVPPAEGEVCLQVGYTGICGTDMHIYHGVMDQRVSIPQIIGHEMSGTVVEVGAGVTDYTVGDRVVVRPLDYCGDCPACNAGHSHVCHNLKFMGIDSPGAFQSYWTVKARTLHALPDNVSLKQGALIEPLSVACHDVARTRLQAGEKALVIGGGPIGQLVALVAKSVGAEVMISEVSEARLKFAAERGIKTVNPVTDDIEAVVKEWTGGKGADAVFEVSGVAAAVETMTKVAAVRGRICMVAIHSQKPQVDLFQFFWKELELLGARVYESADFEHAIELVASGKIDVDSFISSVTSLNDIGTAFASMDNNPAGMKALVECN

SEQ ID NO: 9916 - DNA, 1116 bp, Silicibacter sp. TM1040
  CDS (1)..(1116): transl_table=11
atgatcaaaacccgcgccgcagtggccctcgaagcaggcaagccgcttgaaatcatggaggtgaacctcgaaggccccaaggcgggcgaggttctcgtcgagatcaaggccactggcctctgccacaccgacgaattcacccgttcaggcgatgatcccgaaggtatctttcccgccattctcggccacgagggcgcaggcgttgtgattgaggtcggcgaaggcgtcaaaagtctgaagccaggcgatcatgtgatcccgctctatacgcccgaatgccgcgagtgcgattactgcctcaacccaaagaccaacctctgccaggcgatccgttcgacgcagggtcagggtcttctgcccgatggcacgacccgcttttcgctaccggacgggacgccgatccatcactacatgggctgctcgactttcgccaaccacacggttgtgcccgagatcgcgctcgccaagatccgtgaggacgcgccctttgacaaagtgtgctacatcggttgcggcgtcacgacgggcatcggtgctgtgatcaacacggccaaggtcgaaatcgggtcgactgcgatcgtgtttggccttggcgggattggtctcaacgttattcagggccttcgcttggccggtgcggaccagatcgtcggtgtggacctcaaccccggcaaggttgcgatggcggaaaaattcggcatgaccgattttgtaaacccctccgaagtcgagggtgatctggtggcgcaccttgttgagctcacgggcggcggtgcggattacacctttgacgccaccgggaatgtcagcgtcatgcgcactgcactcgaagcggcccacaaaggctggggcgagagcatcatcatcggcgtggctccggcgggcgcagagatttccacccgccccttccagcttgtgaccggccgttcctggcgcggcaccgcctttggcggcgcgtccggtcgcacagatgtgccaaagatcgtggactggtacatggacggcaagatcgagatcgatccgatgatcacccacaaactgacgcttgatcagatcaacgaagggtttgacctcatgcacgagggcaaatcgatccgagccgttgtcgagttctaa

SEQ ID NO: 9917 - protein, 371 aa, Silicibacter sp. TM1040
MIKTRAAVALEAGKPLEIMEVNLEGPKAGEVLVEIKATGLCHTDEFTRSGDDPEGIFPAILGHEGAGVVIEVGEGVKSLKPGDHVIPLYTPECRECDYCLNPKTNLCQAIRSTQGQGLLPDGTTRFSLPDGTPIHHYMGCSTFANHTVVPEIALAKIREDAPFDKVCYIGCGVTTGIGAVINTAKVEIGSTAIVFGLGGIGLNVIQGLRLAGADQIVGVDLNPGKVAMAEKFGMTDFVNPSEVEGDLVAHLVELTGGGADYTFDATGNVSVMRTALEAAHKGWGESIIIGVAPAGAEISTRPFQLVTGRSWRGTAFGGASGRTDVPKIVDWYMDGKIEIDPMITHKLTLDQINEGFDLMHEGKSIRAVVEF

SEQ ID NO: 9918 - DNA, 1074 bp, Rubrobacter xylanophilus DSM 9941
  CDS (1)..(1074): transl_table=11
atgccggagaagaagatgatgagggcggccgtgtaccgcgggccacgagagctgcgcgtcgagcccgtccccgttccggagatcgggccctccgacgtgctcgtgagggttcacagctgcggtatatgcggctcggatctgcacagctacaaggcggggatgtacatccggcccggccagatcatgggacacgagttcatgggcaccgtcgccgccgccggtgaggacgtggaaggtgtggaggagggcgaccgggtcaccggcttcagcatcggggtgtgcggtagctgctactggtgctcccgccagcagtacatcctgtgcccggaactcttccggaactccaccgggtatggccttccgggcgggttcgcagagtacgtcccgatccggaacgcggtggtcggtcagagcatacacccggtccccagcgagctcgacgacgagacggcggccaccacggagcccgtctccgtaggggtgggggccatcgaagcggccggggtgcgtccgggggacagggtggtcgtgctgggggcgggcatgatcggcaacgcctgcatgcaggcggccagggcggccggagcggggcaggttgcggtgatagacgtctctccggtccggctcgaggcggccaggagcctcggcgccgacgccgtcttcgacgcgaggaccggagacgccctgtcgtgggtgaaggagctgtggggggtcgggcgctaccacttcaacgagggcggcatggcggacgtcgtcgtcgaggccgccggcgcgcccgtgacggtccagcaggccttcgagatggtgcgcagcgggggggcgatcgtcttcgtgggcctgcccgaggagccggcgcccatcgacgtaaccaagatcgtgcacaagcagccgcgcatcgtgggttcgctgggcggggactttgccagggccatcgagctgatggccagcgggagcatccggacaaaggagcttatcacccacaggttcccgctcgaggacgccgccgaagccttcgagacccagctgcggacgggcgaggcgatgaaggtcatgatacaaccgcgggaggggtag

SEQ ID NO: 9919 - protein, 357 aa, Rubrobacter xylanophilus DSM 9941
MPEKKMMRAAVYRGPRELRVEPVPVPEIGPSDVLVRVHSCGICGSDLHSYKAGMYIRPGQIMGHEFMGTVAAAGEDVEGVEEGDRVTGFSIGVCGSCYWCSRQQYILCPELFRNSTGYGLPGGFAEYVPIRNAVVGQSIHPVPSELDDETAATTEPVSVGVGAIEAAGVRPGDRVVVLGAGMIGNACMQAARAAGAGQVAVIDVSPVRLEAARSLGADAVFDARTGDALSWVKELWGVGRYHFNEGGMADVVVEAAGAPVTVQQAFEMVRSGGAIVFVGLPEEPAPIDVTKIVHKQPRIVGSLGGDFARAIELMASGSIRTKELITHRFPLEDAAEAFETQLRTGEAMKVMIQPREG

SEQ ID NO: 9920 - DNA, 1035 bp, Mesorhizobium sp. BNC1
  CDS (1)..(1035): transl_table=11
atgaccaacatgatgaaggccttggtgaaggccaagcccgaggaagggctttggatggagcgggtgccgcttccggagatcggcccgaacgacgtgctgatcaaggtgaggaaagctgccatctgcggcacggacgtccatatctggaactgggacgaatgggcaagaaagaccgtgcccgtgccgctcgtcaccggccatgagttcgtcggcgaggtcgtggatgtcggctcagccgtgaccgaatacagaatcgggcagcgtgtttcgggcgaggggcacattgtctgcggccattgccgcaactgccgggccgggcgtggacatctctgccgaaacacgctgggcgtcggcgttcaccggccgggtgcctttgccgaatatatctcgctgccgcagcacaatgtcgtggcgatccccgacgacgtgccggacgagatcgccgcgattttcgatccgcttggaaacgcggtgcacaccgcgctctctttcgatctggtgggcgaggatgtgctggtgaccggagctggcccgatcggcattatgggcgcgctggtggcgcagtgcgtaggtgcgcgcaaagtggtcatcacggatatcaatccggggcgacttgcgctcgctaagaaactcggcgtgcgtcacgtggtgaatgccagggaagagaagctcaccgatgtaatgaggaagctcggcatgaccgagggcttcgacgtgggcctggagatgtccggctctgcctcggcgtttcgcgacatgatcgatgtcatgaacaatggcggcaaaatagcgatcctcggcatagcgccgacgggtttcgagatcgattggaacaaggtgattttcaagatgctccacctgaagggcatctacggccgggagatgttcgaaacctggtacaagatgatcgcgcttgtgcaggggcctctcgatatctccggcctgatcacgcaccgcatctctgccgatgattaccgcgaaggctttgccgccatgcgcagcggcgaggccggtaaggttgtaatggattggtga

SEQ ID NO: 9921 - protein, 344 aa, Mesorhizobium sp. BNC1
MTNMMKALVKAKPEEGLWMERVPLPEIGPNDVLIKVRKAAICGTDVHIWNWDEWARKTVPVPLVTGHEFVGEVVDVGSAVTEYRIGQRVSGEGHIVCGHCRNCRAGRGHLCRNTLGVGVHRPGAFAEYISLPQHNVVAIPDDVPDEIAAIFDPLGNAVHTALSFDLVGEDVLVTGAGPIGIMGALVAQCVGARKVVITDINPGRLALAKKLGVRHVVNAREEKLTDVMRKLGMTEGFDVGLEMSGSASAFRDMIDVMNNGGKIAILGIAPTGFEIDWNKVIFKMLHLKGIYGREMFETWYKMIALVQGPLDISGLITHRISADDYREGFAAMRSGEAGKVVMDW

SEQ ID NO: 9922 - DNA, 1047 bp, Clostridium perfringens ATCC 13124
  CDS (1)..(1047): transl_table=11
atggaaggtaaaatgaaagtagcagtaatgaatggaataggtaaaatggatttgattgaaagagatattccaatagtaaaggaaaatgaagttcttgttaaattagattatgttggaatttgtggatcagatcttcattattatgagaacggccgtattggagattatatagtggaaccaccatttgtattaggtcatgaaccaggtggagtagtagttgaagttggtaataaggtaaaacatttaaatattggagatagagtagcattagaaccaggaaaaacatgtggccattgtgagttttgtaaaacaggaagatataacttatgtccagatgtaatattttttgcaacaccaccagtagatggggtatttcaagaatatgtagcacatgaagcagatttatgttttaaacttcctgaaaatgtatcaacattagaaggagcattaattgaacctttggcagtagggtttcatgctgcaatacaaggtggtgctcgcattggacaaacagctgtagtaatgggggcaggatgtataggattagtatcaatgatggcattaaaagctatgggagtttcaaatgtctatatcgtagatattatggaaaaaagattggaaaaagctttagagctaggtgctacaggtataattaatgctaaagaaaaaaatgctatagaagaagtaatgaaaataacaaataataatggatgcgatttagtaatagaaacagctggaacagaaataacaacagtacaagcaattcatatggctaaaaagggaagtaatatagttttagttggatatagtaagagtggagaaatgacattaccaatgagtcttgtgctagataaagaacttacatttaaaactgtatttagatatcgtcatatttataatatggcaattgaagcagttgcaagtggaaaagttaacttaaagggtattataacaaatgaatttgatttagatgatgtacaaaaagctatggattatagtgttaataacaaagcggatatagtaaaggcagttataaaaattagataa

SEQ ID NO: 9923 - protein, 348 aa, Clostridium perfringens ATCC 13124
MEGKMKVAVMNGIGKMDLIERDIPIVKENEVLVKLDYVGICGSDLHYYENGRIGDYIVEPPFVLGHEPGGVVVEVGNKVKHLNIGDRVALEPGKTCGHCEFCKTGRYNLCPDVIFFATPPVDGVFQEYVAHEADLCFKLPENVSTLEGALIEPLAVGFHAAIQGGARIGQTAVVMGAGCIGLVSMMALKAMGVSNVYIVDIMEKRLEKALELGATGIINAKEKNAIEEVMKITNNNGCDLVIETAGTEITTVQAIHMAKKGSNIVLVGYSKSGEMTLPMSLVLDKELTFKTVFRYRHIYNMAIEAVASGKVNLKGIITNEFDLDDVQKAMDYSVNNKADIVKAVIKIR

SEQ ID NO: 9924 - DNA, 1005 bp, Rhodococcus sp. RHA1
  CDS (1)..(1005): transl_table=11
atgcgtgccagcgtgctcgtcgagccgggcgtgatcgagatccgggaacgccccgtgcccactcccgctcccggcgacgtcctggtccgcgtggcctcggtgggcgtctgcggatcggatgcccactactaccgcgagggccgcatcggcgagttcgtggtcgaacagccgatcgtgctgggccacgaggcgtcgggcacggtcgtgggtgtcggcgacggggtcccggcaacgcgtatcgggcagcgtgtctccatcgaaccgcagcgccccgacccggacaccgacgaatcccggcgcggtctctacaacctgtgcccgcacatgcagttctatgccaccccgccgatcgacggggcgctggccgaatacgtgaccatcggctcggcgttcgcccacgcgattccggacgagatgtccgaggatgcggccgcgctgtgcgagccgctgtccgtggccatcgccaccacccgcaaagccggagtgaccgccggatcccgtgttctgatcgcgggcgcgggaccgatcggaatcgccatggtgcagaccgccctcgcgttcggtgccaccgaagtggtcgtctcggacctcgatccccggcgccgcgacgtcgcaaccaaattcggcgccaccgcggtgctcgacccgcgcgagcaggacgtcgcgggactccacgtggacgcgttcgtcgacgcgtccggcgccccgagtgcggtgctggccgggatccaggccgtccggcctgcgggatccgtggttctggtgggcatgggcgcccccgagatgacgctgccggtccagaccattcagaaccgggagttggtgctgaccggggtattccgttacgccaacacctggccgacggcgatcgccctcgcgcggtcgggacgggtcgacctcgattcgatggtcaccggaaggtttccgctcgccgaggcggagcaagcactgaacgcagaccggacgccgggcagcctcaaggccgtcgtgcgcgtccaggaatga

SEQ ID NO: 9925 - protein, 334 aa, Rhodococcus sp. RHA1
MRASVLVEPGVIEIRERPVPTPAPGDVLVRVASVGVCGSDAHYYREGRIGEFVVEQPIVLGHEASGTVVGVGDGVPATRIGQRVSIEPQRPDPDTDESRRGLYNLCPHMQFYATPPIDGALAEYVTIGSAFAHAIPDEMSEDAAALCEPLSVAIATTRKAGVTAGSRVLIAGAGPIGIAMVQTALAFGATEVVVSDLDPRRRDVATKFGATAVLDPREQDVAGLHVDAFVDASGAPSAVLAGIQAVRPAGSVVLVGMGAPEMTLPVQTIQNRELVLTGVFRYANTWPTAIALARSGRVDLDSMVTGRFPLAEAEQALNADRTPGSLKAVVRVQE

SEQ ID NO: 9926 - DNA, 1065 bp, Rhodococcus sp. RHA1
  CDS (1)..(1065): transl_table=11
gtgaacactgcacagcgcgagtccggcgccccgcttccggccgagaccctcggggtggtggcgcacgccgcgggagacctccggatcgaagcggtgccgctgcgccgacccgaaccgtccgagacggtggtcgagatcgcctacggcgggatctgcggatccgacctgcactactggacgcacggggcggcgggtgagtcgattctgaaggcgccgatgctgctgggccacgaagtggtgggaacggtggtgcaggccgcggcggacggcagcggtcccgcagcgggtgaacgtgtcgccgtgcaccccgccacccccggcggtcgcggcgccaggttccccgcggatcgcccgaacctctcgccgggatgcacgtacctcggcagtgcggcgcaattcccccacaccgaaggggcattcgcgaagtacgccgttctgccctcccggatgctgcggccgctgccaccggaccttccactgcgcaccgctgcggtcgcggaacccgccgcagtcgcgtggcatgccgtggcccgcgcgggcgacgtgtcggggaagagcgcactcgtcgtgggatgcggacccatcggtgccctcgtggtggcggtccttcgccgggcgggtgcacgcgagatcaccgcagtcgacgtgcacgagtatccccagacggtcgcacgggcgctcggcgccgaccggaccctggacgccgccgactccgcgagcatcgcggacatcgacgccgacattgtcgtcgaatgctccggtaaccgcttcgggctcgaatcggccattcgcggcgcgacgcgcggcggccgagtcgtcatgctcggactgctccctaccggtcttcagcccgcgccgctctcgctcgtcatcacccgggagctcgaactcgtcggatcgttccgattcaacgacgagatcgattcggtgctcgccgctttggcggacggcagcctgaatgtcgaaccggtgatcagtcacgagttcggcatcgaggacggcatcgaggccttcgccgtcgcgaaggacgcgtccacgtccgcgaaggtgttgctggcgttctga

SEQ ID NO: 9927 - protein, 354 aa, Rhodococcus sp. RHA1
MNTAQRESGAPLPAETLGVVAHAAGDLRIEAVPLRRPEPSETVVEIAYGGICGSDLHYWTHGAAGESILKAPMLLGHEVVGTVVQAAADGSGPAAGERVAVHPATPGGRGARFPADRPNLSPGCTYLGSAAQFPHTEGAFAKYAVLPSRMLRPLPPDLPLRTAAVAEPAAVAWHAVARAGDVSGKSALVVGCGPIGALVVAVLRRAGAREITAVDVHEYPQTVARALGADRTLDAADSASIADIDADIVVECSGNRFGLESAIRGATRGGRVVMLGLLPTGLQPAPLSLVITRELELVGSFRFNDEIDSVLAALADGSLNVEPVISHEFGIEDGIEAFAVAKDASTSAKVLLAF

SEQ ID NO: 9928 - DNA, 1059 bp, Haemophilus somnus 129PT
  CDS (1)..(1059): transl_table=11
atgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtactaatccgctggtaacttaccctagaattttaggacatgaaattgttggtacagtcattgaatctggtgttggtatgccaaaaaatattaatataggtgatcgtgtaattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggtgaacacgttgctatcatcggtgctggtgcgattggactgatggccgcattagttgccaaagcttatggtgcgacaccaattttaattgacattttagacaagcgattagattacgcaaaatctattggcattccaaatataattaacccagcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaacgaaacgccactaccaactaatttaattaccttcaaagaacttaacatttatggagcaagaacaagcaagggggaatttgaagaagcattaaaacttttagaatcgagaaagattgaaccgaagaatattattagtaaggtaattacatttgatgaaattcctcactacatcgaagagctttcagaaaatcctgatgattatttaaaaatcattgctgtattttaa

SEQ ID NO: 9929 - protein, 352 aa, Haemophilus somnus 129PT
MSINFVKEGNIMSKYVRSVCLVEPKKVDIKTVLYPKKGECDVLIKVESIGICGSDIGAFRGTNPLVTYPRILGHEIVGTVIESGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 9930 - DNA, 1107 bp, Hyphomonas neptunium ATCC 15444
  CDS (1)..(1107): transl_table=11
atgaagacccgcgccgccgttgcctttgaagccaaaaagccgctcgaaattgtcgagcttgaccttgaagggcccaaggccggtgaagtgctggtcgaaatcatggcgacgggcatctgccacacggatgcctacacgctcgacgggcttgacagcgaaggcatcttccccagcgtgctgggccatgaaggcgccggcatcgtccgcgaggtgggcgcaggcgtgaccagcgtgaagcccggcgatcacgttatcccgctctacacgccagaatgccgccagtgcaaaagctgcctctcaggcaagaccaatctgtgtacggccattcgcgccacgcagggcaagggcctgatgccagacggcaccagccgcttcagctataaaggccagaccgtcttccactatatgggctgctccaccttctcgaacttcaccgtcctgcccgaaatcgccgtcgccaagatccgcgaagacgcgccctttgataaagcctgctatgtcggctgcggcgtcaccaccggcgttggcgcggtcgtcaacacggccaaggttcaggtcggcgagaatgtcgtcgtcttcggtctcggcggcatcggcctcaacgtcatccagggcgcgcgcatggcaggcgccgacatgatcgtcggcgtcgacatcaatccggacaaggaagagtggggccgcaaattcggcatgacgcatttcgtcaacccgaaaaacgtctccgatgtcgtcgcccatatcgtcgagctgaccggcgggggcgcagactattcgttcgactgcaccggcaacaccaccgtgatgcgccaagcgctggaatgctgccatcgcggctggggcaccagcgtcgtcatcggcgtggccgaatcaggcaaggaaatcagcacacgtcccttccagctggtcaccgggcgcaactggcgcggcacagccttcggcggcgccaagggccgcacggacgtccccaagatcgtcgactggtacatgaacggcaaaatcgaaatcgacccgatgatcacccacgtcatgacgctggacaagatcaacgacgcttttgacctgatgcatgagggcaagtcgatccgcagcgtggttgtgtactga

SEQ ID NO: 9931 - protein, 368 aa, Hyphomonas neptunium ATCC 15444
MKTRAAVAFEAKKPLEIVELDLEGPKAGEVLVEIMATGICHTDAYTLDGLDSEGIFPSVLGHEGAGIVREVGAGVTSVKPGDHVIPLYTPECRQCKSCLSGKTNLCTAIRATQGKGLMPDGTSRFSYKGQTVFHYMGCSTFSNFTVLPEIAVAKIREDAPFDKACYVGCGVTTGVGAVVNTAKVQVGENVVVFGLGGIGLNVIQGARMAGADMIVGVDINPDKEEWGRKFGMTHFVNPKNVSDVVAHIVELTGGGADYSFDCTGNTTVMRQALECCHRGWGTSVVIGVAESGKEISTRPFQLVTGRNWRGTAFGGAKGRTDVPKIVDWYMNGKIEIDPMITHVMTLDKINDAFDLMHEGKSIRSVVVY

SEQ ID NO: 9932 - DNA, 1035 bp, Rhizobium leguminosarum bv. viciae 3841
  CDS (1)..(1035): transl_table=11
atgcggacacgtgtggcacggctttaccaaaagggcgacctcaggatcgagaccgccgcggttgcggcccctggtcccggggaggtgcttctcaaaatggcggccgcagggatttgcggctccgacctgcattattatcaggacggcggcttcgggcctgtccgggttcgcgagccgatcatacccggccacgaggcctcggggaccgtgagccaagcgggcgagggcgtcgatctgaaggctggcacgctggtggcggtcaatcccagccaaccctgcgggcattgcgaatattgccagaaaaacatgccgatccactgcctggacatgcgcttcatgggcagtgcgatgcgcctgccgcatgagcagggcatgttccgggaatggctggtggtgccggccaagcaatgctttgcggtcggagctgcgacaaccgccgcggaagcggcctgcagcgagccgctctccgtctgcctgcacgcggcatcgcgcgcaggagatatcacaggcaaacgcgtgctggtcaccggagccggcccgatcggcgccctgatggttgccgtcgcctcctatcaccatgcaagcgagatcgtggtgacagatctcgcggacgcggcgctggaccgggccaaagcgatgggcgccagccgcacgatcaatgtttccaaaaacgcccaggcgcttgccgaattcgaggcgggaaagggctatttcgatctcgtcttcgaatgctcggccgccgccccggccatccgcggcgcaattgccgccatcaggccgcgcggaacgatcgtgcaggtcggcgtcacaggagacgtcccgatcccgctcaacgccatcgtcggcaaggagcttcaactccacggaacgcagcgcttccacgaggagttcggtactgccgtcgagctgatctccagccgcaagatcgatgtgcggccgatcatcagtcacagcctgccgctcgaagaagccaccgcagccttcaccctcgccggcgaccgcgcggccgcctgcaaggtgcaactgactttttag

SEQ ID NO: 9933 - protein, 344 aa, Rhizobium leguminosarum bv. viciae 3841
MRTRVARLYQKGDLRIETAAVAAPGPGEVLLKMAAAGICGSDLHYYQDGGFGPVRVREPIIPGHEASGTVSQAGEGVDLKAGTLVAVNPSQPCGHCEYCQKNMPIHCLDMRFMGSAMRLPHEQGMFREWLVVPAKQCFAVGAATTAAEAACSEPLSVCLHAASRAGDITGKRVLVTGAGPIGALMVAVASYHHASEIVVTDLADAALDRAKAMGASRTINVSKNAQALAEFEAGKGYFDLVFECSAAAPAIRGAIAAIRPRGTIVQVGVTGDVPIPLNAIVGKELQLHGTQRFHEEFGTAVELISSRKIDVRPIISHSLPLEEATAAFTLAGDRAAACKVQLTF

SEQ ID NO: 9934 - DNA, 1038 bp, Rhizobium leguminosarum bv. viciae 3841
  CDS (1)..(1038): transl_table=11
atgtcgaacatgatgaaggcgctggtcaaagcgaaaccggaagtcgggctctggatggagaatgtgccggtgcccgaggtcgggccgaacgacgtgctgatccgggtgaagaaatcggcgatctgcggcaccgacgtccatatctggaactgggatcagtgggcgcagaagaccattccggtaccgatggtggtcggccatgaattctccggcgagatcgccgagatcggttcggcggtcacccgctatcatgtcggcgagcgggtttccggcgaggggcatatcgtctgcggcaagtgccgcaactgccgggcgggcaggggccatctctgccgcaacacgctcggtgtcggcgtcaaccgcccgggctccttcggcgaattcgtctgcattcccgaaagcaatgtcgtgccgatcccggatgatatttccgacgagatcgccgcgatcttcgatccgttcggcaatgccgtgcacaccgcgctctccttcgatctcgtcggcgaggacgtgctcgtcaccggcgccgggccgatcggcatcatgggcgcgctcgtcgccaagcgatccggcgcccgcaaggtcgtcatcaccgatatcaatccgcaccggctggagctggcgcgcaagctcggcatcgatcatgtcgtcgacgcatcgaaggaaaacctcgccgacgtgatgaaggcgatcggcatgacggaaggattcgacgtcgggctggaaatgtcgggggccgcacctgccttccgcgacatgatcgacaagatgaacaatggcggcaagatcgccatcctcggcatcgcgccggcgggcttcgaaatcgactggaacaaggtgatcttcaagatgctcaatctcaagggcatctacggccgcgagatgttcgagacctggtacaagatgatcgccttcgtccagggcggcctcgatctcgcgcccatcatcacccaccggatcggcatcgacgatttccgcgacggcttcgaggcgatgcggtcgggcaattccggcaaggtagtgatggactggatgtga

SEQ ID NO: 9935 - protein, 345 aa, Rhizobium leguminosarum bv. viciae 3841
MSNMMKALVKAKPEVGLWMENVPVPEVGPNDVLIRVKKSAICGTDVHIWNWDQWAQKTIPVPMVVGHEFSGEIAEIGSAVTRYHVGERVSGEGHIVCGKCRNCRAGRGHLCRNTLGVGVNRPGSFGEFVCIPESNVVPIPDDISDEIAAIFDPFGNAVHTALSFDLVGEDVLVTGAGPIGIMGALVAKRSGARKVVITDINPHRLELARKLGIDHVVDASKENLADVMKAIGMTEGFDVGLEMSGAAPAFRDMIDKMNNGGKIAILGIAPAGFEIDWNKVIFKMLNLKGIYGREMFETWYKMIAFVQGGLDLAPIITHRIGIDDFRDGFEAMRSGNSGKVVMDWM

SEQ ID NO: 9936 - DNA, 1032 bp, Rhizobium leguminosarum bv. viciae 3841
  CDS (1)..(1032): transl_table=11
atgaaagccatcgtcattcatgctgccaaggatctgaggatcgaagagcgcgagccggaggttgcgggcgccgggcaggtggagattgccatcgaagccggcggcatctgcggttccgacctgcattattacaatcacggcggtttcggcaccgttcgcctgcgcgaaccgatgatcctcggccatgagatcgccggcacggtcaaggcgctgggctccggcgtcgccgatcttgccgtcggagaccgtgtcgcggtttccccgagccggccgtgcaaccattgccaatattgcctgaaggggcagcaaaaccactgcctcaacatgcggttttacggcagcgccatgccgatgccgcatattcagggcggttttcgccagcggctggtggcagagcgttggcagtgccacaaggtcactgacggcatttccattcacgaggccgcctttgccgaaccctttgccgtgacgctgcatgcggcaaaccgcgccggctcgctgctgggcaaacgcgtgctggtcaccggttgcggccccattgggatgttggcgatcgtcgcggcgcgcgttctcggcgcccgcgaaatcgtcgcgaccgacgtgacggacagcgttctggcaatcgcccgcaccagcggcgccgatcgaacgatcaatgttgccacccatgctgccgaccttgcggcttacagcgctgacaagggatatttcgatgtcatgttcgaagcgtcgggcaatgagagggccgtgcgcgccggcctggagacgcttaagccccgcgccattctcgtgcagctcggccttggcggcgatgtctcgatcccgcagaacatgatcgtggcgaaggaaatcgagatgcgcggcacattccgttttcacgaggaatttgcgctcgccgtcgaactgatcaacgcgcgtcgcgtcgatctgaagccgctgctgaccggtgtctttgggatcgaagaggccgtcgcggccttcgaattggcgggcgaccgcagcaagtccatgaaagtgcagattgctttctga

SEQ ID NO: 9937 - protein, 343 aa, Rhizobium leguminosarum bv. viciae 3841
MKAIVIHAAKDLRIEEREPEVAGAGQVEIAIEAGGICGSDLHYYNHGGFGTVRLREPMILGHEIAGTVKALGSGVADLAVGDRVAVSPSRPCNHCQYCLKGQQNHCLNMRFYGSAMPMPHIQGGFRQRLVAERWQCHKVTDGISIHEAAFAEPFAVTLHAANRAGSLLGKRVLVTGCGPIGMLAIVAARVLGAREIVATDVTDSVLAIARTSGADRTINVATHAADLAAYSADKGYFDVMFEASGNERAVRAGLETLKPRAILVQLGLGGDVSIPQNMIVAKEIEMRGTFRFHEEFALAVELINARRVDLKPLLTGVFGIEEAVAAFELAGDRSKSMKVQIAF

SEQ ID NO: 9938 - DNA, 1044 bp, Rhizobium leguminosarum bv. viciae 3841
  CDS (1)..(1044): transl_table=11
atgaccaaagtccgcgcgcttgtcctcgagcgccagcatgagcttgcgctccgcgatatcgatctgccgctcgaaaccggccccggcgaggtgaagatcaggatccacacggtcggcgtctgcggttcggacgtgcattattacacccacggcaagatcggccccttcgtggtcaacgcgccgatggtgctcggccatgaggcggccggcacggtggtcgaggtcggggccggcgtcacgcatctgaaagtcggcgaccgcgtctgcatggagcccggcattcccgatccgaattccaaggcaagccggctcggcatgtacaatatcgacccggccgtcaccttctgggcgaccccgccgatccacggcgtgctgacgccagaggtcgtgcatcccgccaattataccttcaagctaccggacaatgtcagctttgccgaaggcgccatggtcgagcctttcgccgtcggcatgcaggcggccaccaaggcgaagattacgcctggtgatactgccgtcgtcctcggcgccgggccgatcggcacgatggtggcgatcgcggcgcttgccggcggctgcgcccgcgcgatcgtcgccgatcttgcccagccgaagctcgatatcgccgcgcagtaccagggtgtcattccggtcaatatccgcgagaagaacctggccgaagaggttgcccggctgaccgacggctggggcgccgatgtcgtcttcgaatgctccggctcgccgaaggcctgggagacgatcatggcgctgccgcgcccgggcggcgtcatcgtcgtcgtcggcctgccggtcaatccgatcggcttcgacgtctcgacggcatccaccaaggaaatccgcatcgagacagtgttccgctacgcgcatcagtatgagcgctcgatcgcgctgctcggctcgggtcgcgtggatctgaagccgctgatatcagagaccttcaaattcgacgattcgatcaaggcgtttgatcgcgccgtcgaggcccggccgagcgacgtgaagctgcagatcgtgatggaatag

SEQ ID NO: 9939 - protein, 347 aa, Rhizobium leguminosarum bv. viciae 3841
MTKVRALVLERQHELALRDIDLPLETGPGEVKIRIHTVGVCGSDVHYYTHGKIGPFVVNAPMVLGHEAAGTVVEVGAGVTHLKVGDRVCMEPGIPDPNSKASRLGMYNIDPAVTFWATPPIHGVLTPEVVHPANYTFKLPDNVSFAEGAMVEPFAVGMQAATKAKITPGDTAVVLGAGPIGTMVAIAALAGGCARAIVADLAQPKLDIAAQYQGVIPVNIREKNLAEEVARLTDGWGADVVFECSGSPKAWETIMALPRPGGVIVVVGLPVNPIGFDVSTASTKEIRIETVFRYAHQYERSIALLGSGRVDLKPLISETFKFDDSIKAFDRAVEARPSDVKLQIVME

SEQ ID NO: 9940 - DNA, 1092 bp, Pseudomonas aeruginosa UCBPP-PA14
  CDS (1)..(1092): transl_table=11
atgaacagttccccgcaagccaacgcggcgatgcgcgccgccgtctggcacggccgccacgatatccgcgtggaagacgtgccgctcccggccgagccgccgcccggctgggtgcagatccgcgtgcactggtgcggcatctgcggctccgacctgcacgaatacctggccggcccggtattcatccccgtggaggcgccgcacccgctcaccggcctcaaggatcaatgcatcctcggccacgagttcagcggcgaaatcgtccgcctcggcaacggcgtgaccggcttcgccctcggccaggcggtcgccgcagacgcctgccagcattgcggcacctgctactactgccggcatgggctgtacaacatctgcgagaacctggccttcaccgggctgatgaacaacggcgccttcgccgaatacgtcaacgtaccggccaacctgctctacgccctgccggccggatttcccagcgaggccggcgcgctgatcgagccgctggcggtgggcatgcacgcggtgaagaaggccggcagcctgctcgggcagaacgtggtggtggtcggcgccggcaccatcggcctgtgcaccatcatgtgcgcgcgcgccgccggcgcggcacaggtgatcgccctggagatgtcctcggcgcgcaaggccaaggccctggaggtcggcgccagccaggtgctcgacccctcgcggtgcgacgccctaggcgaaatccgcgccctcaccggcgggcttggcgccgacgtcagcttcgaatgcatcggcaacaagcacaccgccaagctggccatcgatgccattcgcaaggccggcaaatgcgtgcttgtgggaatcttcgaggagcccagtgaattcaatttcttcgagctggtttccaccgagaagcagttgctcggggccctcgcctacaacggcgagttcgccgacgtgatcgccttcatagccgacggccgcctcgacatcgcaccgctggtgaccggtcgcatcggcctggaagaaatcgtcgagcgcggtttcgaagagttggtgaacaacaaggagcacaacgtgaagatcatcgtctcgccgggcggctga

SEQ ID NO: 9941 - protein, 363 aa, Pseudomonas aeruginosa UCBPP-PA14
MNSSPQANAAMRAAVWHGRHDIRVEDVPLPAEPPPGWVQIRVHWCGICGSDLHEYLAGPVFIPVEAPHPLTGLKDQCILGHEFSGEIVRLGNGVTGFALGQAVAADACQHCGTCYYCRHGLYNICENLAFTGLMNNGAFAEYVNVPANLLYALPAGFPSEAGALIEPLAVGMHAVKKAGSLLGQNVVVVGAGTIGLCTIMCARAAGAAQVIALEMSSARKAKALEVGASQVLDPSRCDALGEIRALTGGLGADVSFECIGNKHTAKLAIDAIRKAGKCVLVGIFEEPSEFNFFELVSTEKQLLGALAYNGEFADVIAFIADGRLDIAPLVTGRIGLEEIVERGFEELVNNKEHNVKIIVSPGG

SEQ ID NO: 9942 - DNA, 1011 bp, Oenococcus oeni PSU-1
  CDS (1)..(1011): transl_table=11
atggcaacgatggatgcattagtattaactgccgttaaggatatgaaaattgaacaagtcgacaagcctcaagtgaaggcaaatgaggttttgatcgagaccaaatacgccggaatttgtggaaccgaccatgctctttacaatggtttgccgggttcggccgctgcggttccaccaattgttttgggacacgagaattccggggttgtttccgaagttggtgagaaagttacaagcgtcaaggtcggcgaccgggtaacggttgatccgaacatatactgtggccactgtttctattgccggactggccgtccagaactttgtgataatttgtcggccgtcggtgttacccgtaacggaggtttggaacaatacttcacagcaccttcgacacaggtttacaaggttcctgacaacgtttctttaaaagccgccgccacaaccgaaccgatttcatgtgctgttcacggtgttaagttgttaaagttaacgccttatcaaaaggctctggtaatcggtgatggttttatgggtcaattgtttgttcaacttctgcgtgcttacggagttcatcaagtggattttgccggtattatcgatgaaaagctggctctgaacaaagaaaaatttggcgttaccaatacttacaatacgactcgcgacaagattccggctgattatgatgttgtgatcgaagcagtcggtcttcccgaaacacaagaacaagccgttaatgcaactgtcaaaggagcgcaagtcttgatgtttggtgtcggaaaaccaaatcaggaattcaaaatgaatacttacgaggtttatcaaaagcaacttacaattcaaggttcctttatcaaccctaatgcttttgaagattctttggcattgttgtcgagcgggaaattggacgtattgtctttgattagtaatgaaccatcacttgataaagtttccgattatcttgatggcagtgttaaaaatgtcagcaaagctgttgttaaagtaggtgcttaa

SEQ ID NO: 9943 - protein, 336 aa, Oenococcus oeni PSU-1
MATMDALVLTAVKDMKIEQVDKPQVKANEVLIETKYAGICGTDHALYNGLPGSAAAVPPIVLGHENSGVVSEVGEKVTSVKVGDRVTVDPNIYCGHCFYCRTGRPELCDNLSAVGVTRNGGLEQYFTAPSTQVYKVPDNVSLKAAATTEPISCAVHGVKLLKLTPYQKALVIGDGFMGQLFVQLLRAYGVHQVDFAGIIDEKLALNKEKFGVTNTYNTTRDKIPADYDVVIEAVGLPETQEQAVNATVKGAQVLMFGVGKPNQEFKMNTYEVYQKQLTIQGSFINPNAFEDSLALLSSGKLDVLSLISNEPSLDKVSDYLDGSVKNVSKAVVKVGA

SEQ ID NO: 9944 - DNA, 1050 bp, Leuconostoc mesenteroides subsp. mesenteroides ATCC 8293
  CDS (1)..(1050): transl_table=11
atgaaagcagctgtatggcatggcgttaaagatgttcgtgtggaggatgttgaactcaaaccaacaaaatctaatgaggtagtagtgcgtgttgcttatgctgggatttgtggcagcgacttacacgagtaccttgagggtcctgtatttattcccgttgatcaaccagatgaattgactggcggtcaagcaccattaacgatgggacatgagttttctggcgttatcgaaaaagtaggtcccgatgtggctaattttaaagttggggatcacgtttcaattaatccaactgtcacaaagggaatttcttctgatgatttggatgtttacgatggctatagttttattggtttaagcacggatggtggctttacatcatacgtgaatgtaccagaagataacttatatcatttacctgaagaattctcattgaaattagcagctactattgagccaactgcagttgcggtccaagctatcaaagaggctgatcttcgatttggcgaaaaagttgtgatttttggtgctggaccaataggtgtattagttgctgctgctgcgaaggcggcaggggctactaaaatcgtggctgtagatttgtcagaaattcgcttgagaaaagcgcttgaaatgggcgcaacagacgtgattaatccaagtcaagtaccagacactgttgcagctattaaaaacattattcctggtggagcggatgcatcatttgaagttgccggggtacaaccaacctttgaacaagcaatagatgcaacacgtccgcgcggaagtgtcgttattgtttcaatttttgcaaagccaatcagctttaacccaatgcaattgatgaatgcaggtgttaaactgaccacaacaattgcttattcaaaagaaactttccaacaaactgttgctcttgttagcagtgggcaaataaatgtagaaccagttattacggatacaatttcattggacagtattgtttctgatggttttgagtcattaacaagcgataaatcgcaggccaagattttaattgatttaagtaaagattaa

SEQ ID NO: 9945 - protein, 349 aa, Leuconostoc mesenteroides subsp. mesenteroides ATCC 8293
MKAAVWHGVKDVRVEDVELKPTKSNEVVVRVAYAGICGSDLHEYLEGPVFIPVDQPDELTGGQAPLTMGHEFSGVIEKVGPDVANFKVGDHVSINPTVTKGISSDDLDVYDGYSFIGLSTDGGFTSYVNVPEDNLYHLPEEFSLKLAATIEPTAVAVQAIKEADLRFGEKVVIFGAGPIGVLVAAAAKAAGATKIVAVDLSEIRLRKALEMGATDVINPSQVPDTVAAIKNIIPGGADASFEVAGVQPTFEQAIDATRPRGSVVIVSIFAKPISFNPMQLMNAGVKLTTTIAYSKETFQQTVALVSSGQINVEPVITDTISLDSIVSDGFESLTSDKSQAKILIDLSKD

SEQ ID NO: 9946 - DNA, 1032 bp, Solibacter usitatus Ellin6076
  CDS (1)..(1032): transl_table=11
atgaacgcacttcttctcacgcaatacatgcacctggaaatggtggagatgccggtcccggcgattggagccgacgacgtgctggtccgcgtccgcgcctgcggcatctgcggcagcgacgtccacgggctggacggcaagacgggccggcgcattccgcccctggtaatgggccacgaggccgcgggcgaagttgtggaaaccggcgccaacgtgaccgacctgcgcccgggagaccgggtcacgttcgattccaccgtgtattgcgggcgctgcttccactgcacgcgaggcgaagtgaacctctgcgataaccgcgaagtgctgggcgtttcgcccggaccctaccgccgccacggggccttcgcggagtacgtctcggtgccgcggcggatcatgtaccggctgccggatagcttaagttacgagcaggcggcgctgatcgaggccgtctccgtcgcagtgcacgccgtaaacctgacgccggtgcggctgggcgattccgcggtggtagtcggcagcggcatgatcggcttgctggcgatgcaggcggcgaagcatgcgggatgcacgcgcgtgatcgcggtggatcccgacgaagggcgattgagactcgcgattggtgcgggtgcgaccgatgcgatcaatcccaaatccaccgacgccgcggcggcaatccgcgagttgaccgaaggccgcggcgctgatctcgcgatcgagtgcgtgggcgccaccgacccgatccggacggcgatcgccggagtgcggaagggcggcgcggtgactctggtggggaacgtggcgccggaaatcgagttcccgctgcaatccgtggtgacgcggcagatccgcttgcagggatcgtgcgcctccaacggcgaatatccggcgtgcatcgacatgatggcgcgcggcgcgatccgggtggatgagttgatcaccgctgtggcgccgctcgaagaaggcccttcgtggttcgaccgtctctaccgtcacgagccgcatttgatgaaggtgatcctgcgtccgtaa

SEQ ID NO: 9947 - protein, 343 aa, Solibacter usitatus Ellin6076
MNALLLTQYMHLEMVEMPVPAIGADDVLVRVRACGICGSDVHGLDGKTGRRIPPLVMGHEAAGEVVETGANVTDLRPGDRVTFDSTVYCGRCFHCTRGEVNLCDNREVLGVSPGPYRRHGAFAEYVSVPRRIMYRLPDSLSYEQAALIEAVSVAVHAVNLTPVRLGDSAVVVGSGMIGLLAMQAAKHAGCTRVIAVDPDEGRLRLAIGAGATDAINPKSTDAAAAIRELTEGRGADLAIECVGATDPIRTAIAGVRKGGAVTLVGNVAPEIEFPLQSVVTRQIRLQGSCASNGEYPACIDMMARGAIRVDELITAVAPLEEGPSWFDRLYRHEPHLMKVILRP

SEQ ID NO: 9948 - DNA, 1140 bp, Shewanella sp. ANA-3
  CDS (1)..(1140): transl_table=11
atgtcgaacgaaaaaccacagtttatcaagtcaaaggccgccgtggcctggggcccgggacagccgctcaagattgaagaagtcgatgtgatgttaccaaaagccggcgaagtgttagttcgcatcgtggcgactggggtttgccatactgatgcgtttaccttaagtggtgacgatccagagggcgtgttcccagcgatcctcggccatgagggcggtggtattgttgagcaagtgggcgaaggcgtgaccagcgtgcaggtgggcgaccatgtgatccctctctacacgcctgagtgtggtgaatgtaaattctgtttatcgggtaaaacaaacctgtgccagaagatccgtgcaacccaaggcaaaggtttgatgccagatggcaccacgcgtttctataaagatggccagcccattttccattacatgggttgttctaccttctctgaatacacggtattacctgaaatttcattggctaaggttaataaaactgcgccattagaagaaatctgtttgctgggttgtggtgtgacaacaggtatgggcgctgtgatgaacacggctaaagtggaagaaggcgcgaccgtggcgattttcggccttggcggtatcggtctttcggccattattggtgcgaccatggctaaagccagccggatcattgccatcgatatcaatgaatctaaatttgaacttgcccgtaaattaggggcaaccgattgtattaacccgaaacatttcgacaaacccattcaagaggtgattgtcgaaatgaccgatggcggcgtggattactccttcgaatgtatcggtaatgtcaatgtgatgcgcagcgcgctcgagtgttgccacaagggctggggcgagtcagtgatcattggggttgcgggcgcagggcaggagatttctacccgtccattccaactggtgacgggccgcgtatggcgtggttctgccttcggtggcgtgaaaggacgctcgcaattacctaaaatcgttgaacaatacctagcgggtgagtttaagctcgatgactttatcacccacactatgggacttgagcaagttaacgaagccttcgacttgatgcatgaaggcaagagcattcgcagcgtgatccatttcgataaataa

SEQ ID NO: 9949 - protein, 379 aa, Shewanella sp. ANA-3
MSNEKPQFIKSKAAVAWGPGQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLEEICLLGCGVTTGMGAVMNTAKVEEGATVAIFGLGGIGLSAIIGATMAKASRIIAIDINESKFELARKLGATDCINPKHFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 9950 - DNA, 975 bp, Mycobacterium smegmatis str. MC2 155
  CDS (1)..(975): transl_table=11
gtgaaagctgtcgtggtgcacggcgccaacgatctccgggtcgaagaactgccggatcccgcgccgggcacgggcgaggttctcgtcgcgatggagtggggtgggatctgcggatccgacatctcgtactggcgccacggatccaccggcaccgccgtcctgaagcaccccatggtgctcggccacgaggtggcgggtcacatcgcgggcgtcggcgccggggtcaccggactacgcgagggcgaccgggtcaccatccacccggccaccgaatcgggcggatacttcggctcggcggccttcgatccgcacaccgacggtggcttctgcggactgaaagtggtgcgcgccgagcagatccgtaggctccccgacgcggtcgacacggtgcgcggcgcgctcgccgagccgctcgcggtggcgatgcacgcggtgaaccgcgccggtacggtacgcggacgcgatgtcctggtgaacggtgcgggccccatcggggcgctcgtggtggcggccgccaagtacgcgggcgctgcgagcgtggtggccgcggacgtcgtcgaggcaccactggcgatcgcaaaggcgatgggcgccgacggcgtcgtcaatctcgctggcggtgaacaacttccgtccgacgtcgcggtggtgttcgaggcctcgggcgcagtggccgcactgggcggggtgctgcacgccgcggcgcgcaacggcgtcgtggtacaggtgggcaacctgcccggccaaccgacgccggcgagcctcggcgacctggtcagccgggagctcacctggatcgggtcattccggttcgtcgacgagatcaccgacgccgtcgcggccctgaacgacggtctcgacgtcaccccgctgatcacccaccgctatccgatcgaccacgccgcggaggcgatcgccgtcgcggccgatcgcaacaccggcagcggcaaggtgctcatccaactgaacggttga

SEQ ID NO: 9951 - protein, 324 aa, Mycobacterium smegmatis str. MC2 155
MKAVVVHGANDLRVEELPDPAPGTGEVLVAMEWGGICGSDISYWRHGSTGTAVLKHPMVLGHEVAGHIAGVGAGVTGLREGDRVTIHPATESGGYFGSAAFDPHTDGGFCGLKVVRAEQIRRLPDAVDTVRGALAEPLAVAMHAVNRAGTVRGRDVLVNGAGPIGALVVAAAKYAGAASVVAADVVEAPLAIAKAMGADGVVNLAGGEQLPSDVAVVFEASGAVAALGGVLHAAARNGVVVQVGNLPGQPTPASLGDLVSRELTWIGSFRFVDEITDAVAALNDGLDVTPLITHRYPIDHAAEAIAVAADRNTGSGKVLIQLNG

SEQ ID NO: 9952 - DNA, 1041 bp, Mycobacterium smegmatis str. MC2 155
  CDS (1)..(1041): transl_table=11
atgaacgccgtcgcagccgatgcccgcggcaccatgcgcgccagcgtgcttacctcggtgggcacggtggtggtggaggaccggccggtgccgaccccgggcccgcacgaggtgctcgtcgaggtcgcggccgtcggggtgtgcggttccgacgtgcactactaccggcacggtcgtatcggcgacttcgtggtcaacgagccgatgatcctgggccacgagttgtcgggacggatcgcggcggtcggtgagggcgtcgaccccgcacgggtcggtcagcgcgtcgcggtcgaaccgcagcacccgtgccggcgctgcaagcagtgcaaggccggccgctacaacctgtgccccgagatcaagttctatgccaccccgccgatcgacggggcgttctgccgctacgtcaccatcgacgacgacatggcccatgccgtgccggactccatctccgacgacgccgcggcgctgctcgaaccgctgtcggtggccatcgccaccatgcgcaaggccggcgtcgtacccggctcgtcgatcctcatcgcaggcgccgggcccatcggcgtgatctgcgcacagaccgcgcgcgcgttcggcgccgcgcgcatcgtggtgaccgatctggtggccgaacgccgcgagcgggtcctgcggttcggggccaccgaggtgctcgatcccgcggtcgacgatgtcgccgcgctcgaccccaaggtcgacgcgttcgtcgatgccagcggcgccgcacctgccgtggtgtccggcatcaaggccgtcggccccgcgggcaacgtcgtgctggtcggcatgggcgccgacgacgtgacgctgcccgtcggctacatccagaacatggagatcaacgtgaccggcgtgttccggtacaccgacacctggcctgcggcaatccatctcgtgagttctggtgctgtcgatctcgacgcgctggtgaccggtcgctacgacctcgaccatgtcgccgaggccctcgacagcgacagcgaccccgcgagcctcaagtcgatcgtggtgcccgagtga

SEQ ID NO: 9953 - protein, 346 aa, Mycobacterium smegmatis str. MC2 155
MNAVAADARGTMRASVLTSVGTVVVEDRPVPTPGPHEVLVEVAAVGVCGSDVHYYRHGRIGDFVVNEPMILGHELSGRIAAVGEGVDPARVGQRVAVEPQHPCRRCKQCKAGRYNLCPEIKFYATPPIDGAFCRYVTIDDDMAHAVPDSISDDAAALLEPLSVAIATMRKAGVVPGSSILIAGAGPIGVICAQTARAFGAARIVVTDLVAERRERVLRFGATEVLDPAVDDVAALDPKVDAFVDASGAAPAVVSGIKAVGPAGNVVLVGMGADDVTLPVGYIQNMEINVTGVFRYTDTWPAAIHLVSSGAVDLDALVTGRYDLDHVAEALDSDSDPASLKSIVVPE

SEQ ID NO: 9954 - DNA, 1017 bp, Nocardioides sp. JS614
  CDS (1)..(1017): transl_table=11
gtgcccgtcgccgcccggctccactccgtcggcgacctgcgggtcgagcaggtcgccgagccgcccgctcccaccgtcggctggtcgaccgtcgcggtcacctcggtcgggctctgcggctccgacctgcactggttcaccgacggcggcaccggcgaggtcacgctcgaccgaccggtggtcccgggccacgagctcgccgggcgcgcactggacgggccgtacgccgggcgccgggtcgcgatcgaccccgcgatcccgtgcggggtctgcgagcagtgccgcgccgggcacgggaacctgtgtcccgacgtgcgcttcgccgggcacgccggcctggacggcggcctccaggagcggctggtctggcccgaccacctgctgttcccgctcccggacgacctcagcgacgatgcgggcgcgctgctcgagccgctcggggtcgcgatccacgcggtcggggtggcgcacgtccgccccggccacgacgtactggtggtgggcggcggcccgatcggggtgctcactgccgcggtggctcgccgtaccggcgccgcccaggtggtcgtgagcgagccgctcgcgcaccggcgcgagaccgcacgccgcttcggcgccgacgtcgcggtcgcaccggaggaggcctcgtccgcggtcgacgagctgaccggcgggcgcggcgtcgacgtggtcatcgagatggcgggggcggacgacgccatcggcaccgccgtcgcctgcgcgcgcccgggcgcccggatcgcgctgggcggcatcccgtcggtgccgctgtcctcgttccccgccgcacccgcccggcgcaagggcctgaccttcgcgatggtccgccggatgcacgagacctacccgcgcgcgatcgagctcgccacgagcggcatcgacctcgacgccctggtcagcgaccgcttcccgctcgccgacgcacccctcgccttcacccacgccgtcgcccgcaccggcgacaagaccgtcatcgcggtgtccggcacccgttga

SEQ ID NO: 9955 - protein, 338 aa, Nocardioides sp. JS614
MPVAARLHSVGDLRVEQVAEPPAPTVGWSTVAVTSVGLCGSDLHWFTDGGTGEVTLDRPVVPGHELAGRALDGPYAGRRVAIDPAIPCGVCEQCRAGHGNLCPDVRFAGHAGLDGGLQERLVWPDHLLFPLPDDLSDDAGALLEPLGVAIHAVGVAHVRPGHDVLVVGGGPIGVLTAAVARRTGAAQVVVSEPLAHRRETARRFGADVAVAPEEASSAVDELTGGRGVDVVIEMAGADDAIGTAVACARPGARIALGGIPSVPLSSFPAAPARRKGLTFAMVRRMHETYPRAIELATSGIDLDALVSDRFPLADAPLAFTHAVARTGDKTVIAVSGTR

SEQ ID NO: 9956 - DNA, 1056 bp, Nocardioides sp. JS614
  CDS (1)..(1056): transl_table=11
atgacgcagatcatgcaggccctggtggtgcgcgagcccaatgtgctcgagatcgccgaggtgcctgtgcccgagcccggtcgcaacgaggtcttggcgcgagtccgatccgtctcgatctgcggcaccgacgcccacctcatcaacggtgactaccccgggttctggccgccgcagttccccttcacccccggccacgaatgggcgggtgacgtcgtggccctcggtgagggtgcggacaccttcggctggcgggtcggcgaccgggtcgcgggcacgagccacagtgcttgcggcgcctgccagaagtgcgtcgaaggccagtacaacctgtgtgagaactacggcaggccggcgctccatgctcagtacggacacaacgcgcagggggtcaacgccacctatgccgtccacaacgtcaagtcgatcttccggctgcccgatgaggtgagcttcgatgtcggtgccctggctgacccggccagcatcgccctgcacgtagcacgtcgcggcaacatcaagccgggggacaccgttgcggtgaccggtgccggcgcgatcggcctcctcgcggctgacgccgcactgatcgatggggccgcgcgggtgatcgtggtggggcgcggccaccgtctggagcgggctgctgcgctggggttcgagaccgtcgacacgcgcacaggcgacccggtcgccgaggtgcgtggactgacgagtggcctcggcgccgacgtggtcctggaatgtgcgggcgtccccgagaccctgatctgggggatggcgatgctgcgccgcggcggtcgctgcgcgatggtcggcatcccgaccgaggacgtcagcctgaagtgccagcccctcgtgctcgatgagctggagctggtcggctcacgcgcctctgccggtgagatgcgccgcgtcctgcccttcatcgccaacgggaggatgcgggccgaggagctcatcacccaccacttcccgctctcggagtacgacaaggcgctggccacgttcaacgaccgtgccagcggtgcgatcaagatcatcgtcaacccctag

SEQ ID NO: 9957 - protein, 351 aa, Nocardioides sp. JS614
MTQIMQALVVREPNVLEIAEVPVPEPGRNEVLARVRSVSICGTDAHLINGDYPGFWPPQFPFTPGHEWAGDVVALGEGADTFGWRVGDRVAGTSHSACGACQKCVEGQYNLCENYGRPALHAQYGHNAQGVNATYAVHNVKSIFRLPDEVSFDVGALADPASIALHVARRGNIKPGDTVAVTGAGAIGLLAADAALIDGAARVIVVGRGHRLERAAALGFETVDTRTGDPVAEVRGLTSGLGADVVLECAGVPETLIWGMAMLRRGGRCAMVGIPTEDVSLKCQPLVLDELELVGSRASAGEMRRVLPFIANGRMRAEELITHHFPLSEYDKALATFNDRASGAIKIIVNP

SEQ ID NO: 9958 - DNA, 1026 bp, Mycobacterium sp. KMS
  CDS (1)..(1026): transl_table=11
atgacagagaccgttgacggcaccatgcgtgccagcgtgatgaccggggtcggcacgctgcggatcgaggagcggccggtgccgtctcccggaccgcacgaggtgctcgtcgaggtggccgcggtcggggtgtgcggttcggatgtgcactactaccgtcacggccggatcggcgatttcgtcgtcgaggagccgatgatcctcggccacgaactgtccgggcggatcgccgccgtcggtgagggcgtcgatcccggacgagtgggtgagcgcgtcgccgtcgaaccacagcatccctgccgtcgctgcaggcagtgcaagtccggccggtacaacctgtgccccgagatgaagttctacgccaccccgccgatcgacggcgcgttctgccgttacgtcgtcatcgacgacgacttcgcccatccggtgcccgagtccatgtccgatgacgccgccgcgctgctcgaaccgctctcggtggcgatcgccacgatgcggaaagcgggagtggtccccggatcctccatcctgatcgccggcgccggtcccatcggcgtcatctgcgcgcaggccgcccgagccttcggcgccgcccgcatcgtcgtcaccgacctggttccgtcacgccgggagatggcgctgaagttcggcgccacggaagtgctggatccggccgccgtggacgtctcggccatcgaacccgtcgacgcgttcgtcgacgccaccggcgtacccgcggcggtggtcagcggtatcaaggccgtcggtccggcgggcagggtggtgctggtcgggatgggtgccgatgagtacgcgctcccggtcagccacatcgcgaacctcgagatcaccgtcaccggcgtgttccggtacaccgacacctggtccgccgcaatacatctcgtgaactccggcgcggtggatctcgacgcgatggtgacgggccgctacgacctcgaacacgtggccgacgccctcgacagcgacaccgaccctgccagcctcaagtcgattgtgaacccctga

SEQ ID NO: 9959 - protein, 341 aa, Mycobacterium sp. KMS
MTETVDGTMRASVMTGVGTLRIEERPVPSPGPHEVLVEVAAVGVCGSDVHYYRHGRIGDFVVEEPMILGHELSGRIAAVGEGVDPGRVGERVAVEPQHPCRRCRQCKSGRYNLCPEMKFYATPPIDGAFCRYVVIDDDFAHPVPESMSDDAAALLEPLSVAIATMRKAGVVPGSSILIAGAGPIGVICAQAARAFGAARIVVTDLVPSRREMALKFGATEVLDPAAVDVSAIEPVDAFVDATGVPAAVVSGIKAVGPAGRVVLVGMGADEYALPVSHIANLEITVTGVFRYTDTWSAAIHLVNSGAVDLDAMVTGRYDLEHVADALDSDTDPASLKSIVNP

SEQ ID NO: 9960 - DNA, 1065 bp, Neisseria meningitidis FAM18
  CDS (1)..(1065): transl_table=11
atgaaagcagcacgtttttacgataaaggcgacatccgcatcgaagacatccccgaaccgaccgtcgcccccggcactgtcggcatcaatgtcgcctggtgcggcatctgcggtactgacctgcacgaattcatggaaggcccgattttcattccgccttgcggtcatccgcacccgatttccggcgagtccgcacccgtcacgatgggacacgagttctccggcgtggtctatgccgtcggcgaaggcgtggacgacatcaaagtcggccaacacgtcgtggtcgaaccctacatcatccgcgatgacgtaccgaccggagaaggcagcaactaccacctctccaaagatatgaactttatcggcttgggcggctgcggcggcggtctgtccgaaaaaatcgccgtcaaacgtcgttgggtgcatccgatttccgacaaaatcccgttggatcaagccgctttgatcgaaccgctgtctgtcggacaccacgcctatgtacgcagcggcgcgaaagcaggcgacgtcgcattggtcggcggcgcaggtccgatcggtttgctgttggctgccgtgttgaaagccaaaggcatcaaagtcatcatcaccgagttgagtaaagcacgcaaagacaaagcgcgcgaatccggcgttgccgactacatcctcgacccgtccgaagtcgatgttgtcgaagaggtgaaaaaactgaccaacggcgaaggcgtggacgtggcattcgaatgtaccagcgtgaacaaagtgttggatactttggtcgaagcctgcaaacctgccgccaatttggttatcgtatccatctggagccaccctgcaaccgtcaacgtccacagcgtcgtgatgaaagagctggatgtgcgcggcacgattgcctactgtaacgaccacgccgaaaccatcaaactggtcgaagaaggcaaaatcaacctcgaacccttcatcacccagcgcatcaagctggacgaactggtttccgaaggcttcgagcgtctgatccacaacaacgaatccgccgttaaaattattgtgagtccaaacctgtaa

SEQ ID NO: 9961 - protein, 354 aa, Neisseria meningitidis FAM18
MKAARFYDKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKAGDVALVGGAGPIGLLLAAVLKAKGIKVIITELSKARKDKARESGVADYILDPSEVDVVEEVKKLTNGEGVDVAFECTSVNKVLDTLVEACKPAANLVIVSIWSHPATVNVHSVVMKELDVRGTIAYCNDHAETIKLVEEGKINLEPFITQRIKLDELVSEGFERLIHNNESAVKIIVSPNL

SEQ ID NO: 9962 - DNA, 1110 bp, Nostoc punctiforme PCC 73102
  CDS (1)..(1110): transl_table=11
ttgcaagttaaagcagcagtggcttacagcgcaggtaagccgttaacgattgaaaccgttcaattatcgggaccacaagctggcgaagtgttggttgaggtgaaagccagcgggatttgccatactgacgcttttaccctatctggtgacgatcccgaaggtttgtttccggctattttggggcatgaaggtgctggtgtagtagtggaagtaggcgctggtgtcaccagtctgaaaccaggagatcgtgtgattcccctatatactcccgaatgccgccagtgcgaatattgtctgagcttcaaaactaatctttgtcaagccattcgcttaactcaaggacggggtgtcatgcccgatggcaccagtcgctttagcattgatgggcagatgattcatcattatatgggtacatccacttttgccaactacacggtgctgccggaaatcgccgtggcaaaaattcgggaagatgccccatttgaaaaggtttgttacattggctgtggtgttactactggtattggtgcagttatcaatactgcaaaggtggaaccgggagcaaatgtagtagtttttggcttgggtggtattggtttaaatgtcatccaggcggcgcggatggtaggggcaaatatgattgtcggggtggatattaatcccagcaaacgcgccttggcagaaaagtttgggatgacgcactttgtcaatccccaagaagtagaaggtgatttagttccctatctggttgacttaacaaaaggcggtgctgattacagttttgaatgtatcggtaatgtcaaaattatgcgtcaagcattagaatgttgccacaaaggttggggtgtcagcgtgattattggggttgctggtgctggacaagaaatcagcactcgtccttttcaattagtaactgggcgcgtttggaaaggttcagcatttggaggtgcgagagggcgtacagatgtgccgaaaattgttgattggtatatgcaaggcaaaataaatattgatgatttaattactcatgtgatgccgattgaacaaattaatgatgcttttgaattaatgcacaaaggtgaatcaattcggagtgtggtgactttttag

SEQ ID NO: 9963 - protein, 369 aa, Nostoc punctiforme PCC 73102
MQVKAAVAYSAGKPLTIETVQLSGPQAGEVLVEVKASGICHTDAFTLSGDDPEGLFPAILGHEGAGVVVEVGAGVTSLKPGDRVIPLYTPECRQCEYCLSFKTNLCQAIRLTQGRGVMPDGTSRFSIDGQMIHHYMGTSTFANYTVLPEIAVAKIREDAPFEKVCYIGCGVTTGIGAVINTAKVEPGANVVVFGLGGIGLNVIQAARMVGANMIVGVDINPSKRALAEKFGMTHFVNPQEVEGDLVPYLVDLTKGGADYSFECIGNVKIMRQALECCHKGWGVSVIIGVAGAGQEISTRPFQLVTGRVWKGSAFGGARGRTDVPKIVDWYMQGKINIDDLITHVMPIEQINDAFELMHKGESIRSVVTF

SEQ ID NO: 9964 - DNA, 1041 bp, Bifidobacterium longum DJO10A
  CDS (1)..(1041): transl_table=11
atgaaagcagttgttctcgaagagcagggcgtcatcaatgtgcgtgaggtcccggacgtcaaggatcccggccccggtgagctgcgtatcgcaccccacaccgtgggcgtatgcggttctgatttgcattactacacgcacggtcgtgttggcaagtatgttgttgagcagccaatgattctcggccatgaggcagcgggcaccgtgttggaggtcggccccggcgtcactgatttcaagcccggtgaccgagtcgccctcgagccaggcattccggatatgacttcgcgggccagccgactgggcatgtacaacgtcgatccggctgtgcgtttcttcgctactccgccgattgacggttgcctgtgtgaggaggtcattcacccggccgcattcacctaccatctgcctgattccatgagctttggcgaaggtgcgttgcttgagccgaccgccgtgggcatgtgggctgccaccaaggcgcgcatcaagcccggcgatgtgtgcgtggtgaccggctcgggcacagtgggtatgctcactgcctctgctgcgctcgccggtggcgcttccaaggtgcttgtttcggatgtgtcttccatcaagctgggtattatcggccagattccgggcgttatccccgtggatttgacgacggaggacttggttgaacgtgtacgcgaagagaccgctgggtggggcgctgatgtggcattcgagtgttccggcgcgccgaaagcttatgagacgttctggaagctgattgccccgggcggttgcgcggtgctcgtcggtattccggtcaacccggtaccgattgacgtgaccgagctgcaggccaccgaagtgcgtattgagaacatcttccgttacgccaatgtgtaccagaaagccatcgatttggtcgatagcggccgacttaacctgaagccgttcatcactgacacgtttgccatgaaggacgccaaggctgccttcgaccgtatggatgagggtcgtccgggcgatatcaaattgcagattacggtcaatcgagactaa

SEQ ID NO: 9965 - protein, 346 aa, Bifidobacterium longum DJO10A
MKAVVLEEQGVINVREVPDVKDPGPGELRIAPHTVGVCGSDLHYYTHGRVGKYVVEQPMILGHEAAGTVLEVGPGVTDFKPGDRVALEPGIPDMTSRASRLGMYNVDPAVRFFATPPIDGCLCEEVIHPAAFTYHLPDSMSFGEGALLEPTAVGMWAATKARIKPGDVCVVTGSGTVGMLTASAALAGGASKVLVSDVSSIKLGIIGQIPGVIPVDLTTEDLVERVREETAGWGADVAFECSGAPKAYETFWKLIAPGGCAVLVGIPVNPVPIDVTELQATEVRIENIFRYANVYQKAIDLVDSGRLNLKPFITDTFAMKDAKAAFDRMDEGRPGDIKLQITVNRD

SEQ ID NO: 9966 - DNA, 1059 bp, Haemophilus somnus 2336
  CDS (1)..(1059): transl_table=11
atgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtacaaatccgctggtaacttaccctagaattttaggacatgaaattgttggtacagtcattgaagctggtgttggtatgccaaaaaatattaatataggtgatcgtgtaattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggtgaacacgttgctatcatcggtgcaggtgcgattggactgatggccgcattagttgccaaagcttatggtgcgacaccaattttaattgacattttagacaagcgattagattacgcaaaatctattggcattccaaatataattaacccggcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaatgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaa

SEQ ID NO: 9967 - protein, 352 aa, Haemophilus somnus 2336
MSINFVKEGNIMSKYVRSVCLVEPKKVDIKTVLYPKKGECDVLIKVESIGICGSDIGAFRGTNPLVTYPRILGHEIVGTVIEAGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 9968 - DNA, 993 bp, Listeria monocytogenes str. 4b H7858
  CDS (1)..(993): transl_table=11
atggagctaagagatgtagaagaaccacaagtctatggcgacaaagtaaaaatcaaagtagcattcactggtatttgcggatcagacatccatacgtttaaaggtgaatacaaaaatccaacaactcccgtcacactgggacatgaattttctggtgtcgttgtagaagttgggccagatgtaacaagtatcaaagtgggagaccgtgtcacaagtgaaacaacttttgaaacttgtggagaatgtatttattgtaaggaacgtgattacaatttatgtagcaatcgtcgcggcattggtacgcaagcaaatggtagttttgcagaatttgttttatctcgcgaagaaagttgtcacgtgcttgatgaacgtatttcgctcgaagcagcagcactaacagaaccgcttgcatgttgtgtgcattcggcgcttgaaaaaacaacgattcgtccagatgacacagtacttgttttcggaccaggtccaattggtttgttactagctcaagttgtgaaagcgcaaggggcaacggtgattatggcaggaattaccaaagatagtgaccgcttacgtctagcaaaagagcttggaatggaccggattgtcgatactttaaaagaagacttggctgaagttgtgcttggcatgacagatggttacggagcggaacgcgtatttgattgttctggcgcagtacccgctgtaaatcaaggattacctctaacgaagaaaaaaggcgattttgttcaagtaggactttttgccgaaaagaaaaatgcgattgatgaagaatccattatccaacgtgaaattgcttatatcggcagccgttcgcaaaaaccatcttcttggattttagcgctcgacttactggcaaatggcaaaatcaatacggataaaatgattactaaagtatacggtttggatgactggcgcgaggctttcgaggcagttatggcaggaaatgaaattaaagtattagtgaaatcttaa

SEQ ID NO: 9969 - protein, 330 aa, Listeria monocytogenes str. 4b H7858
MELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 9970 - DNA, 1047 bp, Listeria monocytogenes str. 1/2a F6854
  CDS (1)..(1047): transl_table=11
atgaaagctttaaaattatatggaaaaagagatttgcgttatgaagaagcggatatgccaacaattgaagagccagatgatgttattttgaaagtgaaaacagttgggatttgtggctcagatatttcaaggtatagtaagcttgggccgtacgtaccaggaatggtatggggtcatgaattttcaggggaagttattgaagttggtagtgaggttacagatattgagattggtgatagggctgccggatgcccagcactctattgtggagagtgtgaatactgtaaaaaaggcgaattcgcccgctgtcggaagctaacagtaatcggagcaagacatcccggagcctatgctgagtatatcaaacttccagcagaaaatgtagtaaaaataccagatgaattagattatgaagctgctgcacttgtcgagccttccgcagtggtcgttcatggattttatcatacgaaattacaagctggtgatgatgtcgtcgttgtcggaagcggcaatatcggtttgctagcaattcaatgggcgaaagtctttggggcaagaagagtgatagcgattgatgtagacgataaaaagctagcacttgcgaaagaagtcggagcagacgtagttattaactctttaaaagaagatcctttagaagtagtcgcagcacatacagatggtctaaacgctgatttagttgtagaagctgcgggatcacctattacatctgcacaagtttttgcctatgcgaaaaaaggtgggggcgtcgttttcctaggaattccatacgcagatgtaacaatcgaacgtttctattttgaaaaaattgtacgtagtgagcttactgtttggggctcatggaatgcaatttctgcaccattcccaggaaaagaatggcaaacaaccattcacttcttagccaataaacaaatcaacattgagccaatgattacacatcgtctttcacttgctgaaggaccagaagtttttgagcgaatctatgaaagaaatgaatttttcgggaaagtattatttttcccagaatga

SEQ ID NO: 9971 - protein, 348 aa, Listeria monocytogenes str. 1/2a F6854
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 9972 - DNA, 1032 bp, Listeria monocytogenes str. 1/2a F6854
  CDS (1)..(1032): transl_table=11
ttgaaagcagtagtaaaaacaaatcccggatatgatcaaatggagctaaaagatgtggaagaaccacaagtctatggcgacaaagtaaaaatcaaagtagcattcactggtatttgcggatcagatatccatacgtttaaaggagaatacaaaaatccaacaactcccgtcacacttggacatgaattttctggtgtcgttgtagaagttgggccagatgtaacgagtatcaaagtgggagaccgtgtcacaagtgaaacaacttttgaaacttgtggagagtgtatttattgtaaggaacatgattacaatttatgtagcaatcgtcgcggcattggtacgcaagcaaatggtagttttgcagaatttgttttatctcgcgaggaaagttgccacgtgctagatgaacgtatttcgctcgaagcagcagcactgacagaaccacttgcatgttgcgtgcattcggcgcttgaaaaaacaacgattcgtccagatgacacagtacttgttttcggaccggggccaattggattattactagctcaagttgtgaaagcgcaaggggcaacggtgattatggcaggaattaccaaagatagcgaccgcttacgtctagcaaaagaacttggaatggaccggattgtcgataccttaaaagaagacttggctgaagttgtgctcggcatgacagggggttacggagcggaacgcgtatttgattgctcaggcgcagtaccagctgtaaatcaaggattacctctaacgaagaaaaaaggcgattttgttcaagtaggactttttgctgaaaagaaaaatgcgattgatgaagaatccattatccaacgtgaaatagcttatatcggcagccgttcgcaaaaaccatcttcttggattttagcgctcgatttactggcaaatggcaaaatcaatacggataaaatgattactaaagtatacggtttggatgactggcgcgaggctttcgaggcagttatggcaggaaatgaaattaaagtattagtgaaatcttaa

SEQ ID NO: 9973 - protein, 343 aa, Listeria monocytogenes str. 1/2a F6854
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 9974 - DNA, 1092 bp, Exiguobacterium sibiricum 255-15
  CDS (1)..(1092): transl_table=11
atgatgacaaaactagtgacagctgtagaagatacgacaaaagtaaaaacgatgcgcgcactcgtcaaggaagaacggggatttggcgctgtcttgaaagaagtcgcagttccttcaccaaaacgtggtgaagtcttgattcgcgtggaagcgacttccatctgcgggacggatgtccacatttacgaatgggacgcgtgggcagcatcacgcgtgaatccgccgtatgttttcggacatgagttttccggtgaagtcgtggaactgggagaagggacgaaacgtctgaaactcggggaccgtgtctcagcggaaacacatatcgtctgtcatcaatgcaaacagtgtctgcgggggcagtatcacatttgtaaaaacacaaaaatcatcggcgtcgatacacaaggctgtttcgccgagtacgtcgtcatgccggaagaaaatctctgggtcaatccggaggatatgccagccgccatcgcatcgattcaagagccgatgggcaatgccgttcacacggttcttgcgagtgacgtcagcgctaaaacggtcgccatcgtcggttgcggtccaatcggtctgatggctgtctcggtcgcaaaagcggcaggagctgcggaagtcattgcgattgatgtcaatccgtaccggttggagcttgcgaaaacgatgggcgcagatgtcgtcatcgattcacgccacgaggatgttctcgaacgggtccggatgatgacggacggggacgggattgatgtcgtctgtgaaatgagcggtcatccggttgcgattcgtcaagcatttgagatggtgacagccggcggagacgtcaacattctcagtctgccggtcaaaccggtcgagattgatctgacgaatcacgttgtttttaaaggtgttcgcgttcaaggcatcaccggacggaaaatgtatgagacatggagtcaagtatccgcattcctgtcgagcggaaaagtcgatgtcaaaccgttgattacacacacattgccactcgaacggtttgaagaaggattcgaattgatgcgacaagggaaatgtggaaaggtcgtactacaaccaagggggacgaattaa

SEQ ID NO: 9975 - protein, 363 aa, Exiguobacterium sibiricum 255-15
MMTKLVTAVEDTTKVKTMRALVKEERGFGAVLKEVAVPSPKRGEVLIRVEATSICGTDVHIYEWDAWAASRVNPPYVFGHEFSGEVVELGEGTKRLKLGDRVSAETHIVCHQCKQCLRGQYHICKNTKIIGVDTQGCFAEYVVMPEENLWVNPEDMPAAIASIQEPMGNAVHTVLASDVSAKTVAIVGCGPIGLMAVSVAKAAGAAEVIAIDVNPYRLELAKTMGADVVIDSRHEDVLERVRMMTDGDGIDVVCEMSGHPVAIRQAFEMVTAGGDVNILSLPVKPVEIDLTNHVVFKGVRVQGITGRKMYETWSQVSAFLSSGKVDVKPLITHTLPLERFEEGFELMRQGKCGKVVLQPRGTN

SEQ ID NO: 9976 - DNA, 1002 bp, Kineococcus radiotolerans SRS30216
  CDS (1)..(1002): transl_table=11
gtgaacctcagcgccgtcctgcaggccccgcaccagctcgtcatcgaagatcgcgacaccccccgcccggggagacacgacgtgctggtgcgcgtggaagcggtgggcatctgcggctccgacgtgcactactacgagcacgggcgcatcggctcctacgtggtgcgagcgcccatggtcatcggtcacgaagccgccggcaccatcgtggccgtcggcgacggcgtcgatgcctcccgcgtgggtcagcgggtcgcgctggagccgggcgtgcccgaccgcacctgcgagcagtgcctggcggggcgctacaacctctgcccgaacgtggtcttcttcgccaccccacccgtggacggcgcgatcgcccagctggtgacgatcgacgccgctttcgcccacccggcaccggagcagttgagcccggaacaggccgcgatggccgagcccgtctcggtgggggtgtgggcagcgcgccgtgcccgcatcgcccccggggaccgggtcctggtcaccggcgcggggccgatcggcctgttggcggcgcaggtggcgctggcgttcggcgccgacagcgtcaccgtcaccgacgtcagcgacttccgcctgaaggtcgcccgcgagctgggcttgcgggctcaggcggccacgcaggagctgacggggtctttcgacgtgctgctggagtgctcgggcgcgcccgccgcctggcgcagcggcctgggtgccctggctcccgctgcgcgcgcggtgctcgtgggcatgggggcggatgagctcccgatcgatgtgcccctggtgcagggacgggagatcaccatcaccgggatcttccgttacgccgggacgtatcccaccgcgctgtcgctgatcgcttcgggccgggtcagcacggaggcgatcatcacccaccgcttccccctggcccaggctgaggacgctctcaccgtggggcggcgggaggaccgctccctcaaggccgtcgtcctcccccagcagtga

SEQ ID NO: 9977 - protein, 333 aa, Kineococcus radiotolerans SRS30216
MNLSAVLQAPHQLVIEDRDTPRPGRHDVLVRVEAVGICGSDVHYYEHGRIGSYVVRAPMVIGHEAAGTIVAVGDGVDASRVGQRVALEPGVPDRTCEQCLAGRYNLCPNVVFFATPPVDGAIAQLVTIDAAFAHPAPEQLSPEQAAMAEPVSVGVWAARRARIAPGDRVLVTGAGPIGLLAAQVALAFGADSVTVTDVSDFRLKVARELGLRAQAATQELTGSFDVLLECSGAPAAWRSGLGALAPAARAVLVGMGADELPIDVPLVQGREITITGIFRYAGTYPTALSLIASGRVSTEAIITHRFPLAQAEDALTVGRREDRSLKAVVLPQQ

SEQ ID NO: 9978 - DNA, 1050 bp, Kineococcus radiotolerans SRS30216
  CDS (1)..(1050): transl_table=11
gtgagggccgtcgtcgtccacggtgccggtgatctccgcgtcgaggagcgacccgacccgcagccaggtccgggtgaggtgctgctggccctggagtggggcgggatctgcggttccgacctggcctactggcgccacggagcctccggcaccgcgcagctcgagcaccccctcgtcctggggcacgaagtcgccggaacggtcgcggcactcggcccggacgtcaccggcgtggaggtcggacgagccgtcaccgtccacccggccaccctggtgggggagggggacctccccgcccgcatcgccgggcgcaccaacctgtggccgcaggtgcgctacttcggctccgcggcgttcgaccctcacaccgacgggggcttcagccagttccgcaccgtgcgctcggaccagctgcggttcctgcccgagggggtcgacaccctgcgcggcgccctggccgaaccgctggccgtggccatgcacgccgtcggccgcgccgggtcgctcgccggccgcgacgtgctcgtcaacggtgcgggccccatcggatccctcgtcgtcgccgcggccgtgcacgccggcgccgcgagcgtgacggccgccgacgtctcacccgctgccctgcgggtggctgcggccatgggggcgcggagcgtgctggacctctcggccggtgcggtgctgccggccgacgtcgaactcgtcttcgaggccagcggagcggctgccgctctcggcggggtcctgcgggccaccgctcgcgggggcacgctcgtgcaggtcggaaacctccccggtggtgcggtgcaggccgtcctgggtgacctcgtcactcgcgagatcacctggatcgggtcctaccggttcgtggaggagatcgacgacgcgctggtcgctctggctgagggcctcgacgtcatgcccgtggtcagtcaccgcttcgccatggccgatgcggcggaggcgttcgcggtgatgggtgaccgctccagcggcagcagcaaggtggtgctgcgcctcgacggcaagccggtcgaggacgcgtcgtga

SEQ ID NO: 9979 - protein, 349 aa, Kineococcus radiotolerans SRS30216
MRAVVVHGAGDLRVEERPDPQPGPGEVLLALEWGGICGSDLAYWRHGASGTAQLEHPLVLGHEVAGTVAALGPDVTGVEVGRAVTVHPATLVGEGDLPARIAGRTNLWPQVRYFGSAAFDPHTDGGFSQFRTVRSDQLRFLPEGVDTLRGALAEPLAVAMHAVGRAGSLAGRDVLVNGAGPIGSLVVAAAVHAGAASVTAADVSPAALRVAAAMGARSVLDLSAGAVLPADVELVFEASGAAAALGGVLRATARGGTLVQVGNLPGGAVQAVLGDLVTREITWIGSYRFVEEIDDALVALAEGLDVMPVVSHRFAMADAAEAFAVMGDRSSGSSKVVLRLDGKPVEDAS

SEQ ID NO: 9980 - DNA, 1158 bp, Kineococcus radiotolerans SRS30216
  CDS (1)..(1158): transl_table=11
gtgagcgcacctcacacactcttctgcgccgggcgccggcccgaccgcgctgcgaaggagcagtccatggcagagacgcagaccacagggaagaccatgcaggccgtgatcgtccacggcccgcacgactaccggctcgaggaggtacccgtgcccgtggcgggtccgggcgaggcgctgctcaaggtcgaggccgtgggcatctgcgcgagcgacctgaagtgctaccacggcgccgcgaagttctggggcgacgagaaccggcccgcctgggccgagacggacaccgtcccgggtcacgagttcaccggccgcatcgccgagatcgacgaggaggcctccgagcgctggggcgtcgtcgtgggcgatcgcatcgtcgccgagcagatcgtgccgtgctggaactgccgctactgcaaccgcggtgactaccacatgtgccagccgcacgacatgttcggcttcaagcgccgcacccccggcgccatggccgagtacctcgtcctgccgaaggaggccctggtccacaaggcccccgacgacctcccgccgtggcaggtcgcctacgccgaaccgctgtcctgcgcgctccacgcggtggaacgcgccgacatccgcttcggcgacaccgtcgtcgtcgccggctgcgggccgatcggcctggggatgatcgccggtgctgcggccaagttcccccagcgcatcatcgccctggacgcgttgccgcagaagctggaactggcccggaagtgcggcgccgacgtcacgttgaacatcaccgaggtcgacgtcgtcgaggaggtgaagaagctcaccggaggctacggcgccgacgtctacatcgagggcaccggtcacccgtcggcggtggcgcagggcctgaacctgttgcgaaagctggggaccttcgtggagtactcggtcttcaaggacccggtgacggtggactggtccatcatctccgacgacaaggagctcaacgtcctgggggcccacctggggcagaacacctggccggccgcgctgcggctcatcgcctccgggcgactcccgctggacgagatctgctcgcaccagctgccgctggcccggttccaggagggcctggacctcgtcgccgactccgccaactccgtcaaggtctccctcatcccctga

SEQ ID NO: 9981 - protein, 385 aa, Kineococcus radiotolerans SRS30216
MSAPHTLFCAGRRPDRAAKEQSMAETQTTGKTMQAVIVHGPHDYRLEEVPVPVAGPGEALLKVEAVGICASDLKCYHGAAKFWGDENRPAWAETDTVPGHEFTGRIAEIDEEASERWGVVVGDRIVAEQIVPCWNCRYCNRGDYHMCQPHDMFGFKRRTPGAMAEYLVLPKEALVHKAPDDLPPWQVAYAEPLSCALHAVERADIRFGDTVVVAGCGPIGLGMIAGAAAKFPQRIIALDALPQKLELARKCGADVTLNITEVDVVEEVKKLTGGYGADVYIEGTGHPSAVAQGLNLLRKLGTFVEYSVFKDPVTVDWSIISDDKELNVLGAHLGQNTWPAALRLIASGRLPLDEICSHQLPLARFQEGLDLVADSANSVKVSLIP

SEQ ID NO: 9982 - DNA, 1056 bp, Kineococcus radiotolerans SRS30216
  CDS (1)..(1056): transl_table=11
atgaccaccaccgcccagggtccgatccccacgagcatgcgggccagcgtcctgctggagcagggggtgatcgagatgcaggaacggccggtgccgacgcccggtgacggggaggtgctggtccgggtcggctcggtcggcgtgtgcgggtcggacgtgcactactacaagcacggacggatcggcgacatggtcgtcaccgcccccatcgtcctgggccacgaggtgtccggcaccgtcgtcggcgtcgggcgcggggtgagcgaggaccgcgtgggcgaccgcgtcgcgctcgacccgcaggtgccctgccggcagtgccggcagtgcaagaccgggcggtcgaacctgtgcccgttcatggagttctacgcgaccccgcccttcgacgggacgttctgcgactacgtgaccgcgcccgcggaccaggcgttcacggtgccggacagcctgtccgacgagtccgcggcgctgctggaaccgctgagcgtcggcctgtgggccgcgcacaaggccgacgtcggccccggggaccaggtcctcatcgccggcgccggcccgatcggggcgatgtgcgcgcaggccgtccgcgcccgcggggtcaccgacgtcgtcgtcaccgacttcgtcgactcccgccgcgagcgcatcacctccttcggggcgagccgctcgctgcacccggtggccgacgccgccgagatcgcggagatccgcgccgacgcgttcatcgactgctcgggggcgaccccggcggtggtctccggcatccgcagcacccgcggcggcgggaccgtcgtcctcgtggggctgggcgcggaggagatgccgctgccggtgcagctcatcgccacccgcgagatcaacgtcaccggggtgttccgctacgtcgacacctggccccggggcatcgcgctgaccacctccggcgccgtccacctcgacgacatggtgacggcccggtacccgctggagcaggtggaggacgcgctgaacgcggactccgacccgctgagcatgaaggccgtcgtcgtcgtgaacccgtcccaggactga

SEQ ID NO: 9983 - protein, 351 aa, Kineococcus radiotolerans SRS30216
MTTTAQGPIPTSMRASVLLEQGVIEMQERPVPTPGDGEVLVRVGSVGVCGSDVHYYKHGRIGDMVVTAPIVLGHEVSGTVVGVGRGVSEDRVGDRVALDPQVPCRQCRQCKTGRSNLCPFMEFYATPPFDGTFCDYVTAPADQAFTVPDSLSDESAALLEPLSVGLWAAHKADVGPGDQVLIAGAGPIGAMCAQAVRARGVTDVVVTDFVDSRRERITSFGASRSLHPVADAAEIAEIRADAFIDCSGATPAVVSGIRSTRGGGTVVLVGLGAEEMPLPVQLIATREINVTGVFRYVDTWPRGIALTTSGAVHLDDMVTARYPLEQVEDALNADSDPLSMKAVVVVNPSQD

SEQ ID NO: 9984 - DNA, 1044 bp, Kineococcus radiotolerans SRS30216
  CDS (1)..(1044): transl_table=11
gtgaaggctgtgaccgtccacgcccccggggacctgcgcgtcgaggaggtcgacgcaccggaacccgcccccggcgaggtgctcgtccggatcgtctacggcggcatctgcggctcggacctgcactacgccgccgacggccgcaacggggcctacgtcgtcaccgaacccctggtgctcgggcacgaggtcgtcggggtcgtcgagcgcgccggcccggacacccccgcggccccgcccgcgggcacccgggtcgccgtccaccccgcgaccccctgcgcccccgccggcgccgcggcccccaccgggttgcacctgcgcccgggcgggacgtacctcggcagcgcctccacccacccgcacacccagggcgggttcaccggtctgctcgccgtcggggtggagcggctgcgggaactgcccgccgccctgccgctgcggcgcgcggtcctcgccgaacccctcgcggtggccctgcacgcggtcgggcggctggaggggcgcgtcgccggggcgcgggtcctggtcagcggcgccgggcccatcggggtgctggccgtggccgcgctgaagcgggcgggcgcggcgcacgtcaccgccgccgacctccaggaactgccgctgcgggtcgccacggccgtcggcgccgacgaggtcgtcgacctctcgcgcggcgggtcgctgcccgaggccgggttcgacgtcgtcgtggaggcggccggggtcgtcccgtcgctgctggcggcgatccgcgcggtgcgcccggggggttcgatcctgcagctcggcatcctgcccgccggtccgcagcccgtcccggtcggtgagctgctgtccaaggaggtcgcgctgttcgggacccagcgcttcgacaccgagctggacgccgccgtggaactgctcgccgccgacgactccctcgacgccgtcgtcaccgacgtgttcgggatcgaggacgccgccgcggccttcgcccgggcccgggactccgcgaactcctccaagaccgtcctgcggatcaccccggaccccgacgacgcctga

SEQ ID NO: 9985 - protein, 347 aa, Kineococcus radiotolerans SRS30216
MKAVTVHAPGDLRVEEVDAPEPAPGEVLVRIVYGGICGSDLHYAADGRNGAYVVTEPLVLGHEVVGVVERAGPDTPAAPPAGTRVAVHPATPCAPAGAAAPTGLHLRPGGTYLGSASTHPHTQGGFTGLLAVGVERLRELPAALPLRRAVLAEPLAVALHAVGRLEGRVAGARVLVSGAGPIGVLAVAALKRAGAAHVTAADLQELPLRVATAVGADEVVDLSRGGSLPEAGFDVVVEAAGVVPSLLAAIRAVRPGGSILQLGILPAGPQPVPVGELLSKEVALFGTQRFDTELDAAVELLAADDSLDAVVTDVFGIEDAAAAFARARDSANSSKTVLRITPDPDDA

SEQ ID NO: 9986 - DNA, 1374 bp, Sulfitobacter sp. EE-36
  CDS (1)..(1374): transl_table=11
atgaccgatatcatcaaatgcaaagcggccgtcgcctgggccgttaacgaacctctctcgatcgaggaaatcgacgtaatgccgcctaaggctggcgaagtgcgcatcaaaattatcgcctcgggcgtttgccataccgatgctttcactttgtcgggcgaagatcccgaaggcctgttcccggtcattctgggccatgaagggggcgggattgtcgaatccatcggcgagggcgtcaccagcgtggcggtgggtgaccatgtgatcccgctctacacgccagaatgtggcgagtgcaaattctgcaaatccggcaagaccaacctctgccagaagatccgggaaacccaggggcgcggtctgatgcccgacggtaccagccggttctacaaggatggtcagcccatcctgcactacatgggctgctcgaccttctcggaatacacagtgctgcccgagatatcgcttgccaaggtcaaccccgacgcgccgctggaggaggtctgcctgctgggctgcggcgtcaccaccggcatgggggctgtgatgaacaccgcgaaggtcgaagaggggtcgaccgttgcgatcttcggcatgggcggcattggcctgtccgccgtgatcggcgcgaccatggccaaggccagccgcatcatcgtgatcgatatcaacgaaagcaagttcgatctggcgcgcaagctgggtgccaccgatttcatcaaccccaaggatcacgacaaacccattcaggacgtgattgtcgagatgaccgacggcggtgtggattattcgttcgagtgtatcggcaacgtcaatgttatgcgctcggcgttggaatgctgccacaagggctggggcgaatccgtagtcatcggtgtcgcaggggcagggcaggaaatctcgacccgtccgttccaattggtcacgggccgcgtctggcgggggtcggcctttggcggggtcaagggacgctccgagctacctgactatgtcgagcgctacatgaacggcgagttcaagctgaatgatttcatcacccacaccatggggctggaagagatcaatgaagccttcgacctgatgcatgaaggaaaaagcatccgctcggtcatccacttcggcgaaggatcttccgccggtcgcgccgtttgtaggcgcggccggggtgatctggaagcgttgctggaaagcctaaagtcagcccacctcgcgccgctgtgcatccctgaccagcgctgccattcggtagaacccatgcgccatcttggtgaaaggcgtgagcaggaaaaacgccagcaccgcgccgagatgtataaccaaaagacccggcatccagccggtgccccctgccgcatagagcagcagaccagatag

SEQ ID NO: 9987 - protein, 457 aa, Sulfitobacter sp. EE-36
MTDIIKCKAAVAWAVNEPLSIEEIDVMPPKAGEVRIKIIASGVCHTDAFTLSGEDPEGLFPVILGHEGGGIVESIGEGVTSVAVGDHVIPLYTPECGECKFCKSGKTNLCQKIRETQGRGLMPDGTSRFYKDGQPILHYMGCSTFSEYTVLPEISLAKVNPDAPLEEVCLLGCGVTTGMGAVMNTAKVEEGSTVAIFGMGGIGLSAVIGATMAKASRIIVIDINESKFDLARKLGATDFINPKDHDKPIQDVIVEMTDGGVDYSFECIGNVNVMRSALECCHKGWGESVVIGVAGAGQEISTRPFQLVTGRVWRGSAFGGVKGRSELPDYVERYMNGEFKLNDFITHTMGLEEINEAFDLMHEGKSIRSVIHFGEGSSAGRAVCRRGRGDLEALLESLKSAHLAPLCIPDQRCHSVEPMRHLGERREQEKRQHRAEMYNQKTRHPAGAPCRIEQQTR

SEQ ID NO: 9988 - DNA, 1134 bp, Pseudoalteromonas tunicata D2
  CDS (1)..(1134): transl_table=11
atggaaaatcaattcataaaatcaaaggcagctatcgcatggggtccaaatcaacctttatctattgaagaagttgatgttatgtacccaaaagctggtgaagtattagttaaaattatcgccactggtgtttgccataccgatgcatttaccttatcgggtcaagatcctgaaggtgttttcccagcaattatgggtcatgaaggtgcaggaattgttcatgcaattggtgagggtgtaacaagtgttgctattggtgatcatgtgatcccactttacacccctgagtgtggcgaatgtaaattctgtacttcaggaaaaacaaacttatgccaaaaaatacgagcaactcaaggcaaaggcttaatgcctgacggtactacgcgtttttataaagatggccaacctatttttcattatatgggtacctctacattttctgaatacaccgttttacctgaaatctcacttgcaaaagtaaataaaaccgccccacttgaagaaatttgtttattaggctgtggtgtcacaaccggtatgggcgcggtaatgaataccgctaaagtaaaagcgggcgatacagtggctatttttggtttaggaggcattggcctttctgccattattggcgcacaaatggctggtgccagccaaatcataggggttgatataaatccatcaaaatttgaactggcgaaaaaactaggggcgactttatgtatcaatccaaaagactacgataaaccgatccaagaagtgattgttgaattaaccgatggcggagtcgatttttcatttgaatgtattggtaacgtcgatgtgatgcgctctgcacttgagtgttgccacaaaggctggggtgaatctgtgatcatcggtgttgccggtgcaggacaagaaatctcaacccgccctttccaacttgtaactggccgtgtatggcgcggtagtgcttttggaggcgtaaagggtcgctctgaattaccacacattgttgagcgctatcttgctggtgaatttaaactggacgattttattacccacaccatggcacttgaacaaatcaatgaagcgtttgatttaatgcacagtggtgaaagtattcgttctgttatccattttgatcataaataa

SEQ ID NO: 9989 - protein, 377 aa, Pseudoalteromonas tunicata D2
MENQFIKSKAAIAWGPNQPLSIEEVDVMYPKAGEVLVKIIATGVCHTDAFTLSGQDPEGVFPAIMGHEGAGIVHAIGEGVTSVAIGDHVIPLYTPECGECKFCTSGKTNLCQKIRATQGKGLMPDGTTRFYKDGQPIFHYMGTSTFSEYTVLPEISLAKVNKTAPLEEICLLGCGVTTGMGAVMNTAKVKAGDTVAIFGLGGIGLSAIIGAQMAGASQIIGVDINPSKFELAKKLGATLCINPKDYDKPIQEVIVELTDGGVDFSFECIGNVDVMRSALECCHKGWGESVIIGVAGAGQEISTRPFQLVTGRVWRGSAFGGVKGRSELPHIVERYLAGEFKLDDFITHTMALEQINEAFDLMHSGESIRSVIHFDHK

SEQ ID NO: 9990 - DNA, 1131 bp, Oceanobacter sp. RED65
  CDS (1)..(1131): transl_table=11
atgtcagatacttttattaaatcaaaagcggccattgcttggggtcctggccagcctctcagtgttgaagaagttgatgtcatgatgccgcgcaaaggtgaagtcttggtcaagatcattgcgacaggcgtatgccatactgacgcatttactttgtcaggagaggatcctgagggcaatttccccgcgatattgggacatgaaggtggcggcattgttgaagctgtgggggagggtgttaccagtgtggccgtgggagaccacgttattccgctttatacgccagaatgtggagaatgtaagttttgtacttcgggtaagacaaacctatgtcaaaagattcgtgaaacccagggcaaggggttaatgccagatggcacgtctcgtttttacaaagatggcaagcctatttaccactatatggggacatccacgttttctgagtacacagttctacccgatatttctttggctaaagtgaataagagcgctcccttggaagaggtctgcttacttggatgtggtgtgacgaccgggatgggcgctgttatgaacacagcaaaggttcaggcaggcgatagcgtagccatctttggtttaggtggtattggtttatccgcgattattggggcgacgatggctggtgcgtctcgaattattggtatcgatatcaatgagagtaaatttgagcttgctaagcagctgggtgcaactgattgcattaacccaaacgattatgacaagcccattcaagaagtgatcgtcgaattaacagatggcggcgtggacttctcattcgagtgtattggtaacgttgatgttatgcgttctgctctagagtgttgtcataaaggatggggagagtcagtagtaattggtgttgcaggtgctgggcaagaaatttctacccgtccctttcagttagttaccggacgagtttggcgaggaagtgccttcggtggtgtgaaaggtcggagtgaattgccaggcatagtggaaaagtatcttgcaggtgagttcaagttgaatgatttcatcacccatacaatggggttggaggatatcaatgaagcgtttgatttgatgcatgaaggcaagagtattcgctccgtgattcattacaataaataa

SEQ ID NO: 9991 - protein, 376 aa, Oceanobacter sp. RED65
MSDTFIKSKAAIAWGPGQPLSVEEVDVMMPRKGEVLVKIIATGVCHTDAFTLSGEDPEGNFPAILGHEGGGIVEAVGEGVTSVAVGDHVIPLYTPECGECKFCTSGKTNLCQKIRETQGKGLMPDGTSRFYKDGKPIYHYMGTSTFSEYTVLPDISLAKVNKSAPLEEVCLLGCGVTTGMGAVMNTAKVQAGDSVAIFGLGGIGLSAIIGATMAGASRIIGIDINESKFELAKQLGATDCINPNDYDKPIQEVIVELTDGGVDFSFECIGNVDVMRSALECCHKGWGESVVIGVAGAGQEISTRPFQLVTGRVWRGSAFGGVKGRSELPGIVEKYLAGEFKLNDFITHTMGLEDINEAFDLMHEGKSIRSVIHYNK

SEQ ID NO: 9992 - DNA, 1122 bp, Alteromonadales bacterium TW-7
  CDS (1)..(1122): transl_table=11
atgtctgattttattaaatcaaaagcagcgattgcttggggccctaaccaacctttaagcgttgaagaagttgatgtaatgatgcctaaaaaaggcgaagtaatggtaaaaattactgctactggtgtttgtcataccgatgcatttacattatcaggtgaagatccagaaggtatattcccagctattttaggccatgaaggcgcaggtgttgtttatgcagttggcgaaggtgtaacgagtgttgaagtgggggatcatgtaattccactttacaccgctgaatgtggcgaatgtaaaatgtgtacatctggcaaaactaacttgtgttcagccgtacgcgaaacacaaggtaaaggcttaatgccagacggcacaacacgcttttttaaagacggccaaccaatttaccactacatgggtacgtctacattttctgagtacacagtacttccagaaatttctttagctaaagtaaacaaagaagcctctttagaagaaatttgtttattagggtgtggtgttacaaccggtatgggtgctgtaactaacactgctaaagtaaaagaaggcgatacagtcgctatatttggccttggcggcattggtttatcagccattattggtgcaaaaatggcgggcgcgagtcgtattattggtgtagacattaacaccagtaaatttgaccttgctactaaacttggcgcaaccgatttaataaaccctaaagatttcgacaagccaattcaagaagtgatcgttgaaatgactgacggtggcgttgattactcatttgaatgtattggtaacgttgatgtaatgcgctctgcccttgagtgttgccataaaggctggggggaatcggtaattattggtgtagccggtgctggccaagaaatttcaactcgtcctttccagcttgttaccggccgtgtatggcgtggtagcgcatttggtggcgttaaaggtcgctcgcaacttcctgaaatagttgagcgctacatggcaggcgaatttgcactaaacgactttattactcatacaatgagccttgaagaaatcaacgacgcatttgatttaatgcacgaaggcaaaagtattcgtactgtaattcattactaa

SEQ ID NO: 9993 - protein, 373 aa, Alteromonadales bacterium TW-7
MSDFIKSKAAIAWGPNQPLSVEEVDVMMPKKGEVMVKITATGVCHTDAFTLSGEDPEGIFPAILGHEGAGVVYAVGEGVTSVEVGDHVIPLYTAECGECKMCTSGKTNLCSAVRETQGKGLMPDGTTRFFKDGQPIYHYMGTSTFSEYTVLPEISLAKVNKEASLEEICLLGCGVTTGMGAVTNTAKVKEGDTVAIFGLGGIGLSAIIGAKMAGASRIIGVDINTSKFDLATKLGATDLINPKDFDKPIQEVIVEMTDGGVDYSFECIGNVDVMRSALECCHKGWGESVIIGVAGAGQEISTRPFQLVTGRVWRGSAFGGVKGRSQLPEIVERYMAGEFALNDFITHTMSLEEINDAFDLMHEGKSIRTVIHY

SEQ ID NO: 9994 - DNA, 1086 bp, marine gamma proteobacterium HTCC2143
  CDS (1)..(1086): transl_table=11
atgaaagcagtcgtcgtcgatgcattaaatgaattttcggtccaagaagtacagctggactcaccgaaggccggtgaagtacgagtaaaaatggtggcaacgggtgtatgtcgatcagactggtcggttatttcaggaactattccgatgccactgcctgctgtcatcggacacgaaggtgctggaatcattactgaactcggtgagggtgtcgacaaatttgctctgggtgatcatgtggtactgtcttttataccggagtgcggagactgtttttattgcaaaaatgaccaggcctatctttgcgcgtcaaagaataatgcggctggcggtatgctggacggaaccactcgtgttcatcgcggtgatgaagatgtcatggttatgactcaattaggttgcatggcggaagagtgtattgcccctgcgattagctgtgtgaaaattaatgacgatgtaccccttagttctgccgcgctgatcggttgcggtgttatgacaggtgtaggcgctgcactgaacgccgcaaaagtgaagccaggctccaccgctgtagttttcggttgtggtggcattggtttgtctaccatccagggcgcttgtattgcgggtgctaaaaatgtggtggcagttgataccttgccgggcaagttagacatggctaaaacatttggcgccactcacggttgtctgttggaagatgccaatgagttcatcctcgaactgactgaaggtcgcggcgcagactactgttttgaggccgttgggaatacagcgctgatgcagcttgctgaagctagtacccgcccgggcggcgtctgtacggtgatcggtgttggaaaaatggatgagcaatttgtactgagtccgttcatgttacctctcactggcaagcgcatacagggtacgatgtatggcaattgtaacccctcgaaagacttccctaaattgttagattactacaagaagggtgagttggatctggatggcatgatcaccaaaacctatagcattgatcaggcgtcagaggcttttgcggacttgacgtcgggggcgaatgcccgtggtgtaatcatctacgactag

SEQ ID NO: 9995 - protein, 361 aa, marine gamma proteobacterium HTCC2143
MKAVVVDALNEFSVQEVQLDSPKAGEVRVKMVATGVCRSDWSVISGTIPMPLPAVIGHEGAGIITELGEGVDKFALGDHVVLSFIPECGDCFYCKNDQAYLCASKNNAAGGMLDGTTRVHRGDEDVMVMTQLGCMAEECIAPAISCVKINDDVPLSSAALIGCGVMTGVGAALNAAKVKPGSTAVVFGCGGIGLSTIQGACIAGAKNVVAVDTLPGKLDMAKTFGATHGCLLEDANEFILELTEGRGADYCFEAVGNTALMQLAEASTRPGGVCTVIGVGKMDEQFVLSPFMLPLTGKRIQGTMYGNCNPSKDFPKLLDYYKKGELDLDGMITKTYSIDQASEAFADLTSGANARGVIIYD

SEQ ID NO: 9996 - DNA, 1023 bp, Escherichia coli B
  CDS (1)..(1023): transl_table=11
atgtctacgatgaatgttttaatttgccagcagccgaaagaattagtctggaaacaacgcgagattcctattccgggtgacaatgaagcattaataaaaattaagtctgtcgggatttgcggtaccgatattcatgcctggggtggaaatcaaccattttttaattatccacgggttttaggccatgaaatatgtggggaggttgttgggctgggtaaaaatattgctgatcttaaaaatggtcagcaagttgctgtgatcccttatgttgcctgtcagcaatgcccggcgtgtaaaagcgggcgtaccaattgctgtgaaaaaatttcagtcattggcgtgcatcaggatggcggttttagtgagtatttgagcgtgccggtggcgaacattttgcccgcagacggtattgacccgcaggcggccgcattgattgaacctttcgctattagcgctcatgcggtgcgtcgcgcagccattgctcccggcgagcaggtgctggtggtcggagcggggccaatcggtctgggcgcggcggcaatcgctaaagccgatggcgcacaggtggtggtggcggataccagtccggcgcgccgtgaacatgtggcaacgcgtctggagttgcccgtgctggacccgtcagccgaagattttgacgcgcagctgcgggcgcagtttggtggttcgctggcgcagaaagtgatcgacgcgacaggtaatcaacatgcgatgaataacaccgtgaatctgattcgtcacggcggcacggtggtatttgtcggcctgtttaaaggtgagttgcagttctccgatccggaattccataaaaaagaaacgacgatgatgggcagccgcaacgccacgccggaagatttcgctaaagtcggtcgacttatggcggaagggaaaatcactgccgacatgatgttaacccatcgctatccgttcgccacgctggcagaaacctacgagcgcgatgtgattaacaatcgtgagttaattaaaggcgtaattactttctga

SEQ ID NO: 9997 - protein, 340 aa, Escherichia coli B
MSTMNVLICQQPKELVWKQREIPIPGDNEALIKIKSVGICGTDIHAWGGNQPFFNYPRVLGHEICGEVVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPVLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 9998 - DNA, 1089 bp, Pseudomonas putida GB-1
  CDS (1)..(1089): transl_table=11
atgaacgacctgagccacacccatatgcgcgccgccgtctggcatggccgcaacgatattcgcgtcgaacaggtacccctgccagccgaccctgcgccgggctgggtacagatcaaggtggactggtgcggcatctgcggctccgacctgcacgaatacgtcgccggcccggtattcatcccggtggaggccccgcacccactgactggcattcagggccagtgcatcctcggccacgaattctgcggccagatcgccaagctgggtgaaggcgtggaaggctttgcggtcggcgacccggtggccgcagacgcctgccagcattgcggcacctgctactactgcacccacggcctgtacaacatctgcgagcgcctggccttcaccggcctgatgaacaacggcgccttcgccgagttggtcaacgtgcctgccaacctgctctaccggctgccgcagggcttccctgctgaagccggggcactgatcgagccgctggcagtgggcatgcatgcagtgaaaaaggcgggcagcctgctcggccaaaccgtggtggtggtgggtgctggtaccattggcctgtgtaccatcatgtgcgccaaggctgcgggagcagcgcaggtcattgcccttgagatgtcctcggcgcgcaaggccaaagccaaggaagtcggtgccagcgtggtgctggaccccagccagtgcgatgccctggcgcaaatccgcgcactcactgccgggttgggggcggatgtgagctttgagtgcatcggcaacaagcacacggccaagttggccatcgacaccatccgcaaggcgggcaagtgtgtgctggtgggcattttcgaagagcctagcgagttcaactttttcgaactggtgtccaccgagaagcaggtgctgggggcgttggcgtacaacggtgaatttgccgatgtgattgcctttatcgctgatggacgactggatattcgccccttggtgaccgggcggatcgggctggagcagattgtcgagctgggcttcgaggaactggtgaacaacaaggaagagaacgtgaagatcatcgtttcaccgggcgtgcgctga

SEQ ID NO: 9999 - protein, 362 aa, Pseudomonas putida GB-1
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEVGASVVLDPSQCDALAQIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 10000 - DNA, 1059 bp, Marinobacter sp. ELB17
  CDS (1)..(1059): transl_table=11
atgaaagctgctcgtttttatgacaaaggtgatatccggattgaagatatccccgaaccgacggtagaaccaggcactgtgggcatagatgtagcctggtgcggtatctgtggtaccgatttgcatgaatttatggaggggcccatctttattcctccgtgcggccacccccacccggtctcgggagaatctgcgccgataacaatggggcatgagttttcaggtgtggtttatgctgttggtgacggtgtagacgatattgaaattggtcagcacgttgtggttgaaccttatattattgcggatgatgtggacacgggcccgggtgagagttaccagttgtccaaaaacatgaactttattggccttggtggccacggtggcggcttatccgaaaaaatagcagtcaaacgtcgctgggtgcatccgatttctgacgccattcccctcgatcaagccgctttaattgaacctcttacggttggctatcacgcgtttgttcgcagtggcgccaaagccggcgatgttgctctggtgggcggtggtgggcctattggcctgttattggcgtctgtgttaaaggccaagggtataaccgttatcctcacggaattgagcgcaaagcgtaaggaaaaagcggaagaaaccggcgttgcggattatgttttggatccctctgaagtcaacgtgaccgaagaggttatgaagattaccaaagatcggggtgtggatgtttcttttgagtgcagcagcatcaatgaagtgctggatacgctggtagagacgacaaaaccgggtgggaccgttgtcatcgtatcgatttggagccacccagcgacggtgaatgtacacagcgttgtgatgaaagaactggacgtgcgtggaaccattgcttacgcaaacaaccatgcagaaaccattaagctggtagaggaaggtaaagtgaacctcgaaccgtttattactcagcgaattcaattagatgatctggtttctgaaggcttcgaaaggctaattcataataacgaatcagcagtaaagatcattgttcatacataa

SEQ ID NO: 10001 - protein, 352 aa, Marinobacter sp. ELB17
MKAARFYDKGDIRIEDIPEPTVEPGTVGIDVAWCGICGTDLHEFMEGPIFIPPCGHPHPVSGESAPITMGHEFSGVVYAVGDGVDDIEIGQHVVVEPYIIADDVDTGPGESYQLSKNMNFIGLGGHGGGLSEKIAVKRRWVHPISDAIPLDQAALIEPLTVGYHAFVRSGAKAGDVALVGGGGPIGLLLASVLKAKGITVILTELSAKRKEKAEETGVADYVLDPSEVNVTEEVMKITKDRGVDVSFECSSINEVLDTLVETTKPGGTVVIVSIWSHPATVNVHSVVMKELDVRGTIAYANNHAETIKLVEEGKVNLEPFITQRIQLDDLVSEGFERLIHNNESAVKIIVHT

SEQ ID NO: 10002 - DNA, 1062 bp, Candida sp
  CDS (1)..(1062)
atgtctactcctgaaaacttatcttttgttttacaaaagccttttgacgtcaagttcgaggatagacccatccccaagttgtctgatccttactctgtcaagatccaagtcaagaagactggtatctgtggtagtgatgttcattacttcacccatggagctattggtgactttgtcgtcaaggccccaatggtccttggtcacgaatccagtggtgttgtcttggaagtcggtagcgaggtcaagtcactcaaggttggtgacagagtcgctatggagcctggtgttcccagcagacactctgatgaatacaagtccggtagatacaacttgtgtcctcacatggcatttgctgctactcctccttatgatggtactctttgtaaatactatattcttcctgaagacttctgtgtcaagttacctgagcacgtttctttggaagagggtgctttagttgaacctttaagtgttgcggttcactcctctaagttgggtaacattaagcccggtagccatgttgccatttacggtgcaggacctgttggtttgttagttgccgcagtcgccagtgcttttggtgctgaatctgttactattattgatcttgttgaatctagacttaaccttgccaaggagttaggtgctactgccactgttcaagttgatttcaaggatactcctaaggagtctgctgctaaggttgttgccgctaacaacggaattgcccctgatgttgtcattgatgcttctggtgctgaggcttccattaatagtgctatcaatgccatcagacctggtggcacttacgttcaagtcggtatgggtaagcctgatgtctctttccccattgctactttaattggtaaggagcttactgttaagggatctttcagatatggttacggtgactaccctcttgctgtcagcttgcttgctagtggaaaagtcaatgttaaaaagttgattacccatgaagtcaagtttgaggatgctgctgaagctttccaattggttagagatggaaaggctatcaagtgcatcattaacggccctgagtaa

SEQ ID NO: 10003 - protein, 353 aa, Candida sp
MSTPENLSFVLQKPFDVKFEDRPIPKLSDPYSVKIQVKKTGICGSDVHYFTHGAIGDFVVKAPMVLGHESSGVVLEVGSEVKSLKVGDRVAMEPGVPSRHSDEYKSGRYNLCPHMAFAATPPYDGTLCKYYILPEDFCVKLPEHVSLEEGALVEPLSVAVHSSKLGNIKPGSHVAIYGAGPVGLLVAAVASAFGAESVTIIDLVESRLNLAKELGATATVQVDFKDTPKESAAKVVAANNGIAPDVVIDASGAEASINSAINAIRPGGTYVQVGMGKPDVSFPIATLIGKELTVKGSFRYGYGDYPLAVSLLASGKVNVKKLITHEVKFEDAAEAFQLVRDGKAIKCIINGPE

SEQ ID NO: 10004 - DNA, 1101 bp, Zea mays
  CDS (1)..(1101)
atggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtggtgaaggagccgatggtgatcgggcacgagtgcgcgggcgtggtcgaggaggtgggcgccggcgtgatgcacctgtccgtgggcgaccgcgtggcgctggagccgggcgtcagctgctggcgctgccgccactgcaagggcgggcggtacaacctgtgcgaggacatgaagttcttcgccaccccgccggtgcacggctcgctggcgaaccaggtggtgcacccggccgacctgtgcttcaagctccccgacggtgtgagcctggaggagggcgccatgtgcgagccgctgagcatgggcgtgcacgcgtgccgccgcgcgggggtggggcccgagacgggcgtgctcgtggtgggcgccggccccatcggcctggtgtcgctgctggcggcgcgggccttcggcgcgccgcgcgtgttggtcgtggacgtggacgaccaccgcctggccgtggccaggtcgctgggcgcggacgcggcggtgcgggtgtcgccccgcgtggaggacctggcggacgaggtggagcgcatccgcgcggccatgggctcggacatcgacgtcagcctggactgcgccgggttcagcaagaccatgtcgacggcgctggagtcgacgcggcccggcgggaaggtgtgcctggtcgggatgggccacaacgagatgacgctgcccttgacggcggcggcggcgcgggaggtggacgtggtgggcgtgttccggtacaaggacacctggccgctgtgcatcgacttcctgcgcagcggcaaggtggacgtcaagccgctcatcacccaccgcttcggcttctcgcagcgggacgtggaggaggccttcgaggtcagcgcccgcggccgcgatgccatcaaagtcatgttcaacctctag

SEQ ID NO: 10005 - protein, 366 aa, Zea mays
MGKGAQGSDAAAAGGEVEENMAAWLVAKNTLKIMPFKLPPVGPYDVRVRMKAVGICGSDVHYLREMRIAHFVVKEPMVIGHECAGVVEEVGAGVMHLSVGDRVALEPGVSCWRCRHCKGGRYNLCEDMKFFATPPVHGSLANQVVHPADLCFKLPDGVSLEEGAMCEPLSMGVHACRRAGVGPETGVLVVGAGPIGLVSLLAARAFGAPRVLVVDVDDHRLAVARSLGADAAVRVSPRVEDLADEVERIRAAMGSDIDVSLDCAGFSKTMSTALESTRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 10006 - DNA, 1146 bp, Phaeosphaeria nodorum
  CDS (1)..(1146)
atggaagctgtcgaagctgagcagtccagcattgccaacatggaaaccacatctcttccggaaatgaatgaatcattcgtcttgagcccggagaggcagttcagtttcgaaaaccgatcgatacctgctctgcgaacttctagagatgttcgcgtcaggattatagctaccggtctttgcggctccgatatacattattggcaacatggtcgcattggaccgtacgttgtcaacggcccaatcgtccttggccacgaatctgctggcatcgtcgaatcgattgggaatgatgtcaagaaccttcgcgttggtgacagagtcgccctggagcccggagtaggctgcaatatctgcgaagcttgtcggataggccgttacaacctgtgcagttcgatgcgttttgccgccactcctccacacgatggcacattgtcgacgttctattgcttgcccgaagagtgctgctataaactgccagagcacgtatcgttccaagaaggcgcactggtagagccgcttagcatcgctgtacattgctgcggactggcggggaacctacaaggaagaagcatagctgtgtttggtgctggtcctataggtctcctatgtgccgctgtagcaagcgcttttggtgcggcgacagtcgttgctgtagatattgtagagtcgcggctcgaagtcgtgaaaacttttggagctacacatacttacaagatgcagagcctgctacctgagctgaactccatccaattactggagcaatccggctgtaaagagggcgtggatgttgtcatcgatgctactggggcagagccatgtatcgagtgcggagtatgggcattaaagcgcggaggaacttttgtccaggctggtctcggatctccccgcattgcatttcccatcggtcaattatgcgacaaggaggctgttctgaaaggcagctttcgctatgggccaggcgactacaagctcgcgatttcgttgctcgagtcaagacgtattcggttggcaactcttataacccatgaatttccgttttcggaagccgagaaggcattcaacaacgtccatgagcggaatggtgtcaagagtatcatttacggccccggtttggatgctcatacagcatgcgcatgtccgccttag

SEQ ID NO: 10007 - protein, 381 aa, Phaeosphaeria nodorum
MEAVEAEQSSIANMETTSLPEMNESFVLSPERQFSFENRSIPALRTSRDVRVRIIATGLCGSDIHYWQHGRIGPYVVNGPIVLGHESAGIVESIGNDVKNLRVGDRVALEPGVGCNICEACRIGRYNLCSSMRFAATPPHDGTLSTFYCLPEECCYKLPEHVSFQEGALVEPLSIAVHCCGLAGNLQGRSIAVFGAGPIGLLCAAVASAFGAATVVAVDIVESRLEVVKTFGATHTYKMQSLLPELNSIQLLEQSGCKEGVDVVIDATGAEPCIECGVWALKRGGTFVQAGLGSPRIAFPIGQLCDKEAVLKGSFRYGPGDYKLAISLLESRRIRLATLITHEFPFSEAEKAFNNVHERNGVKSIIYGPGLDAHTACACPP

SEQ ID NO: 10008 - DNA, 1134 bp, Phaeosphaeria nodorum
  CDS (1)..(1134)
atgacttcagccgtttcgattcaagacatgaagaatccttcaatcgttctgtatggcgcgaagaacgcgaaacttgaagaaagaccggtaccagaactctcggatccgaacaatgtgattgtgagaattgcgtatgtcggcgtgtgtgggagcgatgtccacttctacacccacggcggcataggccgctccgtcgacccctccaccggcctcacaatgggccacgaagccagcggcaccatcacctccgtcggcccctccgtaacttcctttaaaatcggcgaccgcgttgctatcgaaccaggcacaccctgccgccgctgcgccgcctgtaaatccggcacatacaacctctgccgccacatgctcttcgccgccgcccccggcccgccctccacgcccggcacgcccggtacgctcagcaaattctacgagatggcggaggacttgtgctacgtgatccccgacgccatcagtctgcaagaagcggtgttggtcgagcctctcgccgtcgccgtccacgctgtgaagttgggcgatgtgcggcccggcgagacggtggttgtcatgggctgcgggacaatcggactactcgtcgctgcagtggcgcggctattcggcgcgctgagagtcgtgatggtggatgttagggaggacaaagtaaagtttgcaaaggggtggatgcagggtgcagagggatttatagcggatgtgggcatgtctggggaagatgtggcggagaagatgttagaagagtttgggttgaaggaggagggggttgatacttcaggcggcaaaatcgacactgtaatcgaagcctcgggcgccgcgagttgcgtcgaagctggaatctgcatgttgcggccgggtgggaagtatgtgcaaaccggactggggagggagaagattgaattcccgattgtcgcgatgagtcagaaggagttggtggttagggggtgttttaggtacggcgcgggggattacgagctcgcggtgaagtatctggaaaaaggggcagttgacgccaaggcgttgattagttcggtgagtcggtttgaggatgcggtgagcgcatgggagaagacgatgagggggaagggtgtgaagaatttgatcgagggggtgagagattga

SEQ ID NO: 10009 - protein, 377 aa, Phaeosphaeria nodorum
MTSAVSIQDMKNPSIVLYGAKNAKLEERPVPELSDPNNVIVRIAYVGVCGSDVHFYTHGGIGRSVDPSTGLTMGHEASGTITSVGPSVTSFKIGDRVAIEPGTPCRRCAACKSGTYNLCRHMLFAAAPGPPSTPGTPGTLSKFYEMAEDLCYVIPDAISLQEAVLVEPLAVAVHAVKLGDVRPGETVVVMGCGTIGLLVAAVARLFGALRVVMVDVREDKVKFAKGWMQGAEGFIADVGMSGEDVAEKMLEEFGLKEEGVDTSGGKIDTVIEASGAASCVEAGICMLRPGGKYVQTGLGREKIEFPIVAMSQKELVVRGCFRYGAGDYELAVKYLEKGAVDAKALISSVSRFEDAVSAWEKTMRGKGVKNLIEGVRD

SEQ ID NO: 10010 - DNA, 1116 bp, Phaeosphaeria nodorum
  CDS (1)..(1116)
atgagttctactacggtcacagaggtcaagccgtccaaggcaaacattggtgtttacacgaatccagcgcacgatctatgggttgcggaagctgaaccgagtctggaggttgtggagaagggtggtgatttgaaggagggagaggttctgctcaacgtgaagagtactggaatctgtggatctgacattcacttctggcatgccggctgcattggtcctatgatcgttgaagacacacacatccttggccacgaatccgctggcacagtccttgctgtccacccctccgtctctactctcaaagtcggcgaccgcgtagcaatagaacctaatgtcatctgccacgaatgcgagccctgcttgacgggacgctacaacggctgcgagaaagtacagttcctctcaacaccacccgtcactggtcttctacgccgataccttaagcacccagctatgtggtgtcacaaactgcccgacaacctcaccttcgaagacggcgccatgttggaaccgttatcagtcgcactagcaggtatggaccgcgcgaacgtccgacttggagatcccgtggtcatctgcggcgctgggcccatcggtcttgtcacccttctctgcgctcgtgcagcaggtgccgcgccaatcgtcatcacagacatcgacgagggccgcctcaagtttgccaaggatctcgtccccaacgttgcaacgcacaaagtggaattttcacactcggtcgacgacttccgcaacgccgtcattgccaagatggaaggcgtcgaacccgccatcgcaatggaatgtacgggcgtcgaatccagcattaacggcgccatccaagctgtcaagttcggcggcaaggtcttcgtcattggcgtgggtaagaacgagatgaagattcctttcatgcgcctgtcgacccgcgaggttgatcttcagttccagtatagatactgcaatacttggcccaaggccataaggctggtcaagagcggcgttattgagctgagtaagctagtaacgcataggttccagttggaagatgcggttcaggcgtttaagacagcggcggatccaaagactggggctatcaaagtacaaattcagagtttggactag

SEQ ID NO: 10011 - protein, 371 aa, Phaeosphaeria nodorum
MSSTTVTEVKPSKANIGVYTNPAHDLWVAEAEPSLEVVEKGGDLKEGEVLLNVKSTGICGSDIHFWHAGCIGPMIVEDTHILGHESAGTVLAVHPSVSTLKVGDRVAIEPNVICHECEPCLTGRYNGCEKVQFLSTPPVTGLLRRYLKHPAMWCHKLPDNLTFEDGAMLEPLSVALAGMDRANVRLGDPVVICGAGPIGLVTLLCARAAGAAPIVITDIDEGRLKFAKDLVPNVATHKVEFSHSVDDFRNAVIAKMEGVEPAIAMECTGVESSINGAIQAVKFGGKVFVIGVGKNEMKIPFMRLSTREVDLQFQYRYCNTWPKAIRLVKSGVIELSKLVTHRFQLEDAVQAFKTAADPKTGAIKVQIQSLD

SEQ ID NO: 10012 - DNA, 1185 bp, Phaeosphaeria nodorum
  CDS (1)..(1185)
atggcgccttcagctttagcagacatgtatccaatcccagcgaggcactaccacaagccctcgactgtggtagcatccgtcctgcatgggccaagggatttgcggctcgaaacccgtcccatcacagaccctggaccgaacgaacttcagatagcaatcaaggctactggtctttgcggaagcgattgctcctactacagcaagtttcgcaacggtgatctgcatgcctgtcagccactctcactcggccatgagtctgccggcgtcgtagtcgcgataggcgagagtgtcagcggcttccagattggcgagcgtgtcgcgttagaggttggcgtgccatgcgacaattgcaggtcctgtcaacgcggccggtacaacctgtgccctaagatgcgattcaggagtagcgccaaatcagtgcctcactttcagggaacccttcaggaacgcatcaaccaccctgcgaaatggtgccacaaacttcccgcacatgtctccatggagtcggcggcattgttagagcctctgtctgtagcgatacatgccacacggagagctcacatcgaacagggtgacaccgctatcgtcttcggtgcaggcgccgtgggccttttgaccgcggcgatggccaaagtttctggcgcgacgaccgttgtaattgctgacatcgactatggtcggatcaactatgcccttgcgaatggtttcgcgcacaagggctacattgtgactcctcaaagagaagcgactgagactgcggagaagcttgaccaggcgaaagaactggcgacagacattatgcaaattgcttcgctcaacgatccggaattcgagggagccgacgtgacatttgactgcactgggaaggagatctgcatgcaagccggtctatacgcaacaagacctggcgggcagcttgtcatggtaggaatgggcactcctatccagactctcccaatgtccgcttcccacttgaaggaagttgatatcatcggcatcttccgctacgccaacacttacccaactggcataaaattgatttctgctggagttcttccaaacctcgacaacatgattacccataggtatcatgggcttgcatctgtgaaggaggctttcgagctcgctggcaagactctcgacaacgacggcaatcttgttctgaaggtcctcgtcgagatgtaa

SEQ ID NO: 10013 - protein, 394 aa, Phaeosphaeria nodorum
MAPSALADMYPIPARHYHKPSTVVASVLHGPRDLRLETRPITDPGPNELQIAIKATGLCGSDCSYYSKFRNGDLHACQPLSLGHESAGVVVAIGESVSGFQIGERVALEVGVPCDNCRSCQRGRYNLCPKMRFRSSAKSVPHFQGTLQERINHPAKWCHKLPAHVSMESAALLEPLSVAIHATRRAHIEQGDTAIVFGAGAVGLLTAAMAKVSGATTVVIADIDYGRINYALANGFAHKGYIVTPQREATETAEKLDQAKELATDIMQIASLNDPEFEGADVTFDCTGKEICMQAGLYATRPGGQLVMVGMGTPIQTLPMSASHLKEVDIIGIFRYANTYPTGIKLISAGVLPNLDNMITHRYHGLASVKEAFELAGKTLDNDGNLVLKVLVEM

SEQ ID NO: 10014 - DNA, 1077 bp, Phaeosphaeria nodorum
  CDS (1)..(1077)
atgacgacaaagacagctacccagaagaatccttccttcgtgctgcaagcacccaacaaagttgtctacgaggacaggcccatccccgatctcccttcaccatacgatgtcattgtcaagccaaaatggactggtatttgcgggtcagatgtgcactactgggttgagggacgcatcggacactttgtcgttgagtcacccatggtcctcggtcatgagtccgctggaatcgtacacaaagttggcgataaggtcaagtcactgaaagttggcgaccgcgtggcaatggaaccgggtgtgccttgccgtcgctgcgtacgctgcaaagagggaaagtacaacctttgcccagatatggctttcgctgctacacccccatacgacggaacgcttgcacggtactatgctctgcccgaggactactgctataagctcccagagaacatgagtcttgaggagggcgcacttatcgagcctactgccgtcgcggtgcacatcactcgacaagcatcaatcaagccgggagactctgtggttgtattcggtgccggtcccgttggtctgctatgctgtgctgtcgcaaaagcatatggcgcaaagaagatcgtcacagtcgacatcaacgagcagagactaaacttcgcactccagtacgctgcgacggacaagttcagcagcgcacgagtcagcgcggaggagaatgcaaagaacttgatcaaggactgcgaactcggtcctggcgcggacgtcattatcgatgcgtcgggtgcggagccgtgtatccagaccgcgatccacgcgctgagaatgggtggaacttatgttcagggcggcatgggcaagccagacatcaacttccccatcatggccatgtgcaccaaagagctcaacgtcaagggctctttccgctacggcgccggcgactaccaaaccgccgtcgatctcgttgctggcgggcgcatctcgatcaaggagctgattaccggcaaggtcaagttcgaagatgcggagaatgcgttcgcgcaggtcaagaagggtgagggaatcaagctgcttattgagggacctgaggagtga

SEQ ID NO: 10015 - protein, 358 aa, Phaeosphaeria nodorum
MTTKTATQKNPSFVLQAPNKVVYEDRPIPDLPSPYDVIVKPKWTGICGSDVHYWVEGRIGHFVVESPMVLGHESAGIVHKVGDKVKSLKVGDRVAMEPGVPCRRCVRCKEGKYNLCPDMAFAATPPYDGTLARYYALPEDYCYKLPENMSLEEGALIEPTAVAVHITRQASIKPGDSVVVFGAGPVGLLCCAVAKAYGAKKIVTVDINEQRLNFALQYAATDKFSSARVSAEENAKNLIKDCELGPGADVIIDASGAEPCIQTAIHALRMGGTYVQGGMGKPDINFPIMAMCTKELNVKGSFRYGAGDYQTAVDLVAGGRISIKELITGKVKFEDAENAFAQVKKGEGIKLLIEGPEE

SEQ ID NO: 10016 - DNA, 1188 bp, Phaeosphaeria nodorum
  CDS (1)..(1188)
atgtcgaatgatataagcccagacgtgtcgcagggcaagcggcaaattcgcgcatctgtcctgcatggcgcgaaagacttgagaatcgagaatcgctcaatttccccaccagcaccgacggaacttcaaatcagtgttcgaagcacaggcctctgcggctcagacttacactactatcgacattaccgcaatggcgatatcatcgtacaagagcccatgtctctcggacacgagtccgcaggtgtcgtagtcggcgttggatcagatgttgagaatttccaagttggagacaaggtcgcattggaagtcggactgccttgtgatacatgcgacagatgtaaagaggggcgatacaacatctgtaaggggatgcggtttaggagtagtgcaaaggcatttccgcatgcgcaaggaacgctgcaagacagaataaaccatcctgctgcttggtgtcataagttgccagaagatatgtccttggaccttggagcactactcgagccgctaggtgtagcaatccaggcatcgaaacgagcacagctcgcgccgggcgcaacagtattagtcttcggagctggtgctgtaggccttctagtggcagctatggcgaagatttcaggcgccagcacagttgtaatagcggacatagacgagggaagggtaaatttcgcagtggagaacaagttcgcgcatcggaatttcacggtcccaatgaagcggggcgcgacaatagaggagcagctggatatcgcgaaagagaccgctgcagcaattggcaagataacgaaagagagtggtggcgaagttggcgaggttgatgctgtgtttgagtgcaccggtgttccgtcctgcgtccaggcatcgatttatgcaacgcgcccgggtggtcgagtcttactgatcggtatgggcacgcccattcaaacactcccaatctccgccgcagctcttcgcgaggtcgacatcatgggtgttttccgatacgccaatacgtatcccagcggcatcgaagtggtgtctaagaagggaacagattacccagatttcgcgaagcttgtcacccatagatacactggcttggaagcggccgtagaggcatttgacatggctggcaagaccaaagacgacaaaggaaatctggttatcaaggtagtgctagaaacaggtgaggataaggcaaatctgtag

SEQ ID NO: 10017 - protein, 395 aa, Phaeosphaeria nodorum
MSNDISPDVSQGKRQIRASVLHGAKDLRIENRSISPPAPTELQISVRSTGLCGSDLHYYRHYRNGDIIVQEPMSLGHESAGVVVGVGSDVENFQVGDKVALEVGLPCDTCDRCKEGRYNICKGMRFRSSAKAFPHAQGTLQDRINHPAAWCHKLPEDMSLDLGALLEPLGVAIQASKRAQLAPGATVLVFGAGAVGLLVAAMAKISGASTVVIADIDEGRVNFAVENKFAHRNFTVPMKRGATIEEQLDIAKETAAAIGKITKESGGEVGEVDAVFECTGVPSCVQASIYATRPGGRVLLIGMGTPIQTLPISAAALREVDIMGVFRYANTYPSGIEVVSKKGTDYPDFAKLVTHRYTGLEAAVEAFDMAGKTKDDKGNLVIKVVLETGEDKANL

SEQ ID NO: 10018 - DNA, 1097 bp, Candida tropicalis
  CDS (2)..(1096): transl_table=12
catgactgcaaacccatccttagttcttaacaaagttgacgatatttcctttgaagaatacgaagctccaaaactcgaatcaccaagagatgtcattgttgaagttaagaaagctggtatctgtggatcagatatccattactatgcccatggttcaattggtccatttattttaagaaaaccaatggttttaggtcacgaatcagcaggtgttgtttctgctgtcggaagtgaagttaccaacttgaaggttggtgatagagttgccattgaacctggtgtaccttcaagatttagtgatgagaccaaatctggtcattatcatttgtgcccacatatgtcttttgccgccaccccaccagttaacccagatgaaccaaatcctcaaggtactttatgtaaatactacagagtcccatgtgactttttattcaaattaccagatcatgtttctttggagttgggtgctatggttgaaccattaactgttggtgtccacggttgtaaattggctgatttgaaatttggtgaagacgttgttgtttttggtgccggtccagttggtttgttgaccgctgccgttgctagaacaattggtgctaaaagagtcatggttgttgatatttttgacaacaaattgaagatggcaaaagatatgggtgctgccactcatattttcaactcaaaaaccggtggtgattatcaagatttgatcaagagttttgatggtgttcaaccttcagttgttttggaatgtagtggtgctcaaccatgtatctatatgggtgttaaaatcttgaaagctggtggtagatttgttcaaattggtaatgccggtggtgatgtcaatttcccaattgctgatttctcaaccagagaattggcattatatggttctttcagatatggttacggtgactaccaaacttcaattgatattttagacagaaactacgtcaatggtaaagacaaagcaccaattaatttcgaattgttgattactcacagattcaagtttaaagatgccatcaaagcctatgatttggtcagagcaggaaatggtgctgtcaaatgtttgattgacggtccagaataga

SEQ ID NO: 10019 - protein, 364 aa, Candida tropicalis
MTANPSLVLNKVDDISFEEYEAPKLESPRDVIVEVKKAGICGSDIHYYAHGSIGPFILRKPMVLGHESAGVVSAVGSEVTNLKVGDRVAIEPGVPSRFSDETKSGHYHLCPHMSFAATPPVNPDEPNPQGTLCKYYRVPCDFLFKLPDHVSLELGAMVEPLTVGVHGCKLADLKFGEDVVVFGAGPVGLLTAAVARTIGAKRVMVVDIFDNKLKMAKDMGAATHIFNSKTGGDYQDLIKSFDGVQPSVVLECSGAQPCIYMGVKILKAGGRFVQIGNAGGDVNFPIADFSTRELALYGSFRYGYGDYQTSIDILDRNYVNGKDKAPINFELLITHRFKFKDAIKAYDLVRAGNGAVKCLIDGPE

SEQ ID NO: 10020 - DNA, 1101 bp, Vitis vinifera
  CDS (1)..(1101)
atggggaaaggaggcaactctgaggatgctgtttcaagcaaggagcatggagaagagaacatggcagcttggcttctgggcatcaagaccctcaagattcaaccctacattctcccttctctgggcccccatgatgttaaagttaggatcaaagctgtagggatatgtggaagtgatgttcatcacttcaagacaatgaggtgcgcaaattttattgtgaagaagccaatggtgataggccatgagtgtgctggtatcatagaagaagttgggagtgaagtgaagaatcttgtagtaggtgaccgggttgctctggagcccggtattagctgtaaccgatgcagtctttgcaggaatggtcaatacaatctatgcagagaaatgaagttttttggatctcctccaaccaatggttctctagctaaccaggtggtccatccttcaaatctttgtttcaagctacctgacaatgtgagcttggaggaaggagcaatgtgtgagccgctcagtgtcggcatccatgcttgtcgccgtgctaatgttggccctgagaccaacgtactgatcatgggatcaggccccatcggccttgtcacaatgctggctgctcgtgcttttggagcgccgaggattgtccttgtggacgtagatgatcagcgactagctattgcaaaagatcttggcgcagacgatattatccgggtttcaacgaatattcaggatctagatgaagaagtggcaaaaatacaaagcacaatggttactggagttgatgtgagcttggactgtgtcggcttcaacaaaaccatgtcaacagctttgaacgcgactcgagcaggcggcaaagtttgccttgtgggtttggcccagagtgagatgactgttcctctcactccagctgctgccagggaggtcgatattgttggcatattccgctataggaacacatggccgctctgccttgagtttttgaggagtggcaagattgatgttaaacccctgataacccacaggtttactttctcacagaaggatgtggaggaagcctttgaaaccagtgctcgtgggggtaatgctatcaaggtcatgtttaatctctaa

SEQ ID NO: 10021 - protein, 366 aa, Vitis vinifera
MGKGGNSEDAVSSKEHGEENMAAWLLGIKTLKIQPYILPSLGPHDVKVRIKAVGICGSDVHHFKTMRCANFIVKKPMVIGHECAGIIEEVGSEVKNLVVGDRVALEPGISCNRCSLCRNGQYNLCREMKFFGSPPTNGSLANQVVHPSNLCFKLPDNVSLEEGAMCEPLSVGIHACRRANVGPETNVLIMGSGPIGLVTMLAARAFGAPRIVLVDVDDQRLAIAKDLGADDIIRVSTNIQDLDEEVAKIQSTMVTGVDVSLDCVGFNKTMSTALNATRAGGKVCLVGLAQSEMTVPLTPAAAREVDIVGIFRYRNTWPLCLEFLRSGKIDVKPLITHRFTFSQKDVEEAFETSARGGNAIKVMFNL

SEQ ID NO: 10022 - DNA, 1131 bp, Zygoascus ofunaensis
  CDS (1)..(1131)
atgaagggattgctctattacaagacaggagatatcagatactccgaagacgttgaggagcccgagatcttgagtagtcacgacgtcaagattcgggtaaaattctgcggcatttgtggaactgaccttaaggaatatacttatgaaggaggtccattattcttacctaagcctggtagtagcgacaagatttctgggttggaattgcccctctgtcctggacatgagttttgtggagttgtagaagaagttggagaatcagtcactagggtgaaacctggtgatagagttgcagtcgaggctacgactcactgttcagatgctgttcattatggagttcatgatatggaattatgtgttgcgtgtaaaaatggaagtcctaactgctgcactcatttatctttctgtggattaggaggagcaagcgggggatttgctgagaaagtagtatatggggaggaacatatgttgaaacttccagactcaattccgtttgatattggtgcccttattgaaccattagcagtggcttggcatgcagtggaatgcgcgaagtttaaaccaggatcgactgcattagttcttggtggaggtccaattggactggctaccattctagctctgcaaggacatcaagcaggacgcattgtatgttccgaacctgcttgtatcagacgggaatatgccgccaagtttggtgctgaagtattcgatccttcacagcacgacgacgtcatccatgaactcaaagcattgcttcctgagaatggaggattcgatgcatcatttgactgttcaggagttcctcagactttcacaacttcaatagaggcactagcacctggtggaatggctgtcaatgtagctatttggggagatcatgctatagatttcggcgccatgtgtttgacatatcaagagaaaacctgtactggatcaatgtgttacacagtaaaggactttgaagaagttattaatgcccttgataaaggtctcatctccatcagcaaagctcgtctaatgatcacaggcaaggttaaccttaaagatggagttgagcttggatttaagcaactgatcgaacataaggaaactaacatcaagatccttgttactcctgatgaagtgtag

SEQ ID NO: 10023 - protein, 376 aa, Zygoascus ofunaensis
MKGLLYYKTGDIRYSEDVEEPEILSSHDVKIRVKFCGICGTDLKEYTYEGGPLFLPKPGSSDKISGLELPLCPGHEFCGVVEEVGESVTRVKPGDRVAVEATTHCSDAVHYGVHDMELCVACKNGSPNCCTHLSFCGLGGASGGFAEKVVYGEEHMLKLPDSIPFDIGALIEPLAVAWHAVECAKFKPGSTALVLGGGPIGLATILALQGHQAGRIVCSEPACIRREYAAKFGAEVFDPSQHDDVIHELKALLPENGGFDASFDCSGVPQTFTTSIEALAPGGMAVNVAIWGDHAIDFGAMCLTYQEKTCTGSMCYTVKDFEEVINALDKGLISISKARLMITGKVNLKDGVELGFKQLIEHKETNIKILVTPDEV

SEQ ID NO: 10024 - DNA, 1089 bp, Aspergillus oryzae
  CDS (1)..(1089)
atgttagccacgccgcttttaacccaatgtaggaacccttcatttgtcctccgcaaagtcaaagacgtcgtcatcgaagaccgtcctaagcctgttctcaaggatcctgacgatgttatcgtgcacgttaagcagactggcatctgcggcagtgatgttcactactggcaaagaggccgaatcggcgactacgtcctagccggccccatggtcctaggccacgagtcctcaggcaaagtcgtggaagtcggtgtcgccgtctcacacctcaaagccggtgaccgagtagcaatggagcctggagttccctgccgttgctgcaatcaatgtcgttccggtgcttatcatctctgcggtggtatgagcttcgccgctactcccccatgggatggcaccctggcgaaatactacgtcaacaccgccgacttctgctacaaagtgcccgaccacatgagcatggaggaagcagccatggtcaagcccgcggctgcgatcgccaagacggccgacctccgcgctcaccagacagtgcttgtgttcggctgcggtccgatcggtgtgctctgtcagacggttgcgaaggcgcatggcgcgaaaaccattatcgccgtcgatgtgttagaggtcgccaagtcctatggtgttgaccatgtgtttatgcctgaaaagcccgagccgggtgctgaccccattgcgcatgcagagaagatggcgcagaagctgaaggaagagtgtgggctgggtgagggagctgatgtcgagcttgaatgctcgggtgcggaaccctgtgtgcagatgggcgttttcgctgctcgtcatggaggcacaattgttcaggcacgtatggggaaggaggttatcaatttcccgattactgctgtgtgcactcggggcttggttgtcaaagggtctattcggtatttgacgggctgttatcccgctgcgattgatctgattggaaaaggcattattgatgttaagaggttggttacaaatcgattcaagtttgaggaggcggaacaggcatttgaattggttaaggcagggagacaggatgttttcaaggtcatgattgcaggtgttgtttaa

SEQ ID NO: 10025 - protein, 362 aa, Aspergillus oryzae
MLATPLLTQCRNPSFVLRKVKDVVIEDRPKPVLKDPDDVIVHVKQTGICGSDVHYWQRGRIGDYVLAGPMVLGHESSGKVVEVGVAVSHLKAGDRVAMEPGVPCRCCNQCRSGAYHLCGGMSFAATPPWDGTLAKYYVNTADFCYKVPDHMSMEEAAMVKPAAAIAKTADLRAHQTVLVFGCGPIGVLCQTVAKAHGAKTIIAVDVLEVAKSYGVDHVFMPEKPEPGADPIAHAEKMAQKLKEECGLGEGADVELECSGAEPCVQMGVFAARHGGTIVQARMGKEVINFPITAVCTRGLVVKGSIRYLTGCYPAAIDLIGKGIIDVKRLVTNRFKFEEAEQAFELVKAGRQDVFKVMIAGVV

SEQ ID NO: 10026 - DNA, 1071 bp, Aspergillus oryzae
  CDS (1)..(1071)
atggagagcaacaacccatcctggttcttgtatgggcctggggaggcacgtctacagtcactccctataccggagattcaggatccccacgatgtcatcgtccgcattgcctacgttggagtctgtggaagtgatgtacatttttggaaacacggcggagtcaacaagaaggttagcaaggaacaaccgctagtactaggccacgaagctgctggaaccattcatacggtcggaactgccgtcaagtccgttcaagtcggtgatcccgttgccattgagcctggtatcccctgccggcgctgcagggcttgcaaacatggcacctacaatatctgtcgagagatgaagttcgcggcggtaccaccagatgtgcatggtactctaacgaagtattaccgggtaccagaagactttgtctataagataccttcgggaatgagccttcaagaagcagtgctcatggaacctctctccgtggccgtgcattctactcgtctggtcaacatcactcctggccaaaccattgttattatgggctccgggtcggtcggtcttttatgcggcgcagtcgctaaggcattcggcgctcaccggatcattcttgccgacattctggaacacaagctgtcatttggctccgagttcctcgattgcgaaaccttccttgtcagcttggacgaaacgccagaggagagcgcagctcgtttgttagatatgctggatgctccagatggggtcgatgctgtgattgaggcttccggtgctgagggttcagtccaaatcggcatatatgccttacgacgcggtggtagttacgttcaagccggtgttgggaagccaaaggctgagatcccgatcttggccttgtcccagaaagaactccatgtccatggatgctttcggtatggaccaggagactatgacctggctctaaagctgatcaccaagggatccattgatgttaaacgcctaattaccagtgtgacgcccttcgaacaagcgccgcaggcttgggacaagacagcacggggtgaaggaatcaaaaacctgattcaaggtgtgcaagattag

SEQ ID NO: 10027 - protein, 356 aa, Aspergillus oryzae
MESNNPSWFLYGPGEARLQSLPIPEIQDPHDVIVRIAYVGVCGSDVHFWKHGGVNKKVSKEQPLVLGHEAAGTIHTVGTAVKSVQVGDPVAIEPGIPCRRCRACKHGTYNICREMKFAAVPPDVHGTLTKYYRVPEDFVYKIPSGMSLQEAVLMEPLSVAVHSTRLVNITPGQTIVIMGSGSVGLLCGAVAKAFGAHRIILADILEHKLSFGSEFLDCETFLVSLDETPEESAARLLDMLDAPDGVDAVIEASGAEGSVQIGIYALRRGGSYVQAGVGKPKAEIPILALSQKELHVHGCFRYGPGDYDLALKLITKGSIDVKRLITSVTPFEQAPQAWDKTARGEGIKNLIQGVQD

SEQ ID NO: 10028 - DNA, 1086 bp, Aspergillus oryzae
  CDS (1)..(1086)
atgagtgagagcatccgccaagtcatagaacttaacccatcattggtgctcaaagctgtccaacagctcgagttcgaggaccgcccggtaccagacttgttggagccctacgatgtttccgtgcggattgaatatacagggatatgcggcaacgatgtccactactggcagcgcggccgaattggccaattcatcctcgaaaagccgatggtgctaggccacgagtcagccggagtagtagagaaggtcggctccaaagtgaaatcactagcagtgggcgatcatgttgccctagaacccggagtgccctgtcggcgatgcacgttttgcaaagcggggaactacaacctgtgcagcgagatggcatttgctgctactcccccctttgatggcaccttggccaagtattatgttttgccagaggacttttgctacaagctccctacgaatgttagcttgcaagaaggcgccgttgtggaaccccttagtgttgcagtgcatctcgttcgacaggccgcgctgcagccagggcagtcggtagtggtatttggtgcaggacccgtcggccttttgtgctgtgcggtggctcgagcttttggggcttccaaggtaattgtcgttgatgtgcagcctaagcgattggaatttgcccgtgcctatgcggcaactgctcattttctcccgggcgtggagacctctccggcggataacgctgttcggcttcgagaagagaacgaactcgaaatgggcgcggatgttgtcatcgaggcctccggtgcagagccatcggtctacacaggtatccatatcttgagacctggtggaacgtatgttcaaggaggaatgggaaaggaggaagttaagtttccaatcacggcggcatgcacgaaggagctcaatattcggggaagttttcgatattcgagtggcgattataagctcgctattgagctaatcgcggctgggaaaatcaacgttaaggccctgatcacacaagttttcaagtttgaggatgcaccgcgggcgtttgaggaggtgaagtcagggaaagggattaagacactcattgcaggcccgggagtctga

SEQ ID NO: 10029 - protein, 361 aa, Aspergillus oryzae
MSESIRQVIELNPSLVLKAVQQLEFEDRPVPDLLEPYDVSVRIEYTGICGNDVHYWQRGRIGQFILEKPMVLGHESAGVVEKVGSKVKSLAVGDHVALEPGVPCRRCTFCKAGNYNLCSEMAFAATPPFDGTLAKYYVLPEDFCYKLPTNVSLQEGAVVEPLSVAVHLVRQAALQPGQSVVVFGAGPVGLLCCAVARAFGASKVIVVDVQPKRLEFARAYAATAHFLPGVETSPADNAVRLREENELEMGADVVIEASGAEPSVYTGIHILRPGGTYVQGGMGKEEVKFPITAACTKELNIRGSFRYSSGDYKLAIELIAAGKINVKALITQVFKFEDAPRAFEEVKSGKGIKTLIAGPGV

SEQ ID NO: 10030 - DNA, 1110 bp, Aspergillus oryzae
  CDS (1)..(1110)
atggctacagatactcatcccacgatcaacaaagcttccgtactccgccccggcggctcattttactatgaagatagagagaaaccttcattagaatctgatcgagatgtgatagtacgagttgtcgccaccggtctctgtggctccgatgtccattactggcaacacggtcgcatcggtcgctatgttgttgaaaaccccatagttctcggccacgagtcctccggcatagttgtatcccgcggtgccaaagcatccggcattgaagttggcgaccgcgtcgcgatcgagcccggaatcgcctgcaacacctgcaacccatgtcgcagtggtcggtataacctatgcaaggacatgcgttttgccgcgactcccccatatgacggaacgctgtccacatactaccgcgtgcccgttgaatgctgctacaagttgccggagcatatctcgctgcgtgatggcgcgctggtcgaaccgctcggagttgcggtgcatggatgccgactggcaggggatctgcaggataagtcggtcattgttttcggcgcggggccggtcggactgctttgctgcgctgttgcgagtgcgttcggtgcgtcgacggtcgtcgccgtggatatcgtggctgctcgactcgagtcggcaaggaagtacggggctacacatacataccagatgagcgcggagaagtctcccgagctcaacgccgatgccctagcagctacagcaggactcatggatggcgctaatgttgtcctcgatgcttcaggtgctgagccttgtatcaactgtggaattcatgcgctggcgcatggtggaaccttcgtgcaagtcggacttgggagaccgaatctgtccttacccgttggacaaatctgcgacaaagaggctgtgttcaagggtagcttccgatacgggccaggagatttcaaactggctgttggcttgctgaactcgcggcgggtccgggtcgatgggttggtcactcatgaattctctttctcgcaggtcgaggaagcgttcaagcatgttgctggcaaggggggtatcaagagtgtgatttacggaccggacgtcgatgtcgaagctgcaaagcaagcttcagtatag

SEQ ID NO: 10031 - protein, 369 aa, Aspergillus oryzae
MATDTHPTINKASVLRPGGSFYYEDREKPSLESDRDVIVRVVATGLCGSDVHYWQHGRIGRYVVENPIVLGHESSGIVVSRGAKASGIEVGDRVAIEPGIACNTCNPCRSGRYNLCKDMRFAATPPYDGTLSTYYRVPVECCYKLPEHISLRDGALVEPLGVAVHGCRLAGDLQDKSVIVFGAGPVGLLCCAVASAFGASTVVAVDIVAARLESARKYGATHTYQMSAEKSPELNADALAATAGLMDGANVVLDASGAEPCINCGIHALAHGGTFVQVGLGRPNLSLPVGQICDKEAVFKGSFRYGPGDFKLAVGLLNSRRVRVDGLVTHEFSFSQVEEAFKHVAGKGGIKSVIYGPDVDVEAAKQASV

SEQ ID NO: 10032 - DNA, 1146 bp, Aspergillus oryzae
  CDS (1)..(1146)
atgagatggtttactattgaaaggctcttctttatttggaaacttttgaagtatcagtactcaaacccctccttcgtcctcaaggccgtgaaggatgtcgccttcgaagatagaccagttcccgcgctccaggatccctgggatgtgcgcgttcagatcgcccaaacaggtatctgcggatctgacgtgcattactggcaaagaggcagaatcggcgattttgttctcacaagccccatcgttctcggccatgaaagctcaggaactgttatggacgtcggatcggccgtcaagaacctgaaggttggcgatcgtgttgccatcgagcctggtattccctgcagacactgcgagtactgtcacagtggctcgtacaacctttgtccgaacgaccgcttcgcagcaactcctccccacgatggaactttgtcgaaatactacatcacccagtctgacttctgctaccccattcccgatcacatgaacatggaggaaggagccatggtcgagccagtcgcggtcgcatgccagattaccaaggtcggaaacgtgagggcgaaccagaagatcgtggtcttcggctgcggtcctattggtctcctctgccaggctgtcagcaaggcctacggcgccaagaaggtcatcggcgtcgacattagcaagtctcgtgcggagtttgcgaagacctttggcgcagatgatgtctttgtaccccctccacctccggctgatgtgtctcccgaggagtggagtgagaaattggcgaagattattaaggaacagttcgacttaggcgagggcccggatgttgttcttgaggctactggtgcacaaccttgtattcagactggaatacacttgacgaagaagggcggtacttatgttcaggctggaatgggacgtgagaatgttatgttcccaattacaactgcttgtattcgcgacttgactatccgcgggtctattcgttacagcactggttgctattcgactgccgtggacttaattgctagtggaaaggtggatgtcaagcgtctcattaccaaccggtatacgtttgaggaggctgagcaggcattcgagctggttaggcaaggaaaggagagtgtcatcaaagtgattatcgaggggtatcagggacggtag

SEQ ID NO: 10033 - protein, 381 aa, Aspergillus oryzae
MRWFTIERLFFIWKLLKYQYSNPSFVLKAVKDVAFEDRPVPALQDPWDVRVQIAQTGICGSDVHYWQRGRIGDFVLTSPIVLGHESSGTVMDVGSAVKNLKVGDRVAIEPGIPCRHCEYCHSGSYNLCPNDRFAATPPHDGTLSKYYITQSDFCYPIPDHMNMEEGAMVEPVAVACQITKVGNVRANQKIVVFGCGPIGLLCQAVSKAYGAKKVIGVDISKSRAEFAKTFGADDVFVPPPPPADVSPEEWSEKLAKIIKEQFDLGEGPDVVLEATGAQPCIQTGIHLTKKGGTYVQAGMGRENVMFPITTACIRDLTIRGSIRYSTGCYSTAVDLIASGKVDVKRLITNRYTFEEAEQAFELVRQGKESVIKVIIEGYQGR

SEQ ID NO: 10034 - DNA, 1062 bp, Aspergillus oryzae
  CDS (1)..(1062)
atggaagcggtccgcttccatggaccccgcgacatccaggtggaaacaatagatgagcctatttgtggcaaagggcaagtaaagatccgaccagctttcgtcggactctgtggcagtgacatccatgagtataccggtggtcccgtattgataccccaagaaccccataatattactggacgttcatatccagttacacttggtcatgaattcagcggtatcgtcgaagaagtcggagaaggagtaacgcatgtgtctccaggacagcgggtcgtcgtacgtccgaccatctttgaccgacaatgcacggcatgcaaacgtggctacgaatactgctgcgagaatatagggtttattgggctttctgggtacggcggcgggttggcaaagtaccatgtcgcaccggcagaacacttctacccaatccctgacaacgtatctcttgaagcagcagccttgaccgagccactggcagttgcctggcacgctgtcaatctatcaccattcaagatgggcgataatgtcatggtggtagggggtgggccagttgggattggcattgtgcaggtgttgaagttgcaaggcgccaagaatatcatggtatcagagctctatgagaagcgtaggaagtttgcgattgaatacggtgctacgcatacctttgatccggaccaggaggatgtgacgcagagggtcatggaagtgacggatagtataggcgccgatgttatctttgatgctgctggtgtggaaaaggcattgaatggtgccatcagtgcgtgtcgcacacatggtacaatcgttaatgttgcggtgtgggagaagaaaccagctattcccgtgaacgacttgatgtacaacgaagttaattataccgggtcagcattgtacgacgaaggctccttcgaagctgttatcaaggcccttggatatggtcaattgaaaccagaaaagatgattacgtcgaagataaagttgaatgagacggtggaaaagggattcgaaaccctggtcaacgaccgcgaggaccactgcaagatcctaatcgacgtgcaggcatga

SEQ ID NO: 10035 - protein, 353 aa, Aspergillus oryzae
MEAVRFHGPRDIQVETIDEPICGKGQVKIRPAFVGLCGSDIHEYTGGPVLIPQEPHNITGRSYPVTLGHEFSGIVEEVGEGVTHVSPGQRVVVRPTIFDRQCTACKRGYEYCCENIGFIGLSGYGGGLAKYHVAPAEHFYPIPDNVSLEAAALTEPLAVAWHAVNLSPFKMGDNVMVVGGGPVGIGIVQVLKLQGAKNIMVSELYEKRRKFAIEYGATHTFDPDQEDVTQRVMEVTDSIGADVIFDAAGVEKALNGAISACRTHGTIVNVAVWEKKPAIPVNDLMYNEVNYTGSALYDEGSFEAVIKALGYGQLKPEKMITSKIKLNETVEKGFETLVNDREDHCKILIDVQA

SEQ ID NO: 10036 - DNA, 1167 bp, Aspergillus oryzae
  CDS (1)..(1167)
atggcgccctctctccttgatcccagtctcaatccccccacagccgcaaccccggccaaaagttctacagagactattgtcacacctttccccaacccttctctccaagtcacagccgatcacaagctcaaggccattgatgcgccggtgtatgccccaaagcacggcgaagttctgcttcagatcaaagcaactggaatttgcggttccgatcttcacttttggaaaaccggttgcattggagaactgattttcaagggtgactgcattatcggacatgaagccgcaggtgttgtcttgaaatgtggcgagggagtcactcatctccgtcctggtgacagagtggccgttgagccgggcgtgccctgcggggattgtttcctctgtctcgacggccgttataacctttgcgaagatgtccagttcgcaggcgtatacccttacgccggaacaattcaacgatacaagacgcaccccgcaaaatgggttcacaaattgcccgataaccttacctacgccgagggtgccctcctcgagcccctctcggtcgttatgcgtggaatgtcagttgctggtctgcaacttggtcgcggggccgtcgtctgcggtgccggtcccattggactaatcgcactggccgccgcacgtgcgtcaggcgctcatcctattgttatcacagacctagatgctagtcggttggcattcgctaaggagttcgtcccgagctgcatcacataccaggtgaaccgtgatcttgatgcccaaggaaatgccaaggcaatccgagcgctgttcggttccgaagaatactttgccccagagaccgttctcgagtgcacaggtgttgaaagtagtgtatgcactgctgcgttcacagctcgacgaggcggcaccgtcgtagtcattggcgtgggtaaagctgtgatgaacaacttgccgtttatgcatatctcgctggctgagattgacttgcgcttcatcaaccgctaccgcgacacctgggccccagccattcagtgcatgagtggcggaatccttgatctcaagagacttgttacccatacattcccattagaacaggctgagtcggcgttgcagctgtgctctaacccgaagaacccgagtatcaaggtcttggtggtggatgaggttgaagctacattgtag

SEQ ID NO: 10037 - protein, 388 aa, Aspergillus oryzae
MAPSLLDPSLNPPTAATPAKSSTETIVTPFPNPSLQVTADHKLKAIDAPVYAPKHGEVLLQIKATGICGSDLHFWKTGCIGELIFKGDCIIGHEAAGVVLKCGEGVTHLRPGDRVAVEPGVPCGDCFLCLDGRYNLCEDVQFAGVYPYAGTIQRYKTHPAKWVHKLPDNLTYAEGALLEPLSVVMRGMSVAGLQLGRGAVVCGAGPIGLIALAAARASGAHPIVITDLDASRLAFAKEFVPSCITYQVNRDLDAQGNAKAIRALFGSEEYFAPETVLECTGVESSVCTAAFTARRGGTVVVIGVGKAVMNNLPFMHISLAEIDLRFINRYRDTWAPAIQCMSGGILDLKRLVTHTFPLEQAESALQLCSNPKNPSIKVLVVDEVEATL

SEQ ID NO: 10038 - DNA, 1077 bp, Aspergillus oryzae
  CDS (1)..(1077)
atggacatcctcgaccgtaaaccctacaaccatgccatccataccagccccgcgaacgacctccgtctagtaaaatcagacatccccgaaatccaaccccatgagtgcctcgtccacgtccgtgccactggaatctgtggctctgatgtacacttttggaaacatggccacatcggagatatggtagtaacaggggacaacggcctgggccatgaaagtgccggggtagttcttaaagtcggcaaggatgtaactcggttcaagcccggcgacagagtcgctatggaatgcggtgtcccctgctccaaacccacctgttacttctgccgaacaggccaatacaacgcctgcccggatgtagtcttcttctccacgcctcctcaccacggcactctccgacgataccacgtccaccccgaggcatggctacaccatattcccgacaatatctcctttgaagaaggtgctctcctagagcccttaaccgtcgctctagcaggaatcgacagatccggactccgcctcgccgatcccctggtgatctgcggggcaggacctatcggtctcgtcactctactcgccgccaacgcagcgggcgcagagcccatcgtgatcacagacttggacgagggtcgtcttgcaaaggcaaaggaaatagtcccgcgcgttcgaccggtgaaggtcacaagagaagacactcccaaggccttggcgggcaggattgtcgagactctaggccaggaggcaaaattggtcattgaatgcacgggcgtggagtctagtatccatgctggaatatattccacccgtttcggcggctccgtcttcgtgatcggtgtcggcaaggatttccaaaccatccccttcatgcatctctccgccaaagagattgatctccgctggcagtatagatatcacgatatctaccccaaggcgattggtctcgtcgctgctggaatcattgatttgaaaccgttggtttcgcatcgattcgcgttggaggatgggatcaaggccttcgagacggcgagtaaccctgcttctaaggctatcaaagtgcagattttggatgattag

SEQ ID NO: 10039 - protein, 358 aa, Aspergillus oryzae
MDILDRKPYNHAIHTSPANDLRLVKSDIPEIQPHECLVHVRATGICGSDVHFWKHGHIGDMVVTGDNGLGHESAGVVLKVGKDVTRFKPGDRVAMECGVPCSKPTCYFCRTGQYNACPDVVFFSTPPHHGTLRRYHVHPEAWLHHIPDNISFEEGALLEPLTVALAGIDRSGLRLADPLVICGAGPIGLVTLLAANAAGAEPIVITDLDEGRLAKAKEIVPRVRPVKVTREDTPKALAGRIVETLGQEAKLVIECTGVESSIHAGIYSTRFGGSVFVIGVGKDFQTIPFMHLSAKEIDLRWQYRYHDIYPKAIGLVAAGIIDLKPLVSHRFALEDGIKAFETASNPASKAIKVQILDD

SEQ ID NO: 10040 - DNA, 1538 bp, Candida tropicalis
  CDS (343)..(1437): transl_table=12
accttcctattgtttggaaaccggaaaaaaataatattttgtatggagatcctcaaatttcggggaaattgtagatttaccttcctcttgcaattacgcattgctactattttgttttttagtttgggttttcttttgtattgcttcacgtatggtgattatactttgtgtacacttgttcatttactcccccaagttttcctctccccctccatttataatgtatgaattaattatataaatactgccgcaaatttccccaggttgaaattttttttgttacttctaaagtttcttatttcttttcattcaataactttcaattctacaaatacaaaagtcatgactgcaaacccatcattagttcttaacaaagttgacgatatttcctttgaagaatacgaagctccaaaactcgaatcaccaagagatgtcattgttgaagttaagaaaactggtatctgtggatcagatatccattactatgcccatggttcaattggtccatttattttaagaaaaccaatggttttaggtcacgaatcagcaggtgttgtttctgctgtcggaagtgaagttaccaacttgaaggttggtgatagagttgccattgaacctggtgtaccttcaagatttagtgatgagaccaaatctggtcattatcatttgtgcccacatatgtcttttgccgccaccccaccagttaacccagatgaaccaaatcctcaaggtactttatgtaaatactacagagtcccatgtgactttttattcaaattaccagatcatgtttctttggagttgggtgctatggttgaaccattaactgttggtgtccacggttgtaaattggctgatttgaaatttggtgaagacgttgttgtttttggtgccggtccagttggtttgttgaccgctgccgttgctagaacaattggtgctaaaagagtcatggttgttgatatttttgacaacaaattgaagatggcaaaagatatgggtgctgccactcatattttcaactcaaaaaccggtggtgattatcaagatttgatcaagagttttgatggtgttcaaccttcagttgttttggaatgtagtggtgctcaaccatgtatctatatgggtgttaaaatcttgaaagctggtggtagatttgttcaaattggtaatgccggtggtgatgtcaatttcccaattgctgatttctcaaccagagaattggcattatatggttctttcagatatggttacggtgactaccaaacttcaattgatattttagacagaaactacgtcaatggtaaagacaaagcaccaattaatttcgaattgttgattactcacagattcaagtttaaagatgccatcaaagcctatgatttggtcagagcaggaaatggtgctgtcaaatgtttaattgatggtccagaatagaggtatatagtattagaaaaagaatatacagtatatatatatatatatgtgaataattcatgcttaagtttaatatcagtaaagcatctactataaatcca

SEQ ID NO: 10041 - protein, 364 aa, Candida tropicalis
MTANPSLVLNKVDDISFEEYEAPKLESPRDVIVEVKKTGICGSDIHYYAHGSIGPFILRKPMVLGHESAGVVSAVGSEVTNLKVGDRVAIEPGVPSRFSDETKSGHYHLCPHMSFAATPPVNPDEPNPQGTLCKYYRVPCDFLFKLPDHVSLELGAMVEPLTVGVHGCKLADLKFGEDVVVFGAGPVGLLTAAVARTIGAKRVMVVDIFDNKLKMAKDMGAATHIFNSKTGGDYQDLIKSFDGVQPSVVLECSGAQPCIYMGVKILKAGGRFVQIGNAGGDVNFPIADFSTRELALYGSFRYGYGDYQTSIDILDRNYVNGKDKAPINFELLITHRFKFKDAIKAYDLVRAGNGAVKCLIDGPE

SEQ ID NO: 10042 - DNA, 1386 bp, Solanum lycopersicum
  CDS (251)..(1318)
gactgtgttgattttcacaaaattttagtattttcttcttatccacattcaataatattcacaaaaaatgaaactacacaaattcacctaaaaattgaaatcaacaacaaaaaaaaatcaaatcttgaaaacccccttttagatagaagagcaaaaaaatcaaatcttgatttgcccctttttgtgttattgttgtttttagataaaagagcaaaaaaaatcaaatcttgaaaaccccttttctgttctaatgggtaaaggaggcagtgatgaaaatatggctgcttggcttcttggtgttaacaccctcaagattcagcctttcaatctccctgctttgggaccccatgatgttagagttaggatgaaggctgtcggtatttgtggaagtgatgttcattacctcaagaccatgaggtgtgcggattttgtggttaaagaaccaatggtgattgggcatgaatgtgccgggatcatagaggaagttggcggtgaagtcaagacattggttcctggagatcgtgtagcactagagcccggaattagttgttggagatgtaatctttgcaaagaagggcgatataatctctgccccgagatgaagttctttgctactccccctgttcatggttctcttgcgaatcaggtagtccaccctgcagacctatgtttcaagctcccggatgatataagtttagaggagggagcaatgtgtgagccacttagtgttggtgttcatgcctgtcggcgtgcaaatgttggtcctgagacaaacatattagtgctgggagctggaccaattgggcttgtcacgctgcttgctgctcgtgcttttggtgccccaagaattgttattgtggatgtagatgactatcgtctttctgttgcaaagaagttaggagcagatgacatcgtcaaggtttcaatcaatattcaggatgtagctacagatatagaaaacattcagaaagcaatgggaggtggaatcgacgcgagttttgactgtgctggctttaacaaaactatgtcgaccgctcttggtgcaactcgtccaggtggcaaagtttgcttggttggaatgggacatcatgagatgaccgttcctctcactccagctgctgcaagggaggtcgacgtcatcggcatatttcgctacaagaatacatggccattgtgtcttgagttcttaagaagtggtaagattgatgtgaaacctttgatcacacacaggtttggattctctcaagaagaagttgaagaagcttttgaaacaagtgctcgtggtggtgatgctattaaagtcatgtttaatttgtaaaaaaaaaaatactttttaaatttgagaaaataagtttttttttttaccagaaaaaaaaaaaaaaaaaa

SEQ ID NO: 10043 - protein, 355 aa, Solanum lycopersicum
MGKGGSDENMAAWLLGVNTLKIQPFNLPALGPHDVRVRMKAVGICGSDVHYLKTMRCADFVVKEPMVIGHECAGIIEEVGGEVKTLVPGDRVALEPGISCWRCNLCKEGRYNLCPEMKFFATPPVHGSLANQVVHPADLCFKLPDDISLEEGAMCEPLSVGVHACRRANVGPETNILVLGAGPIGLVTLLAARAFGAPRIVIVDVDDYRLSVAKKLGADDIVKVSINIQDVATDIENIQKAMGGGIDASFDCAGFNKTMSTALGATRPGGKVCLVGMGHHEMTVPLTPAAAREVDVIGIFRYKNTWPLCLEFLRSGKIDVKPLITHRFGFSQEEVEEAFETSARGGDAIKVMFNL

SEQ ID NO: 10044 - DNA, 1334 bp, Candida tropicalis
  CDS (192)..(1286): transl_table=12
ccctagtcttttgcccgccatatggtgattcacctttgtgtgccttccacccctccacatcctccacactccaacctgaagaatgtataaatagaacccacgaatccctcccccctttcccctggggatctccagattgctcccagatttttccttcataccacacacacacacacacacacaccaccaacatgaccccaaacccatccttagtccttaacaaagtcgacgacatctcctttgaagaatatgaggctcctaaactcgagtccccaagggacgtcattgtcgaagtcaagaagaccggtatctgtggttccgatattcactactacgcccacggttccattggtcctttcatcttgagaaaaccaatggtcttgggccacgagtccgccggtgtcgtttctgctgtcggcagtgaagtcaccaacttgaaagttggcgaccgcgtcgctatcgaaccaggtgtgccttccagattcagcgatgagactaaatccggccactaccacttgtgcccacacatgtcctttgctgctactccaccagtcaacccagacgaagaaaacccacagggtaccttgtgtaagtactacagagtcccatgcgactttttgttcaagttgccagaccacgtttccttggaattgggtgccatggtcgagccattgactgttggtgtgcacggatgcaagttggctgatttgaagttcggtgaagacgttgttgttttcggtgctggtccagttggtttgttgaccgctgccgttgccagaaccattggtgccaagagagtcatggttgttgatatctttgacaacaagttgaagatggccggagacatgggcgctgctacccacactttcaactccaagaccgaaggtgactacgaagcattgatcaagaagtttgatggtgtccagccagccgttgttttggaatgcagtggtgctcagccatgtatctacatgggtgtcaagatcttgaaggctggtggacgatttgtgcaaattggtaacgctggcggtgatgtcaacttcccaatttccgacttctccactagagaattgtccttgcacggttctttcagatacggttatggcgactaccagacttctattgatattttggacagaaactacgccaacggcaaggacaaggctccaattgactttgaattgttgatcacccacagattcaagttcaaagatgccatcaaggcttatgacttggttagagcaggtaacggtgccgtcaaatgtttgattgacggtccagaatagatatataggagtgcatagtacgagtaaaaagataaagtttgattttgt

SEQ ID NO: 10045 - protein, 364 aa, Candida tropicalis
MTPNPSLVLNKVDDISFEEYEAPKLESPRDVIVEVKKTGICGSDIHYYAHGSIGPFILRKPMVLGHESAGVVSAVGSEVTNLKVGDRVAIEPGVPSRFSDETKSGHYHLCPHMSFAATPPVNPDEENPQGTLCKYYRVPCDFLFKLPDHVSLELGAMVEPLTVGVHGCKLADLKFGEDVVVFGAGPVGLLTAAVARTIGAKRVMVVDIFDNKLKMAGDMGAATHTFNSKTEGDYEALIKKFDGVQPAVVLECSGAQPCIYMGVKILKAGGRFVQIGNAGGDVNFPISDFSTRELSLHGSFRYGYGDYQTSIDILDRNYANGKDKAPIDFELLITHRFKFKDAIKAYDLVRAGNGAVKCLIDGPE

SEQ ID NO: 10046 - DNA, 1023 bp, uncultured bacterium
  CDS (1)..(1023): transl_table=11
atgaaggcagtggtatttcacggtaaagacgccggactgaagatcgaggacattccggtcccgcagatcaagggcgaccaaatactggtcaaggtggcggcgtgcggggtgtgtcataccgacctgcactacatcgagcacggcgtgcccacgttcaagaagccgcccatcgtgctggggcacgaggcctccggtatcgtggagaaggccggcgcgaatgtgaccaacgtcaagccgggtcaacgggtgctgatcccggctgtgctcacctgcggccattgcccggcctgccgccaggggcgtgagaacatttgcagcaacatgacgatgctcggcaatcacttcgacggcgcctacgccgaatacgtggcggtgccggcgaaggatgttttgggtctcccggaagcgattcccctgcaagaagcctcgatcatcgccgatgcgatttccaccccgtaccacgccgtcaagaaccgggcccaagtgaaaccgggcgacacggtagtggttttcggttgcggcggcgtggggatcaacgcggtgcaaatggcgtcggcggcgggcggctatgtgatcgccgttgacatcaacccgcgcaagctcgaatgggcacgcgagttcggagccgccaagaccgtcgacgccagcaaggtggatcgggtcagcaaggagatcaagaagctgaccggcggcggggccgacatcgccatggaggtgatcggcaatccgcggacgattgaacaggcgttcgagtgcgtccgcgtgggcgggcgattgtgcgttgtgggatatacccacgaggccatttcgatcgtggccggcaagatcatgttcaaagagctggagatcgtcggctcgctcggctgccgcccggtcgactacgtgccgctgatacgcatggtcgagcagggcaagatcgacctcaaacgccaggttacccatcgcttcggcctggatgagctcggccaggccttcgaggtgatgaaggaagggctgtcgctgcggtcgatcgtgattccctga

SEQ ID NO: 10047 - protein, 340 aa, uncultured bacterium
MKAVVFHGKDAGLKIEDIPVPQIKGDQILVKVAACGVCHTDLHYIEHGVPTFKKPPIVLGHEASGIVEKAGANVTNVKPGQRVLIPAVLTCGHCPACRQGRENICSNMTMLGNHFDGAYAEYVAVPAKDVLGLPEAIPLQEASIIADAISTPYHAVKNRAQVKPGDTVVVFGCGGVGINAVQMASAAGGYVIAVDINPRKLEWAREFGAAKTVDASKVDRVSKEIKKLTGGGADIAMEVIGNPRTIEQAFECVRVGGRLCVVGYTHEAISIVAGKIMFKELEIVGSLGCRPVDYVPLIRMVEQGKIDLKRQVTHRFGLDELGQAFEVMKEGLSLRSIVIP

SEQ ID NO: 10048 - DNA, 1089 bp, Pseudomonas putida
  CDS (1)..(1089): transl_table=11
atgaatgacctgagccacacccacatgcgcgccgccgtctggcatggccgtaatgatattcgcgtcgaacaggtccccctgccagccgacccggcacccggctgggtgcagatcaaggtggactggtgcggcatctgcggctccgacctgcacgaatacgtcgccggcccggtgttcatcccggtggaggcaccacacccgctgaccggcatccagggccagtgcatcctcggccacgaattttgcggccagatcgccaagcttggcgaaggcgtggagggctttgcggtaggtgacccggtggcggcggacgcctgccagcattgtggtacttgctattactgcacccacggcctgtacaacatctgcgagcgcctggcgttcaccggcctgatgaacaatggcgcctttgccgagttggtcaacgtacccgccaacctgctgtaccgcttgccgcaaggtttcccgccagaggccggggcactgatcgaaccgctggcggtgggtatgcacgcggtgaaaaaggccggcagcctgcttgggcagaccgttgtggtggtgggtgccggcaccatcggtctgtgcaccatcatgtgcgccaaggctgcgggcgcggcgcaagtgattgcgctggaaatgtcctcggcgcgcaaggccaaggccaaagaggtaggcgccaccgtggtgctggaccccagccagtgcgacgcgctggcgcaaatccgcgcactgacctttgggttgggggccgatgtgagctttgagtgcatcggcaacaagcacacggccaagctggccatcgacaccatccgcaaggcgggtaagtgcgtgctggtaggtatttttgaagagcctagcgagttcaacttcttcgaattggtatccaccgagaagcaggtactgggagcgttggcgtacaacggcgagtttgccgatgtgattgccttcatcgctgacggcaggctggatattcgcccgctggtgaccggccggatcgggttggagcagattgtcgaactgggcttcgaggaactggtgaacaacaaagaggagaacgtgaagatcatcgtttccccgggtgtgcgctga

SEQ ID NO: 10049 - protein, 362 aa, Pseudomonas putida
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPPEAGALIEPLAVGMHAVKKAGSLLGQTVVVVGAGTIGLCTIMCAKAAGAAQVIALEMSSARKAKAKEVGATVVLDPSQCDALAQIRALTFGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 10050 - DNA, 1737 bp, Arabidopsis thaliana
  CDS (516)..(1610)
gtctttcagtctactttatccgatcggcgccggcgagattcaagggtaaagaagaagatgagtggtgaagttgttttagctgctagagtttatcgtgaccttctcaaagcagtggtgaaacatgttggtaaagaagatcacaagtctcatttcttagactttgttaagcaagaatttcgaaagaatgcaaactcagagaaaataaaccttgctcgaaattacacatatcttctcaatagcattcactctcacaaggatctgctgttctcatacaacattgcggttgatagaactgaagaaatgaaacgagtgcttaataaatctgcagccagtgtagggcttcgtcttcctgaagtttacgagccttgatcatgcattcattcctctttgtctttccgggggatgagtcgttatgatttcttcatttctgtggacaggctctggtagctttggcttttgatctaaaagctgagagtcaatagagagctttgtgctgagcatagcagagaagagttatggggaaaggagggatgtctcaaggagaaggctcaaaggttgaagaagaaaacatggctgcttggttggttggtatcaataccctcaagatccaaccttttcttcttccttccgttggtcctcatgatgtgagagttaggatgaaagctgttggtatttgtggaagtgatgttcattaccttaagaccatgatatgtgcggattttgtggtgaaagagccgatggtgattggacatgaatgtgctgggatcattgaagaagtaggtgaagaagtgaaacatttagtggttggtgaccgtgtagctcttgaacctgggattagttgttggagatgcaatctctgcagggaaggacgatacaacctttgtccagaaatgaagttctttgcaactccaccggttcatggctctttagctaaccaagtggtacaccctgcggacctatgcttcaaattgcctgagaatgtgagtttggaggaaggagcaatgtgtgaaccacttagtgttggtgtccatgcttgtcgccgagctgaggttggtcctgaaacaaacgttttggtaatgggagctggacctattggccttgttacaatgttggctgctcgggctttcagtgtgcctagaattgttattgtggatgttgatgagaaccgtttagccgtagcaaaacagctcggcgcagatgagattgtacaagtgacaacaaacttagaggatgttggttctgaggttgaacagattcagaaagctatggggtcaaacatcgatgtaacattcgactgtgcgggttttaacaaaaccatgtcgacagcattagcagccactcgttgtggcggtaaagtctgtcttgtcggaatgggtcacggtataatgactgtccctctcactcctgcagctgcaagggaggtagatgtggtgggtgtgttcaggtacaagaacacatggccattgtgtcttgagttcctgacaagtggtaagattgatgtaaagccactcataacccacagattcggtttctctcaaaaggaagtggaagatgcctttgaaaccagtgctcgtgggagcaatgccatcaaagttatgttcaatctctgaaaacaatctttgcttttctaagaacatattaaggtttcataataaggaagcttctgtaactttgttatccattgtatatcaactctgaatctctcttgaataagataatcctttatgataaaaaaaa

SEQ ID NO: 10051 - protein, 364 aa, Arabidopsis thaliana
MGKGGMSQGEGSKVEEENMAAWLVGINTLKIQPFLLPSVGPHDVRVRMKAVGICGSDVHYLKTMICADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 10052 - DNA, 1883 bp, Arxula adeninivorans
  CDS (505)..(1611)
ctgtgagtggatctgcgtagacgataagatgaatgtttgggaaaccagagaacaggggcgtcccaatgtcgaagaaatgacaataagtttcgctggtaatgggccatgctgggttgcagcgtgcggaccagatccattgctacgggcggtgcaaaatggtgtggcaaagctcatctccgatggccacgacgtgcatcttcatattgaggcctttggctggtaattaacttatactaacaatcaattgactatgttacaaaaatctttcctgaccgttaacggcctgtctcaccttgctcagtatttatccgaggatggttcgactgcctaatggggtaaagccggagcacggctagcatgtcatcggtatcgcccttttgggtactaactctgtggggtaaaaagcggacttgattgttccggttggattgcaaaatatttaagcattgagtttccataaagatgtgaagatttattcaatttatccattaccataatatagcaatggctgcacaagtcgaggaacaggtgcttaatctccgagctcaagcggatcacaatccctcgtttgttctcaaaaagcccttggaattggggtttgaagagcgcccagtgcctgtgattactgaccctcgagatgttaaaatccaggtcaagaagacgggaatctgcggatctgatgttcacttttggcaacatggtcgtattggtgactacgtagtggaaaagccaatggtcctaggccatgagtccagtggagtggtggttgaagttggttctgaggtcacctccctcaaggtgggagaccgagtagctatggaacctggagtgccggacaggcgctcaaaggaatataagatgggacgatatcatttgtgccctcatgtgcgctttgcagcctgccctcccactgacggaacgctctgcaagtattacacacttcccgaggacttctgcgttaaactgcctgaaaacgtagattttgaggaaggagcattggtggagccattgagtgtagcagtccacaccgctaggcttcttggtatctaccctggctccaaggtggtcgtgttcggagcaggaccaattggccagctgtgcattggagtgtgcaaggcatttggtgccagtataattggcgcggtggatttgtttgagcaaaagctagagaccgcaaaggagtttggtgcatctcacacgtatgtccctcagaaaggggactcacatgacgagactgcccacaaaattctcgagctcctgcccaacaagcaggccccagatgtggtcattgatgccagtggagctgagcaatctatcaacgcaggaattgagcttctagagagaggtggaacctttggacaggtggccatgggccgaactgactacattcagtttgccgtttctcgtatggccatgaaggagattcgattccagggagtcttccgatatacctatggagattatgagctcgcaacccagttgattggtgatggaaagatccctgtaaagaaattggtcacccataggcggccatttgaaaaggccgaggaggcatatgaattggtcaagagcggtgttgcagtaaagtgcattattgatggacctgagtaatcaaagtatggaccatcggtttgtcagatcttttactatttatcctataattgatgcctacgattcattgttttcggacacagttagttgttttccttttcccatctattcacattgttgaactgctattcataataacactatattggtcgtagtcccgtactgttgaatacaggatctcttcattccctcagcgggcatttaagggcactttgatatggccttaggttgggcttcttgggctctctcgcgatctcgcctagcgaagatct

SEQ ID NO: 10053 - protein, 368 aa, Arxula adeninivorans
MAAQVEEQVLNLRAQADHNPSFVLKKPLELGFEERPVPVITDPRDVKIQVKKTGICGSDVHFWQHGRIGDYVVEKPMVLGHESSGVVVEVGSEVTSLKVGDRVAMEPGVPDRRSKEYKMGRYHLCPHVRFAACPPTDGTLCKYYTLPEDFCVKLPENVDFEEGALVEPLSVAVHTARLLGIYPGSKVVVFGAGPIGQLCIGVCKAFGASIIGAVDLFEQKLETAKEFGASHTYVPQKGDSHDETAHKILELLPNKQAPDVVIDASGAEQSINAGIELLERGGTFGQVAMGRTDYIQFAVSRMAMKEIRFQGVFRYTYGDYELATQLIGDGKIPVKKLVTHRRPFEKAEEAYELVKSGVAVKCIIDGPE

SEQ ID NO: 10054 - DNA, 1113 bp, Sulfitobacter sp
  CDS (1)..(1113)
atgaaaacacgcgccgccgtcgccgttgccgcaggtcaaccgcttgaagtgatggacgtaaatctcgaaggccccaagcggggtgaagtcctgatcgaaatcaacgccaccggcctgtgccacaccgatgaattcacccgttcgggcgacgaccccgaagggattttcccggccattctgggccacgagggcgcaggcgtcgtgcttgaggtcggcgagggcgtcaccacgctcgaggtcggcgatcacgtgatcccgctttacacgcccgaatgccgcgagtgtgaatattgcctatcgggtaaaaccaacctctgccaggcgatccgcgtgacccaaggccaggggctgctgcccgatggcaccacgcggttctcgatgatggatggcacgccgatccaccactacatgggctgttcgaccttcgccaatcacacggtcatccctgaaatcgcgcttgctaaagtccgcaaggacgcgccgtttgataaaatctgctatatcggctgcggtgtgaccacgggcatcggcgcggtgatcaacaccgccaaggtagagatcggcgcgcgctgtgtggtctttggcttgggcggcatcgggctgaacgtcattcaaggcctgcgcatggcgggcgccgaccagatcgtcggcgtcgatctgaacgacgacaaggaagagacaggccgctacttcggcatgaccgactttgtgaaccccaccaaggtcgagggcgatatggtcgcgcatctggtcgagctgaccaaaggcggcgcggattacacctttgatgccacaggcaataccaaggtcatgcggcaggcgcttgaagccgcgcataagggctggggggagtcgatcattatcggtgtcgcaccggcgggggccgaaatctcgacccgtccgttccagctggtcacgggccgcgtctggaaaggcacggcattcggcggggccaagggccgcaccgatgtgcccaagatcgtggattggtacatgaacggcaagatcgagatcgacccgatgatcacccacaagctgacgctggaccagatcaacgaagggttcgagctgatgcacaaaggtgaatccattcgcgccgtcgttgaattctaa

SEQ ID NO: 10055 - protein, 370 aa, Sulfitobacter sp
MKTRAAVAVAAGQPLEVMDVNLEGPKRGEVLIEINATGLCHTDEFTRSGDDPEGIFPAILGHEGAGVVLEVGEGVTTLEVGDHVIPLYTPECRECEYCLSGKTNLCQAIRVTQGQGLLPDGTTRFSMMDGTPIHHYMGCSTFANHTVIPEIALAKVRKDAPFDKICYIGCGVTTGIGAVINTAKVEIGARCVVFGLGGIGLNVIQGLRMAGADQIVGVDLNDDKEETGRYFGMTDFVNPTKVEGDMVAHLVELTKGGADYTFDATGNTKVMRQALEAAHKGWGESIIIGVAPAGAEISTRPFQLVTGRVWKGTAFGGAKGRTDVPKIVDWYMNGKIEIDPMITHKLTLDQINEGFELMHKGESIRAVVEF

SEQ ID NO: 10056 - DNA, 1149 bp, Aspergillus oryzae
  CDS (1)..(1149)
atggctactgcaactgtcctcgaaaaggccaacattggtgtctacaccaacaccaaccacgacctgtgggtcgcagaatcgaagccgacgctcgaggaggtgaagagtggtgagagcttgaagcccggtgaggtgacagtccaggttcgcagtaccggaatttgcggatctgacgtgcacttttggcatgccggctgcattggtcccatgattgtcacgggagaccatatcctgggtcacgagtcggccggcgaagtgattgcagttgcctccgatgtcacccacctcaagccaggcgatcgtgtcgccgtcgagcccaacattccctgccacgcatgcgagccttgcttgactggacgttacaacggttgtgaaaaggtgcttttcctgtctactcctcccgtggatggtttgctgcggcgctatgtcaaccaccccgctgtctggtgccacaagatcggtgatatgagctatgaggatggagctctgctggagcctctcagtgtgtctctcgctgcaattgagcgaagcggccttcgcttgggcgaccctgtacttgtcaccggtgctggtcccatcggtttgatcactctcctcagtgcccgcgccgcgggagcaacacccattgtcatcaccgatatcgacgagggaagactagccttcgccaagtcgttggttcctgatgttatcacctacaaggtgcagaccaatctgtccgctgaggataatgctgcgggcattatcgatgctttcaacgatggccagggttccgcccctgatgccctgaagcctaagctggcactggagtgcaccggtgttgagagtagtgtcgcatctgctatctggagtgtcaagttcggtggcaaggtcttcgtgatcggtgtgggcaagaacgagatgaagattccgttcatgcgtctgagcacccaagagatcgaccttcagtaccagtaccgctactgcaacacctggcctcgcgccattcgtcttgtgaggaacggtgtcatcagtctgaagaagcttgttacacatcgcttcctcttggaggacgctcttaaggccttcgaaactgctgcagaccccaagacgggagctatcaaggttcagatcatgagcaacgaggaggacgtgaagggtgcttcagcttaa

SEQ ID NO: 10057 - protein, 382 aa, Aspergillus oryzae
MATATVLEKANIGVYTNTNHDLWVAESKPTLEEVKSGESLKPGEVTVQVRSTGICGSDVHFWHAGCIGPMIVTGDHILGHESAGEVIAVASDVTHLKPGDRVAVEPNIPCHACEPCLTGRYNGCEKVLFLSTPPVDGLLRRYVNHPAVWCHKIGDMSYEDGALLEPLSVSLAAIERSGLRLGDPVLVTGAGPIGLITLLSARAAGATPIVITDIDEGRLAFAKSLVPDVITYKVQTNLSAEDNAAGIIDAFNDGQGSAPDALKPKLALECTGVESSVASAIWSVKFGGKVFVIGVGKNEMKIPFMRLSTQEIDLQYQYRYCNTWPRAIRLVRNGVISLKKLVTHRFLLEDALKAFETAADPKTGAIKVQIMSNEEDVKGASA

SEQ ID NO: 10058 - DNA, 1381 bp, Puccinia triticina
  CDS (47)..(1243)
tcgcatccccctccctcacttccaaagtagaaagccgtaaagagctatgtgcggaacatcctcggcgatggacccagtcttccaatcaatcaacccatccttgtatgatccgcagcgcgttttagactcggaggagtttgagattctcacggacatgaataaagtcaaggcttattcggatgacaacaagaacattgcctgttgttacaatgataagcaacagctcaacatggtcaaaaagccgatgcctgaagtccatccaggccaagttttagtccgtgtccgggccactggtatctgcggcagtgacatccatttctggaaacactcacgagttggcgagaagatggtcgtgaaacatgagtgtggcgccgggcacgaatcagctggggaagtgattgcgcttggggaaggagtaaccgatcttgaagtcggcgatcgagttgcaattgaaaccgggatcccgtgctccaagccaacctgcgagatgtgccgaacaggccaatacaatgcatgcccggagatcatgttttggttcacttcaccctaccatggcctcatgacccgctatcacgcgcacccaagctgctggctccacaaactcccaccgaacgtctcctacgaagagggttcattgctcgagccgctggccgttgctctggcaggcatcgagcgtgccggagtccgactcggcgacccagtgttgatctgtggagccggacctatcgggctggtcactcttctcgcatgccacgccgctggcgcctgtccaatcgccatcaccgatctttccgaaggccgcttggattgtgccaaacgtctcgtgcctagtgtctcgacctttaagatctccttaggagagtctgagacggacgtcgctggacaaattcaagctgccatgggatgcaagccccgcgtagcaatggaatgtaccgggtttgagtcatccatcgccaccgcaatcttcagtgtcaagttcggaggcaaggtgttcgtcatcggagtcggaaaggacaagcaaacccttccattcatgcacatggctgagaacgaaatcgacctacaattccaattccgatacgccaaccaataccccaaggccatccgattggtttctaccggactgatcgatgtcaaacctcttatcactcaccgattcgtcctcgaaaaggccatcgaagcattcaacacagctgctgatccgaaatccggctcgatgaaagttcaagttgtagattactaatccaatgtaggattcttgattccttttgtcatccgatgtagtaaaccttttttgttcctgtggatttttagattttcgtagatatatatagatttaatgatatagcaattttagatgggaaaaaaaaaaaaaaaaaaa

SEQ ID NO: 10059 - protein, 398 aa, Puccinia triticina
MCGTSSAMDPVFQSINPSLYDPQRVLDSEEFEILTDMNKVKAYSDDNKNIACCYNDKQQLNMVKKPMPEVHPGQVLVRVRATGICGSDIHFWKHSRVGEKMVVKHECGAGHESAGEVIALGEGVTDLEVGDRVAIETGIPCSKPTCEMCRTGQYNACPEIMFWFTSPYHGLMTRYHAHPSCWLHKLPPNVSYEEGSLLEPLAVALAGIERAGVRLGDPVLICGAGPIGLVTLLACHAAGACPIAITDLSEGRLDCAKRLVPSVSTFKISLGESETDVAGQIQAAMGCKPRVAMECTGFESSIATAIFSVKFGGKVFVIGVGKDKQTLPFMHMAENEIDLQFQFRYANQYPKAIRLVSTGLIDVKPLITHRFVLEKAIEAFNTAADPKSGSMKVQVVDY

SEQ ID NO: 10060 - DNA, 1017 bp, Leuconostoc pseudomesenteroides
  CDS (1)..(1017): transl_table=11
atggaagcacttgtgttaactggtacaaaaaaattagaggttgaaaacattgaacaacctgaggtaaagccgaatgaagtgttgattcatacagcattcgctggtatttgcggtactgatcacgctttgtatgccggtcttcctggctcagccgatgctgtgccaccaatcgttttggggcatgaaaattctggtgttgtagctgaaattggttctgatgttacaaacgttgcggtgggtgatcgtgtcacaattgatcccaatatttactgtggtcaatgcaagtattgccgtacagcacgtccagagctttgcgaaaacttgtctgcagttggtgtaacacgcaatggtggctttgaagaatactttactgcgcccgcatcagttgtttaccaaattccagataatgtttcacttaagtcagctgccgtggttgagccgatttcatgtgctgttcacggtattcaacttcttaaagtgacaccataccaaaaggcattagttattggtgacggcttcatgggtgaactctttgttcaaattctgcaagcttatggcattcaccaagtcgacttggctggtattgttcctgaaaagcttgctatgaacaaagaaaagttcggcgtgaaaaatacgtacaatacaaaagatggcgacaaaattcccgaaggcacttacgatgttgttgttgaagcagttggcctaccacagacacaagaagccgcaattgaagcctcagctcgtggcgctcaggttttgatgtttggtgttggcggtcccgacgcaaagttccaaatgaacacttacgaagtcttccaaaagcaattgacgattcaaggatcatttatcaatccaaacgcatttgaagactcattggcattgttatcatcaggcaagttagacgtcgaatcgctaatgtcacacgaattagattaccagactgttgatgactttgtgaatggcaagttaggtgtcgtttcaaaggcagtcgttaaggttggtggcgaagaggcataa

SEQ ID NO: 10061 - protein, 338 aa, Leuconostoc pseudomesenteroides
MEALVLTGTKKLEVENIEQPEVKPNEVLIHTAFAGICGTDHALYAGLPGSADAVPPIVLGHENSGVVAEIGSDVTNVAVGDRVTIDPNIYCGQCKYCRTARPELCENLSAVGVTRNGGFEEYFTAPASVVYQIPDNVSLKSAAVVEPISCAVHGIQLLKVTPYQKALVIGDGFMGELFVQILQAYGIHQVDLAGIVPEKLAMNKEKFGVKNTYNTKDGDKIPEGTYDVVVEAVGLPQTQEAAIEASARGAQVLMFGVGGPDAKFQMNTYEVFQKQLTIQGSFINPNAFEDSLALLSSGKLDVESLMSHELDYQTVDDFVNGKLGVVSKAVVKVGGEEA

SEQ ID NO: 10062 - DNA, 1077 bp, Aspergillus oryzae
  CDS (1)..(1077)
atgggtgcgccacccaaaaccgctcagaacttgtcctttgtcctcgaagggattcataaggtcaaatttgaggaccgaccaatccctcaactgagagatgctcatgacgttctcgtggatgtcaggtttaccggtatttgcggtagtgacgttcactattgggaacatggctcaattggtcaatttgtcgtcaaagatcctatggtactaggtcatgaatcttctggcgtaatcagcaaggtcggctcggctgttacaacattaaaggtgggggatcatgttgccatggagcctggtataccgtgtcgccggtgtgagccctgtaaagaagggaagtataacctctgcgaaaaaatggccttcgccgcaacgccaccttacgacggtacgctagccaagtattatgtcctgcccgaggacttctgctacaagcttcctgaaaacatcaatcttcaggaagctgctgtgatggagcctctcagcgtcgctgtgcatattgtaaagcaagcaaatgtagcgccaggacaatctgtggtagtcttcggtgccgggccggtggggttattgtgctgcgcggtggctagggcttttggctccccgaaggtcatcgccgtggacatccaaaaaggaaggctggaatttgcgaagaaatatgccgcaacagcaatcttcgaacctagcaaggtttctgcgttggaaaatgcagaacgaattgttaatgaaaatgatctcggccgtggagcggatatcgttattgacgcatcaggtgctgagccttcagttcatacgggcatacatgtccttcgtcctggtggcacttacgtgcaaggtggtatgggaaggaatgaaatcacctttcccatcatggcggcttgcacgaaagagttgaatgtcaggggcagtttccgttacggcagtggtgattataagcttgcggttaacctagtagcttcaggcaaggttagcgtaaaggaactaatcaccggagtcgtcagttttgaagacgcggaacaagcgttccatgaagtcaaagctgggaagggtatcaagacacttattgctggtgttgatgtatga

SEQ ID NO: 10063 - protein, 358 aa, Aspergillus oryzae
MGAPPKTAQNLSFVLEGIHKVKFEDRPIPQLRDAHDVLVDVRFTGICGSDVHYWEHGSIGQFVVKDPMVLGHESSGVISKVGSAVTTLKVGDHVAMEPGIPCRRCEPCKEGKYNLCEKMAFAATPPYDGTLAKYYVLPEDFCYKLPENINLQEAAVMEPLSVAVHIVKQANVAPGQSVVVFGAGPVGLLCCAVARAFGSPKVIAVDIQKGRLEFAKKYAATAIFEPSKVSALENAERIVNENDLGRGADIVIDASGAEPSVHTGIHVLRPGGTYVQGGMGRNEITFPIMAACTKELNVRGSFRYGSGDYKLAVNLVASGKVSVKELITGVVSFEDAEQAFHEVKAGKGIKTLIAGVDV

SEQ ID NO: 10064 - DNA, 1092 bp, Trichoderma reesei
  CDS (1)..(1092)
atggcgactcaaacgatcaacaaggatgcgatcagcaacctctccttcgtcctcaacaagcccggcgacgtgacctttgaggagcggccgaagccgaccatcacggaccccaacgacgtcctcgtcgccgtcaactacacgggcatctgcggctccgacgtgcactactgggtgcacggcgccatcgggcacttcgtcgtcaaggacccgatggtgctgggccacgagtcggccggcaccgtcgtcgaggtcggcccggccgtcaagagcctcaagcccggcgaccgcgtcgccctcgagcccggctacccgtgccggcggtgctccttctgccgcgccggcaaatacaacctgtgcccggacatggtcttcgccgccacgccgccgtaccacggcaccctgacgggcctgtgggcggcgcccgccgacttctgctacaagctgccggacggcgtgtcgctgcaggagggcgcgctgatcgagccgctggccgtggccgtccacattgtcaagcaggcccgcgtccagccgggccagtccgtcgtcgtcatgggcgccggccccgtcggcctgctgtgcgccgccgtggccaaggcgtacggcgcctccaccattgtcagcgtcgacatcgtgcagtccaagctcgactttgcgcgcggcttctgctcgacgcacacgtacgtctcgcagcgcatctcggctgaggacaacgcaaaggccatcaaggagctggcgggcctgcccggcggcgccgacgtcgtgattgacgccagcggcgcggagccgtcgatccagacgagcattcacgtcgtccgcatgggcggcacgtacgtccagggcggcatgggcaagagcgacatcacgttccccatcatggccatgtgcctcaaggaggtgacggtccggggctcgttccgctacggcgccggcgactacgagctggcggtcgagctggtccggacggggcgggtggacgtcaagaagctgattacgggcaccgtcagcttcaagcaggcggaggaggcgttccaaaaggtcaagtctggggaggccatcaagattctgattgccgggcccaacgagaaggtgtaa

SEQ ID NO: 10065 - protein, 363 aa, Trichoderma reesei
MATQTINKDAISNLSFVLNKPGDVTFEERPKPTITDPNDVLVAVNYTGICGSDVHYWVHGAIGHFVVKDPMVLGHESAGTVVEVGPAVKSLKPGDRVALEPGYPCRRCSFCRAGKYNLCPDMVFAATPPYHGTLTGLWAAPADFCYKLPDGVSLQEGALIEPLAVAVHIVKQARVQPGQSVVVMGAGPVGLLCAAVAKAYGASTIVSVDIVQSKLDFARGFCSTHTYVSQRISAEDNAKAIKELAGLPGGADVVIDASGAEPSIQTSIHVVRMGGTYVQGGMGKSDITFPIMAMCLKEVTVRGSFRYGAGDYELAVELVRTGRVDVKKLITGTVSFKQAEEAFQKVKSGEAIKILIAGPNEKV

SEQ ID NO: 10066 - DNA, 1059 bp, Enterococcus avium
  CDS (1)..(1059): transl_table=11
atgagtaaaacaatgaagggtgtttccaagcaggcacccggttatgaccaaatggcatttatcgatttatctgttccagaagcaacagatgacaaggtcttgattaaagtcgcttatacaggtatttgcggatcagatatccatacgtttaaaggtgaatacaaaaatcccactactcccgtcgtcctaggacatgaattttctgggcaggtagttgaagtcggagccaatgtaccaaaggtcaaggttggtgatcgggtaaccagtgagacgaccttttatgtctgcggcgaatgcgattattgcaaggaaaagcagtataatttgtgtccccatcgaaaaggaatcggcacgcagcaaaatggctccatggcgaactatgtgttggctcgagaagaaagcattcatttactgccggatcatttaagctatgaaggtgcggcgatgagcgaaccattagcgtgctgtgtccacgcgatgtatcaaaagagtcacttggaattaaaagacacgatcattatcatgggccctggaccaatcggactgtatcttttgcagattgccaaggaaattggagccttcgtcattatgacggggatcacaaaagatgctcatcgcttagcattagcaaaaaaactaggcgcggatgtgatcgttgatacgatgaaggaagatctagcgaaagtcgtcaatgagatcacggatggctacggtgtcgataaagtgtatgatgcctcaggagcagttcctgctgttaatgctagtctgccattgattcgcaagcaggggcaatttattcaagtaggcttgttcgctaataaaatggtggatttagacactgaatcgatcattcaacgagagatcgaatacatcggcagtcgttcacagaacccttatgactggccgattgcgatccacttattagcgaaaggtgcgatcaatatcgatgagatgattacgaaaaaatacccgttgactgaatggcgggaagcctttgataaagtgatggaaggcaatgaaatcaaggtaatgatcgaatccaatccagaagaattttaa

SEQ ID NO: 10067 - protein, 352 aa, Enterococcus avium
MSKTMKGVSKQAPGYDQMAFIDLSVPEATDDKVLIKVAYTGICGSDIHTFKGEYKNPTTPVVLGHEFSGQVVEVGANVPKVKVGDRVTSETTFYVCGECDYCKEKQYNLCPHRKGIGTQQNGSMANYVLAREESIHLLPDHLSYEGAAMSEPLACCVHAMYQKSHLELKDTIIIMGPGPIGLYLLQIAKEIGAFVIMTGITKDAHRLALAKKLGADVIVDTMKEDLAKVVNEITDGYGVDKVYDASGAVPAVNASLPLIRKQGQFIQVGLFANKMVDLDTESIIQREIEYIGSRSQNPYDWPIAIHLLAKGAINIDEMITKKYPLTEWREAFDKVMEGNEIKVMIESNPEEF

SEQ ID NO: 10068 - DNA, 1445 bp, Malus domestica
  CDS (129)..(1235)
atcaagaaatcaaacaagtccgttcattccgtttatccgtgccttttgtattatctgtgtctattttgttaggagaagtagtagtttgtgccttagaaacacactttagaaaaaacagagagtaaaaaatgggtaagggaggccaatcctgcaatggcgtggttagagacgccaaacctgttgagcaggaaaacatggctgcctggctagttgatgttaacaccatcaagatcctacctttcaagctccccgctattggaccgaatgatgttcgaattcggattaaggctgttggcatttgcggaagtgatattcactacctcaagaccatgaaatgtggggattttcaggttaaggatccgatggtgatcggacatgagtgtgctgggatcgtagacaaagttgggagcgaggtgaagcatctggtgcctggtgaccgtgtggctgttgagcctggcatcagctgcgcacggtgccagcagtgcaagggaggccgctataatctttgccctgatatgaagtttttcgccaccccaccggttcatggttccttggctaatcagattgtgcaccctgcggatctgtgctttaaattgccggaaaacgtgagtttggaggaaggggcaatgtgtgagcccttgagtgttggggttcatgcttgtcggcgagccaatgttgatcccgagacaactgtcctgatcatcggtgcagggcctattggtctcgtttcagttttagccgctcgtgctttcggggcaccaagaattgtgattgtggatatggatgacaagcgtctagcaatggcaaagtctctcggtgctgatgaagccgtgaaagtttcgacaaaaatggaggatttagatgatgaagttgccgaaattaaagaagccatgatctccgaagtggatgtgaccttcgattgtgtgggtttcaacaaaaccgtgtcgaccggcctcaatgctactcgtcccggcggaaaagtctgccttgtaggaatgggacacggcgtgatgaccgtgcctctgactcccgctgctgctagggaggttgacgttgttggagttttccgataccagaaaacatggccgctttgcctcgagtttttgagaagtgggaagattgacgtgaagccgcttatcacacaccgttttggatttactgagaaggaggtggaagaagcgtttgcaacaagtgctcgtgggggtaatgccatcaaggtgatgttcaaattgtaaagacgaagacaggttttgatgatcaaattgttagtagaatgtagagggtggggtgttggggggattatttacatgtcataactcaataagcaagttccgttccactgtttgggtttttaagtcataatagtattacttttggtgggcttctcattctgtttgttttgttaccgcggagcttaacaaaaaggaatcctccactcctttgct

SEQ ID NO: 10069 - protein, 368 aa, Malus domestica
MGKGGQSCNGVVRDAKPVEQENMAAWLVDVNTIKILPFKLPAIGPNDVRIRIKAVGICGSDIHYLKTMKCGDFQVKDPMVIGHECAGIVDKVGSEVKHLVPGDRVAVEPGISCARCQQCKGGRYNLCPDMKFFATPPVHGSLANQIVHPADLCFKLPENVSLEEGAMCEPLSVGVHACRRANVDPETTVLIIGAGPIGLVSVLAARAFGAPRIVIVDMDDKRLAMAKSLGADEAVKVSTKMEDLDDEVAEIKEAMISEVDVTFDCVGFNKTVSTGLNATRPGGKVCLVGMGHGVMTVPLTPAAAREVDVVGVFRYQKTWPLCLEFLRSGKIDVKPLITHRFGFTEKEVEEAFATSARGGNAIKVMFKL

SEQ ID NO: 10070 - DNA, 1359 bp, Malus domestica
  CDS (108)..(1211)
gttcattccgtttatccgtgccttttgtattatctgtgtctattttgttaggagaagtagtagtttgtgccttagaaacacactttagaaagaacagagagtaaaaaatgggtaagggaggccaatcctgcaatggcgtggttagagacgccaaacctgttgagcaggaaaacatggctgtctggctagttgatgttaacaccatcaagatcctacctttcaagctccccgctattggaccgaatgatgttcgaattcggatcaaggctgtcgtcatttgtggaagtgatgttcactacctcaagaccatgaaatgcgcggattttgaggttaaagagccaatggtaatcggacatgagtgtgccgggatcgtagacaccgttgggagcgaggtgaagcatttggtgcctggtgaccgcgtgggagagcctggcatcagctgcgcacggtgccagcagtgcaagggaggccgctataatctttgccctgatatgaagtttttcgccaccccaccggttcatggttccttggctaatcagattgtgcaccctgcggatctgtgctttaaattgccggaaaacgtgagtttggaggaaggggcaatgtgtgagcccttgagtgttggggttcacgcttgtcggcgagccaatgttggtcccgagacaagtgtcctgatcatcggagcagggcctattggtctcgtttcagttttagccgctcgtgctttcggggcaccaagaattgtgattgtggatatggatgacaagcgtctagcaatggcaaagtctctcggtgctgatgaagccgtgaaagtttcgacaaaaatggaggatttagatgatagagttgccgaaattaaaaaagccatgatctccgaagtggatgtgaccttcgattgtgtgggtttcaacaaaaccatgtcgaccggcctcaatgctactcgtcccggcggaaaagtctgccttgtaggaatgggacacggtgtgatgacggtgcctctgactcccgctgctgctagggaggttgacgttgttggagttttccgataccagaacacatggccgctttgcctcgagtttttgagaagtgggaagattgacgtgaagccgcttatcacacaccgttttggatttactgagaaggaggtggaagaagcgtttgcaacaagtgctcgtgggggtaatgccatcaaggtgatgttcaaattgtaaagacgaagacaggttttgatgatcaaattgttagtagaatgtagagggtggggtgttggggggattatttacatgtcataactcaataagcaagttcgttccactgtatggttttttaagtaataatagtattacttttggtgggctg

SEQ ID NO: 10071 - protein, 367 aa, Malus domestica
MGKGGQSCNGVVRDAKPVEQENMAVWLVDVNTIKILPFKLPAIGPNDVRIRIKAVVICGSDVHYLKTMKCADFEVKEPMVIGHECAGIVDTVGSEVKHLVPGDRVGEPGISCARCQQCKGGRYNLCPDMKFFATPPVHGSLANQIVHPADLCFKLPENVSLEEGAMCEPLSVGVHACRRANVGPETSVLIIGAGPIGLVSVLAARAFGAPRIVIVDMDDKRLAMAKSLGADEAVKVSTKMEDLDDRVAEIKKAMISEVDVTFDCVGFNKTMSTGLNATRPGGKVCLVGMGHGVMTVPLTPAAAREVDVVGVFRYQNTWPLCLEFLRSGKIDVKPLITHRFGFTEKEVEEAFATSARGGNAIKVMFKL

SEQ ID NO: 10072 - DNA, 1485 bp, Malus domestica
  CDS (99)..(1205)
gtttatccgtgccttttatattatctgtgtctattttgttaggagaagtagtagtttatgccttagaaacacactttagaaaaaacagagagtaaaaaatgggtaagggaggccaatcctgcaatggcgtggttagagacgccaaacctgttgagcaggaaaacatggctgtctggctagttgatgttaacaccatcaagatcctacctttcaagctccccgctattggaccgaatgatgttcgaattcggattaaggctgttggcatttgcggaagtgatattcactacctcaagaccatgaaatgtggggattttcaggttaaggatccgatggtgatcggacatgagtgtgctgggatcgtagacaaagttgggagcaaggtgaagcatctggtgcctggtgaccgtgtggctgttgagcccggcatcagctgcgcacattgccagcagtgcaaaggcggccgctacaatctatgtttcgacatgaagtttttcgccaccccacctgttcatggttcattggcgaatcagattgtgcaccccgcggatctgtgctttaaattgccggaaaatgtgagcttggaagaaggggcaatgtgtgagcccttgagtgttggggttcacccgtttcggcgagccaatgttggtcccgaaacaactgttctgatcgtcggcgcagggccgatcgggctggtttccgtgctggctgctcgtgctttcggagcaccaagaattgtcatcgtagatatggatgacaggcgtttagccatggcaaagtctctcgggcccgatggcacggtcaaagtttcgacaaaaatggaggatttagatgacgaacttgccaagattaaagaagctatgggatccgaagttgatgtgaccttcgactgtgttggcttcaacaaaaccatgtctacgggcctcaatgccactcgtcctggcggcaaagtttgccttgtcggaatgggacacggggtgacgacggtccctctcactccggctgctgccagggaggttgacgtggttggagtttttgcttacaagaacacatggccgctttgcctagagtttttgagaagcgggaagatcgacgtgaagccgcttattacccaccggtttggttttaccgagaaggaggtggaagaagcttttgcaaccagtgctcgggggggcaacgccattaaagtcatgtttactctatagcaaatcaaccatgaagttgcagaatttcggattgtttggagggggcaagtttgtgatggtttggaaatttggaagtcatcatctcggatgaagaatgttcttgttctaaagttcgtggaaacttgttgtacagggaccattgtatacctttattagatctcggcatgcaccagtgtagtagcttcccgtatttttaacatgagtccgtcaatatatatgaactatgtatgtaactaaaagttcttcaatataagtctttttttccgctgaagttgttttc

SEQ ID NO: 10073 - protein, 368 aa, Malus domestica
MGKGGQSCNGVVRDAKPVEQENMAVWLVDVNTIKILPFKLPAIGPNDVRIRIKAVGICGSDIHYLKTMKCGDFQVKDPMVIGHECAGIVDKVGSKVKHLVPGDRVAVEPGISCAHCQQCKGGRYNLCFDMKFFATPPVHGSLANQIVHPADLCFKLPENVSLEEGAMCEPLSVGVHPFRRANVGPETTVLIVGAGPIGLVSVLAARAFGAPRIVIVDMDDRRLAMAKSLGPDGTVKVSTKMEDLDDELAKIKEAMGSEVDVTFDCVGFNKTMSTGLNATRPGGKVCLVGMGHGVTTVPLTPAAAREVDVVGVFAYKNTWPLCLEFLRSGKIDVKPLITHRFGFTEKEVEEAFATSARGGNAIKVMFTL

SEQ ID NO: 10074 - DNA, 1918 bp, Bacillus cereus
  CDS (241)..(1290): transl_table=11
ataaaatatttcaagcgatattcacctctcctatgctattatggcataatgctaatttcaaccgcaatgaaattagcattaacagatgtggaaaaaagtacaaagtgacaaaatattgaacgttatttgttaaaatttagtggaaatgagattgtttttttgaaatatatggatagaagtattataatagatttgtaaacttcaccaggttaagtatatacatagagagggatgtataaaatgaaagcattactttggcataatcaacgtgatgtaagagtagaagaagtaccagaaccaactgtaaaaccaggagcagttaagattaaagtgaaatggtgtggtatctgcgggacagacctgcatgaatatttagcaggacctatttttattccaacagaagagcatccattaacacatgtaaaagcaccggttattttaggtcatgagtttagcggtgaggtagttgaaatcggtgaaggtgttacatctcataaagtgggagaccgcgtcgttgtagaaccaatttattcttgtggtaaatgtgaagcttgtaaacatggacattacaatgtttgtgaacaacttgttttccacggtcttggcggagaaggcggcggtttctctgaatatacagtagtaccagaagatatggttcatcatattccagatgaaatgacgtatgaacaaggtgcacttgtagaaccagcagctgtagcagttcatgcagtacgtcaaagtaaattaaaagaaggggaagctgtagcagtatttggttgtggtccaattggacttcttgttatccaagcagctaaagcagcaggagcaactcctgttattgcagtcgagctttctaaagaacgtcaagagttagcaaaattagcaggtgcggattacgtattaaatccagctactcaagatgtattagcagaaattcgtaacttaacaaatggtttaggtgtaaatgtgagctttgaagtaacaggtgttgaagtagtacttcgtcaagcgattgaaagtacaagtttcgaaggacaaactgtaattgttagtgtatgggaaaaagatgcaacaattactccaaacaatcttgtactaaaagaaaaagaagtggttggtattttaggataccgtcatatcttcccagctgttattaaattaattagctctggccaaattcaagcagagaaattaattacgaaaaaaatcacagtagatcaagttgttgaagaaggatttgaagcacttgtaaaagataaaacacaagtgaaaatttcttgtttcacctaaataatatagaatagtaaaaagtagctctttttctagaaatagaagagggctactttttttctatacagaaaggtgatagactttcctgtaactacaggtattttgtttggaaggggaagtctaatgctttcatttatgttgacattgaaacggatgctaaaagcttgtttgcgagcatggaaagataaagaatttcaagtgttattcgtattaacatttttaacattaacgtcgggtacgattttttatagtacagttgaaggattacgtcctcttgacgctttatattttagtgtggtcacgttgacgactgttggtgatgggaattttagtccgcaaactgatttcggaaagatatttacaatcttatacatatttattgggattggattagtgtttggatttattcataagttggcagttaatgtgcaattgccaagtatattatcgagtagaaaaaaagagtaaagcatgtggatgctttactctttttttacattagtttagacaagccttaataataatttattaaaatgaaagtgtattcattcattatattcactgtgtataaagttataatgatatgaacatttgcatattttaatttagtgatagaaatttcgtgaaa

SEQ ID NO: 10075 - protein, 349 aa, Bacillus cereus
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKISCFT

SEQ ID NO: 10076 - DNA, 1430 bp, Trichoderma reesei
  CDS (164)..(1297)
cccaagaaggcctggaacagaagatcaaaagcagagaagagagcgtatataagcatacatacactccctctgctccggtattgtggttgatctccaaacgcgtcatccctcccaaccctcaaacgccttgttcgccggagaccgcgcgcattcacagctcgccatgtcgccttccgcagtcgatgacgctcccaaggccacaggggcagccatctcagtcaagcccaacattggcgtcttcacaaatccaaaacatgacctctggattagcgaagctgaacccagcgccgatgccgtcaaatctggcgctgatctgaagcccggcgaggtgaccattgctgtccgcagcactggtatctgtggttcagatgtccatttctggcacgccggctgcattgggcccatgatcgtcgagggcgaccacatcctcggccacgagtctgccggcgaggtcatcgccgtccacccgactgtcagtagcctccaaatcggcgatcgggttgccatcgagcccaacatcatctgcaacgcatgcgagccctgcctgacaggtcgatacaacggctgcgaaaaggtcgagttcctatccacgccgccagtgcccggactgctgcgacgctacgtcaaccacccagccgtttggtgccacaagattggcaacatgtcgtgggagaacggcgcgctgctggagcccctgagcgtggctctggccggcatgcagagggccaaggttcagctcggtgaccccgtgctggtctgcggcgctggtccgattggattggtgtcaatgctgtgcgctgctgccgccggtgcttgcccgcttgtcatcacagacatttcagagagccgtctggcgtttgcaaaggagatctgcccccgcgtcaccacgcaccgcatcgagattggcaagtcggctgaggaaacggccaaaagcatcgtcagctcttttgggggcgtcgagccagccgtgaccctggagtgcaccggtgtggagagcagcattgcagcggccatctgggccagcaagtttggaggaaaggtctttgtgatcggcgtcggcaagaatgaaatcagcattccctttatgagggccagtgtacgcgaggtcgatatccagctgcagtatcgctacagcaacacctggcctcgtgccatccggctcatcgagagcggtgtcatcgatctatccaaatttgtgacgcatcgcttcccgctggaggatgccgtcaaggcatttgagacgtcagcagatcccaagagcggcgccattaaggtcatgattcagagcctggattgagagtgaggtgctaccaggtagaggtagataatagatagatgatgaagatggaaagactgcgggcgcaagaatcgggcggatagggagttggctgtaatggtttgcaaagcataaaaaaaaaaaaaaaaaaaaa

SEQ ID NO: 10077 - protein, 377 aa, Trichoderma reesei
MSPSAVDDAPKATGAAISVKPNIGVFTNPKHDLWISEAEPSADAVKSGADLKPGEVTIAVRSTGICGSDVHFWHAGCIGPMIVEGDHILGHESAGEVIAVHPTVSSLQIGDRVAIEPNIICNACEPCLTGRYNGCEKVEFLSTPPVPGLLRRYVNHPAVWCHKIGNMSWENGALLEPLSVALAGMQRAKVQLGDPVLVCGAGPIGLVSMLCAAAAGACPLVITDISESRLAFAKEICPRVTTHRIEIGKSAEETAKSIVSSFGGVEPAVTLECTGVESSIAAAIWASKFGGKVFVIGVGKNEISIPFMRASVREVDIQLQYRYSNTWPRAIRLIESGVIDLSKFVTHRFPLEDAVKAFETSADPKSGAIKVMIQSLD

SEQ ID NO: 10078 - DNA, 1074 bp, Saccharomyces cerevisiae
  CDS (1)..(1074)
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggaggtataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 10079 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGRYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 10080 - DNA, 1074 bp, Saccharomyces cerevisiae
  CDS (1)..(1074)
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggagctataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 10081 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGSYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 10082 - DNA, 1032 bp, Bacillus halodurans
  CDS (1)..(1032): transl_table=11
atgaaagcattagtaaaaacacaacatggcacgggccattttgccgtgcaagagaaacccgaaccaactccagggaaacatcaagtaaaaatcaaagtaaagtacacaggcgtttgtggttcagatattcatacctatgagggccattatcctgtagccgctccagtcacacttggtcatgaattttcaggtgagatcgttgaactcggtgaaggtgtaacaggctttaacgttggcgaccgagtaacatcagaaacgacctactcgatttgcggtaaatgctcatattgcacctcgggtgactataatctttgctctcaccggaaaggacttgggaatcagcaggatggcagttttgctaaatacgtaatcgcgcgacaagagagtttgcaccatctccctgctggtgtggatgatcgctcagcagccatgacagagcccctcgcatgtacacatcatgcgattgcaaaaaccagcatcaacaaaggggacttagttgtcgttactggtcctggtccgattggtttgttagcagctcaagttgcaaaaagtcacggtggaacagtgattattacaggtctatccaatgatcaagtccgattaaaaaaagcaaaggaagtcgggatcgattacgccatcgatacacaggaagtggacataaaagagcttgtctccgagcttacagacggctatggtgcagatgtcgttttagaatgttctggcgctgtgccagccgcaaaacaagggattgatcttttacgcaagaaaggacaatatgcccaagtcggcttatttgcccagcccgagatccaatttaattttgagaaaattattcaaaaagagatttccgtcgttgggagtagaagtcaaaaacctgcggattgggagcctgccctctcacttcttaatgaaaaaaaagtaaatgccaaaacactcgtcacccatgaatacacaatttctgaatgggataaggcctatcacgcgattaaaagtggtgaggctatcaaagtattattgacacctattgattag

SEQ ID NO: 10083 - protein, 343 aa, Bacillus halodurans
MKALVKTQHGTGHFAVQEKPEPTPGKHQVKIKVKYTGVCGSDIHTYEGHYPVAAPVTLGHEFSGEIVELGEGVTGFNVGDRVTSETTYSICGKCSYCTSGDYNLCSHRKGLGNQQDGSFAKYVIARQESLHHLPAGVDDRSAAMTEPLACTHHAIAKTSINKGDLVVVTGPGPIGLLAAQVAKSHGGTVIITGLSNDQVRLKKAKEVGIDYAIDTQEVDIKELVSELTDGYGADVVLECSGAVPAAKQGIDLLRKKGQYAQVGLFAQPEIQFNFEKIIQKEISVVGSRSQKPADWEPALSLLNEKKVNAKTLVTHEYTISEWDKAYHAIKSGEAIKVLLTPID

SEQ ID NO: 10084 - DNA, 1200 bp, Bacillus subtilis
  CDS (87)..(1148): transl_table=11
aaaaagcagataaaatgggggcagtaacagagaaaacaaaaatgtatgcacttacattttattttctaaagaaaggaacttgccaaatgactcacacagtacctcaaaacatgaaagcggctgttatgcacaacacaagagagatcaaaattgaaacattgcctgtgcctgatatcaatcatgatgaagtgttgattaaggtgatggctgtcggaatttgcggatctgatctgcattactatacaaatggccgaataggcaactatgttgtggaaaaaccatttatccttgggcatgaatgtgcgggtgaaattgccgctgtcggatcatctgtcgatcaattcaaggtgggagaccgcgtcgctgtagagccgggtgttacgtgcggacgctgtgaggcgtgcaaagaaggacgctataatctttgcccggatgtacagtttttggctacaccgccggtagacggtgcgtttgtccaatatattaaaatgcgtcaggactttgtttttttaatcccagactcactttcttatgaagaagctgctttgatcgagccgttttctgtcggtatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaatcgctgagtgaacagggaggatcttcgtattctccctcttgtttactggaaatgaaaac

SEQ ID NO: 10085 - protein, 353 aa, Bacillus subtilis
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 10086 - DNA, 1083 bp, Schizosaccharomyces pombe
  CDS (1)..(1083)
atggcacctgcagagaaagcattcgtcttgcgcaagaaaatggacactgcgatcgaggatcgtcctggtcagactttgactgatgaccatcaagtcaaagtcgccatcaaggctactggaatttgcggtagcgacgttcattactggaaagaaggcggcattggagacttcattctgaagaaacccatgatcttgggccatgaaagcgcaggtgttgtcgtcgaagttggaaagggtgtctcttccttaaagcccggtgatccagttgcggttgaacccggttgcgtttgtcgtttatgcgattactgtcgttctggtagatacaacttgtgtcctcatatggagtttgctgctactcctccatacgacggaactcttcgcacttactacattaccacagaagacttttgcaccaagctacctaagcagatttcagttgaagagggtgctcttttcgagcccatgagtgttgccgttcacgctatgacccgcggtaacctcaagtgtggttcgcgagtccttgtgatgggatgtggtacagttggcctcttgatgatggctgttgctaaggcttatggggcaattgacattgttgctgttgacgcttccccctctcgtgtagagtttgctcaaaagtatgttggtgcaaagccctttactcccattgctgccaaggagaatgagtcattacccgactacgcgcagagatataagcaagcaatcatcgaaaagtacggtgagtttgattttgctgtagatgccactggcgttggcatctgcattcacactgccgtattggcactcaaacgaggtggtacatttgtgcaagctggaaatggaaaacctgtgattgattttcccattaaccacatcattaattatgaaatcaacgtcttaggtagtttccgttacgcccatggatgctacaaacaatctctatttctggtatcaaacgggctggttgacgttaaaccactcattacccacagattcgctttcaaagatgccctaaaggcttacgaaactgtcgcaagcggcgaagaaggtgtgctgaaagtaatcattggtggtcccgatgcgtag

SEQ ID NO: 10087 - protein, 360 aa, Schizosaccharomyces pombe
MAPAEKAFVLRKKMDTAIEDRPGQTLTDDHQVKVAIKATGICGSDVHYWKEGGIGDFILKKPMILGHESAGVVVEVGKGVSSLKPGDPVAVEPGCVCRLCDYCRSGRYNLCPHMEFAATPPYDGTLRTYYITTEDFCTKLPKQISVEEGALFEPMSVAVHAMTRGNLKCGSRVLVMGCGTVGLLMMAVAKAYGAIDIVAVDASPSRVEFAQKYVGAKPFTPIAAKENESLPDYAQRYKQAIIEKYGEFDFAVDATGVGICIHTAVLALKRGGTFVQAGNGKPVIDFPINHIINYEINVLGSFRYAHGCYKQSLFLVSNGLVDVKPLITHRFAFKDALKAYETVASGEEGVLKVIIGGPDA

SEQ ID NO: 10088 - DNA, 1047 bp, Pyrococcus horikoshii
  CDS (1)..(1047): transl_table=11
atgtcagaaaagatggtagctatcatgaagacaaagcctgggtatggtgctgagcttgttgaggtggacgttccaaagcctggacctggagaagttctcattaaggttcttgcaaccagcatatgtggaactgatcttcatatatacgagtggaatgagtgggcacagagcaggattaagccacctcagataatggggcatgaagttgcgggagaagtcgttgaaatcgggccaggtgtggaaggaattgaagttggtgactacgtttccgttgaaacgcacatagtttgtggcaagtgttacgcctgcagaaggggccagtaccacgtctgccagaataccaagatatttggcgtcgatacagatggcgtattcgcagagtatgccgttgttccagcccaaaatatctggaagaatcctaaatcaattccaccagaatatgcaaccctccaggagcccttgggtaatgctgttgataccgttttggcaggaccaatttctggtaagagcgttttaataaccggagcggggccccttggattattgggaattgcagtggcaaaagcgtctggcgcataccctgtgatagtctcagaacctagtgacttcagaagggagttggccaagaaggtaggtgctgattacgttatcaatccattcgaagaggatgtcgttaaggaggtaatggatatcacagatggaaatggtgttgacgtatttctggaattcagtggagctcctaaggctctagagcagggtcttcaagcagttacacctgctggaagggtatctctcctgggtctatacccaggaaaggttaccattgactttaacaatctaataatcttcaaggcgctaacaatctatggaataactggaaggcacctctgggaaacttggtatacagtttcaaggctccttcagagcggaaagctcaacttagatcctattataactcataaatataagggattcgacaagtacgaggaagcctttgagctaatgagggccggcaaaacgggtaaagttgtttttatgcttaaatga

SEQ ID NO: 10089 - protein, 348 aa, Pyrococcus horikoshii
MSEKMVAIMKTKPGYGAELVEVDVPKPGPGEVLIKVLATSICGTDLHIYEWNEWAQSRIKPPQIMGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELMRAGKTGKVVFMLK

SEQ ID NO: 10090 - DNA, 1053 bp, Pyrococcus kodakaraensis
  CDS (1)..(1053): transl_table=11
atggccgagaaaatgcaggctattatgaagactaagccggcgtacggcgccgaacttgtagaagttgacgttccaaagcctgggccaggagaagtcctcattaaggttctcgcaacgagcatctgcggtacagacctccatatctacgagtggaacgaatgggcgcagagcaggataaagccgccccagataatgggccacgaagtggctggagaggtcgtcgaggtcggtcccggcgttgaggatctccaggttggagattacatcagcgttgaaactcatatcgtctgtggcaagtgctacgcgtgcaagcacaaccgctatcacgtctgccagaacaccaagatattcggagttgatatggacggtgtcttcgcccactacgcgatagttccggccaagaacgcctggaagaacccgaaggacatgccgccagagtacgcagcccttcaggagccgctcggaaacgccgtcgataccgttcttgcaggcccgattgctgggaggagcaccctcataaccggtgctggaccgctcggtcttctcggcatagcagttgccaaggcaagcggggcttatccagtcatcgttagcgagccgagtgagttcagaaggaagctcgccaagaaggtcggtgctgactacgtcgttaaccccttcgaggaagacccagtcaagttcgttatggacataaccgacggagcgggcgttgaagttttccttgagttcagtggtgcacctaaagcccttgagcagggcctcaaggcagtaacacccggaggacgcgtctcacttctcggcctcttcccgagagaggtcacgatagacttcaacaacctcataatcttcaaggcccttgaagtccacggcataaccggaaggcacctctgggaaacctggtacaccgtctcaagcctcatccagagcggcaagctgaacctcgatccgataatcacccacaagtacaagggcttcgacaagttcgaggaagcctttgagcttatgcgcgctggaaagaccggaaaggtcgtcttcttccctcacaagggatga

SEQ ID NO: 10091 - protein, 350 aa, Pyrococcus kodakaraensis
MAEKMQAIMKTKPAYGAELVEVDVPKPGPGEVLIKVLATSICGTDLHIYEWNEWAQSRIKPPQIMGHEVAGEVVEVGPGVEDLQVGDYISVETHIVCGKCYACKHNRYHVCQNTKIFGVDMDGVFAHYAIVPAKNAWKNPKDMPPEYAALQEPLGNAVDTVLAGPIAGRSTLITGAGPLGLLGIAVAKASGAYPVIVSEPSEFRRKLAKKVGADYVVNPFEEDPVKFVMDITDGAGVEVFLEFSGAPKALEQGLKAVTPGGRVSLLGLFPREVTIDFNNLIIFKALEVHGITGRHLWETWYTVSSLIQSGKLNLDPIITHKYKGFDKFEEAFELMRAGKTGKVVFFPHKG

SEQ ID NO: 10092 - DNA, 1035 bp, Rhizobium loti
  CDS (1)..(1035): transl_table=11
atgtcgaacatgatgaaggcgctggtgaaggccaaggccgaaccgggcatctggatggaagaggtgccggtgccggagatcggccccaacgacgtgctgatcaagatcaggaagacggcgatctgcggcaccgacgtgcacatctacaattgggaccagtgggcgcagaagaccgtgccggtgccgatggtgaccggccatgaatttgtcggcacggtggccgattttggcgccgcggtcaccgaatacaaggtcggccagcgcgtctcgggcgagggccacatcgtctgcggccactgccgcaactgccgcgccgggcgagggcatctctgccgcaacacgctcggcgtcggcgtcaaccgccccggcgccttcggcgagtatctggcgatcccgcaacacaatgtcgtgccgatccccgacgatgtgccggacgagatcgccgcgatcttcgatcccctgggcaatgcggtgcatacggcattatccttcgatcttgtcggcgaggacgtgctggtcaccggcgccgggccgatcggcatcatgggcgcgctcgttgcccaatgcgtgggcgcgcgaaaagtcgtcatcaccgatatcaacccggtgcggctggcgctggcgaagaaactcggtgtccagcatgtcgtcgacgcctcgaaggaaaagctgcgcgatgtcatgccagtgctcggcatgaccgagggttttgacgtcggcctcgaaatgtcgggcgccgcccccgccttccgcgacatgatcgacaccatgaacaatggcggcaagatcgccattctgggcatcgcgcccaccggcttcgagatcgactggaacaaggtcatcttcaagatgctgcatctcaaaggcatctacggccgcgaaatgttcgagacctggtacaagatgatcgcgctggtccagggtcctctggatgtttcgggcctgatcacgcaccgcatcggcatcgacgatttccaggaggggttcgatgcgatgcggagcggcagttccggcaaggtggtgatggattggtag

SEQ ID NO: 10093 - protein, 344 aa, Rhizobium loti
MSNMMKALVKAKAEPGIWMEEVPVPEIGPNDVLIKIRKTAICGTDVHIYNWDQWAQKTVPVPMVTGHEFVGTVADFGAAVTEYKVGQRVSGEGHIVCGHCRNCRAGRGHLCRNTLGVGVNRPGAFGEYLAIPQHNVVPIPDDVPDEIAAIFDPLGNAVHTALSFDLVGEDVLVTGAGPIGIMGALVAQCVGARKVVITDINPVRLALAKKLGVQHVVDASKEKLRDVMPVLGMTEGFDVGLEMSGAAPAFRDMIDTMNNGGKIAILGIAPTGFEIDWNKVIFKMLHLKGIYGREMFETWYKMIALVQGPLDVSGLITHRIGIDDFQEGFDAMRSGSSGKVVMDW

SEQ ID NO: 10094 - DNA, 1092 bp, Pichia stipitis
  CDS (1)..(1092)
atgactgctaacccttccttggtgttgaacaagatcgacgacatttcgttcgaaacttacgatgccccagaaatctctgaacctaccgatgtcctcgtccaggtcaagaaaaccggtatctgtggttccgacatccacttctacgcccatggtagaatcggtaacttcgttttgaccaagccaatggtcttgggtcacgaatccgccggtactgttgtccaggttggtaagggtgtcacctctcttaaggttggtgacaacgtcgctatcgaaccaggtattccatccagattctccgacgaatacaagagcggtcactacaacttgtgtcctcacatggccttcgccgctactcctaactccaaggaaggcgaaccaaacccaccaggtaccttatgtaagtacttcaagtcgccagaagacttcttggtcaagttgccagaccacgtcagcttggaactcggtgctcttgttgagccattgtctgttggtgtccacgcctccaagttgggttccgttgctttcggcgactacgttgccgtctttggtgctggtcctgttggtcttttggctgctgctgtcgccaagaccttcggtgctaagggtgtcatcgtcgttgacattttcgacaacaagttgaagatggccaaggacattggtgctgctactcacaccttcaactccaagaccggtggttctgaagaattgatcaaggctttcggtggtaacgtgccaaacgtcgttttggaatgtactggtgctgaaccttgtatcaagttgggtgttgacgccattgccccaggtggtcgtttcgttcaagttggtaacgctgctggtccagtcagcttcccaatcaccgttttcgccatgaaggaattgactttgttcggttctttcagatacggattcaacgactacaagactgctgttggaatctttgacactaactaccaaaacggtagagaaaatgctccaattgactttgaacaattgatcacccacagatacaagttcaaggacgctattgaagcctacgacttggtcagagccggtaagggtgctgtcaagtgtctcattgacggccctgagtaa

SEQ ID NO: 10095 - protein, 363 aa, Pichia stipitis
MTANPSLVLNKIDDISFETYDAPEISEPTDVLVQVKKTGICGSDIHFYAHGRIGNFVLTKPMVLGHESAGTVVQVGKGVTSLKVGDNVAIEPGIPSRFSDEYKSGHYNLCPHMAFAATPNSKEGEPNPPGTLCKYFKSPEDFLVKLPDHVSLELGALVEPLSVGVHASKLGSVAFGDYVAVFGAGPVGLLAAAVAKTFGAKGVIVVDIFDNKLKMAKDIGAATHTFNSKTGGSEELIKAFGGNVPNVVLECTGAEPCIKLGVDAIAPGGRFVQVGNAAGPVSFPITVFAMKELTLFGSFRYGFNDYKTAVGIFDTNYQNGRENAPIDFEQLITHRYKFKDAIEAYDLVRAGKGAVKCLIDGPE

SEQ ID NO: 10096 - DNA, 1053 bp, Agrobacterium tumefaciens
  CDS (1)..(1053): transl_table=11
atgaaggcactggtgctggaagaaaaaggcaaactctcgctcagggattttgacattcccggaggcgccgggtccggtgaactcggaccgaaggatgtgcgcattcgcacccatacggtcggcatctgcggctcggacgttcattattatacccatggcaagatcggccacttcgtcgtcaacgcacccatggtgctcggccatgaagcctccggtacggtgatcgaaaccggttccgacgtcacccatctgaagatcggtgaccgcgtctgcatggagcctggtatccccgatcccacatcgcgggcctcgaaactcggcatctataatgtcgatcccgctgtccgcttctgggcaacaccgccgatccatggctgcctgacgcctgaggtcatccaccccgcggccttcacctacaagctgccggataacgtctcctttgccgaaggggcgatggtcgaacccttcgccatcggcatgcaggcggcactgcgggcgcgcatccagcccggcgatatcgccgtcgtcaccggtgccggtcctatcggcatgatggtggcgcttgccgcattggcgggcggttgcgccaaggtcatcgttgccgatctcgctcagccgaagcttgatatcatcgccgcttatgacggcatcgagaccatcaatatccgcgagcgcaaccttgccgaagcggtttcggccgccacggatggctggggttgcgatatcgtcttcgaatgctcaggtgcggcacccgccatactcggcatggcgaaactggcgcgaccgggcggtgccatcgtgctcgttggcatgccggttgacccggttccggtcgatatcgtcggccttcaggccaaagagctgcgggtggaaacggtattccgttacgccaacgtctatgaccgcgcggtggccctcatcgcctccggcaaggttgatctcaagccattgatttcggccaccattcccttcgaagacagtatcgccggtttcgaccgtgcggtggaagcgcgggaaacggatgtgaagttgcagatcgtcatgccgcaataa

SEQ ID NO: 10097 - protein, 350 aa, Agrobacterium tumefaciens
MKALVLEEKGKLSLRDFDIPGGAGSGELGPKDVRIRTHTVGICGSDVHYYTHGKIGHFVVNAPMVLGHEASGTVIETGSDVTHLKIGDRVCMEPGIPDPTSRASKLGIYNVDPAVRFWATPPIHGCLTPEVIHPAAFTYKLPDNVSFAEGAMVEPFAIGMQAALRARIQPGDIAVVTGAGPIGMMVALAALAGGCAKVIVADLAQPKLDIIAAYDGIETINIRERNLAEAVSAATDGWGCDIVFECSGAAPAILGMAKLARPGGAIVLVGMPVDPVPVDIVGLQAKELRVETVFRYANVYDRAVALIASGKVDLKPLISATIPFEDSIAGFDRAVEARETDVKLQIVMPQ

SEQ ID NO: 10098 - DNA, 1017 bp, Morganella morganii
  CDS (1)..(1017): transl_table=11
atgatcatgaaggcattagtattagagaaagcagggaaaatcgccattcaggattggcagagtaatgaagtgctgggcgacgacgatgttgaaattaaaatccacaccgtcggtatctgcggcagcgacgttcactattatcagcatggccgtatcgggccgttcgtggttgacgagccgatggtgctgggtcacgaagcgtccggtgtgatcacggcagccggtaaaaatgtgaaacacctgaaagtcggcgatcgcgtgtgcatggagccgggtattccggatctgcagtccccgcaatcccgagccggtatctataaccttgatcctgccgttcgtttctgggcaaccccgccaatcgacggctgcctgcgtgaaagcgtaatccaccctgccgccttcacctttaaactgcctgataacgtttcctttgcccagggcgcgatggttgagccgctggcaatcggtatgcagtccgccaccaaagccgggatcaaaccgggcgacatcggtctggttatcggtgccgggacaatcggtatcattacgcagagcgcactggccggcggctgttccgatgtcatcatctgtgatgtgttcgatgaaaaactgaaagtggctgagaaatatcagggtctgcacgcagtaaacagcaaagaccagcaggcactggcagataaagtccgtgaactgaccggcggcgaaggcgtgaacgtcctgtttgagtgcagcggcgcgaaaccggttattgcctccatctctgatcatatcgcccccggcggtaccgcagttctcgtcggcatgcctatcgacccggcaccgctggatatcgtggcggcacaggcgaaagaagtgaccttcaaaactattttgcgctacgccaatatgtatcctcgcaccatccgtctgctgagctccggcaaactgaatgtggcaccgctgctgtccgcaacctacaagttcaaagacagtgtcgaagcctatgagcgtgcagccgaaccggtgcgactgatgtga

SEQ ID NO: 10099 - protein, 338 aa, Morganella morganii
MIMKALVLEKAGKIAIQDWQSNEVLGDDDVEIKIHTVGICGSDVHYYQHGRIGPFVVDEPMVLGHEASGVITAAGKNVKHLKVGDRVCMEPGIPDLQSPQSRAGIYNLDPAVRFWATPPIDGCLRESVIHPAAFTFKLPDNVSFAQGAMVEPLAIGMQSATKAGIKPGDIGLVIGAGTIGIITQSALAGGCSDVIICDVFDEKLKVAEKYQGLHAVNSKDQQALADKVRELTGGEGVNVLFECSGAKPVIASISDHIAPGGTAVLVGMPIDPAPLDIVAAQAKEVTFKTILRYANMYPRTIRLLSSGKLNVAPLLSATYKFKDSVEAYERAAEPVRLM

SEQ ID NO: 10100 - DNA, 1047 bp, Rhizobium loti
  CDS (1)..(1047): transl_table=11
atgcgggcactggtgcttgagaaaaaaggcgaactgtcgttgcgcgagatcgcgctgccgctcgatgtcgggccggatgatgtcaagatcgccatccacacggtcggcgtctgcggcagcgacgtgcactattacacgcatggcgccatcggcagctatgtcgtgcgcgcgccgatggtgctaggccacgaagccgcggggacggtcgtcgagaccggcgccaatgtcgagacgttcaaggccggtgaccgcgtctgcatggagcccggcgtgccgaacctgtcgtcgcgggcgaccaagctcggcatctacaatgtcgaccccgacgtcagcttctgggcgacgccgccggtgcatggcgtgctggcgccctacgcggtgcaccccgccgccttcacctacaaactgccggacaatgtctccttcgccgagggggcgatggtcgagcccttcgccataggcatgcaggcggcaagccgtgcccgcatcgttccgggcgatgtcgccgtcgtcgtcggctgcggcccgatcggcatcatgatcgcgcttgccgccctggccggcggttgttcgaaagtgctgatctccgatttttccgcgcccaagctgaagatcgccgcgcaatatgccggcatcgtgccggtcaatatcggcgagcggtcgctggtcgacgcggtcgcggcggcgaccgacaagtggggcgccgacatcgtcttcgaggccagcggcagcccgaaggctttcgccgatctgttcgatgtcgtgcggccgggcggcgcggtggtgctggtcggcctgccggtggagccggtggccctcaacgtgccggcggcgatctcgaaggaggtgcgcatcgagacggtgttccgctacgccaacattttcgaccgcgccttgcaactgatcgcttccggcaaggtcgacctcaagccgctgatcaccggcacctatgatttcgccgacagcatcaaggcattcgagcgggctgcccaaggcaatccggaagacgtcaagctgcagatcctgctcaccggcgagaagggatga

SEQ ID NO: 10101 - protein, 348 aa, Rhizobium loti
MRALVLEKKGELSLREIALPLDVGPDDVKIAIHTVGVCGSDVHYYTHGAIGSYVVRAPMVLGHEAAGTVVETGANVETFKAGDRVCMEPGVPNLSSRATKLGIYNVDPDVSFWATPPVHGVLAPYAVHPAAFTYKLPDNVSFAEGAMVEPFAIGMQAASRARIVPGDVAVVVGCGPIGIMIALAALAGGCSKVLISDFSAPKLKIAAQYAGIVPVNIGERSLVDAVAAATDKWGADIVFEASGSPKAFADLFDVVRPGGAVVLVGLPVEPVALNVPAAISKEVRIETVFRYANIFDRALQLIASGKVDLKPLITGTYDFADSIKAFERAAQGNPEDVKLQILLTGEKG

SEQ ID NO: 10102 - DNA, 1044 bp, Escherichia coli
  CDS (1)..(1044): transl_table=11
atgaaaaattcaaaagcaatattgcaggtgccgggcacaatgaaaattatttcagcagaaataccagtgcctaaagaagatgaagttttgattaaagtagaatatgtcggtatttgtggttcagatgtacatggttttgaatcaggcccgtttattccgcctaaagacccaaatcaagaaattggcctgggtcatgaatgcgccgggacggttgtggctgtgggaagccgcgtgcgcaaatttaaaccgggggatcgggtaaatatcgaacctggcgttccttgcggtcactgtcgttactgtctggaaggcaaatataacatctgcccggacgttgattttatggcgacacaacccaactaccgcggcgcattaacgcactatctgtgtcatccggagagctttacttacaaactgcccgacaatatggacacgatggaaggggcgctggtggagcctgccgcagtcgggatgcatgccgcgatgctggcagatgttaaaccgggtaagaagataattattctgggagcaggttgtattggtttgatgacgttgcaagcgtgcaaatgcctgggagcaacggaaattgccgtcgttgatgtgctggaaaaacgtctggcaatggcggaacagcttggtgcgacagtggttattaacggcgcaaaagaagacactattgcacgctgtcagcaatttaccgaagacatgggcgcagatattgttttcgaaacagcgggttctgcggtcaccgttaaacaggcaccttatctggtaatgcgcggcggtaaaattatgattgttggtactgtacccggcgattcggcaatcaatttcctcaaaatcaatcgcgaagtcactatccagacggtattccgctatgccaatcgttatccggtcacgattgaagctatttcttcagggcgattcgatgtgaaatcgatggtgacgcatatttacgattatcgggatgtacaacaggcatttgaagagtcagttaacaacaaacgcgacattattaaaggcgttattaaaattagcgattaa

SEQ ID NO: 10103 - protein, 347 aa, Escherichia coli
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 10104 - DNA, 1146 bp, Oryza sativa
  CDS (1)..(1146)
atggcttcctcgacccagggccaggtcatcacctgcaaagcggcggtggcatgggaggccaacaggccgatgacgatcgaggacgtgcaggtggcgccgccgcaggccggcgaggtccgtgtcaagatcctcttcaccgcgctctgccacaccgaccactacacctggagcggcaaggatcctgagggtctatttccttgcattcttggtcatgaagctgctggaattgttgaaagtgttggggaaggagtaactgaggtgcagcctggggaccatgtcattccttgttaccaagcagaatgcagagaatgcaagttttgcaagagtggaaagaccaacctctgtggcaaagttcgtgctgccacaggggtcggtgtcatgatgaatgatcgcaagagccgtttctcaataaatggaaaacccatttatcatttcatgggaacatctacattcagccagtatactgttgtgcacgatgtcagtgtcgcaaagataaacccacaggcacctctagacaaagtttgcctgcttggctgcggtgtttctactggcctcggagcagtatggaataccgcaaaggttgaagcaggttccatcgttgctatttttggacttggcacagttggacttgcagttgctgagggggcaaaatcagctggtgcttctcggattattggcatcgacattgatagcaaaaagtttgatgtcgcaaagaactttggggttacagaatttgtgaacccaaaggaccatgacaaaccaatccaacaggtcatagttgaccttacagacggtggtgtggactacagctttgaatgcattggaaatgtttctgttatgaggtctgcattggagtgctgccacaagggctggggaacctctgtcatcgttggtgtagctgcttctgggcaagaaatctctacacgaccattccagctcgtcactggccgtgtctggaagggaacagctttcggcggtttcaagagccgaagccaagttccatggctcgttgagaagtacttgaacaaggaaatcaaggtggacgagtacgttactcacagcatgaacctgactgacatcaacaaggcgtttgacctgctgcatgaaggtggctgcctgcggtgtgttctggcaactgataaatga

SEQ ID NO: 10105 - protein, 381 aa, Oryza sativa
MASSTQGQVITCKAAVAWEANRPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 10106 - DNA, 1077 bp, Oryza sativa
  CDS (1)..(1077)
atgacgatcgaggacgtgcaggtggcgccgccgcaggccggcgaggtccgtgtcaagatcctcttcaccgcgctctgccacaccgaccactacacctggagcggcaaggatcctgagggtctatttccttgcattcttggtcatgaagctgctggaattgttgaaagtgttggggaaggagtaactgaggtgcagcctggggaccatgtcattccttgttaccaagcagaatgcagagaatgcaagttttgcaagagtggaaagaccaacctctgtggcaaagttcgtgctgccacaggggtcggtgtcatgatgaatgatcgcaagagccgtttctcaataaatggaaaacccatttatcatttcatgggaacatctacattcagccagtatactgttgtgcacgatgtcagtgtcgcaaagataaacccacaggcacctctagacaaagtttgcctgcttggctgcggtgtttctactggcctcggagcagtatggaataccgcaaaggttgaagcaggttccatcgttgctatttttggacttggcacagttggacttgcagttgctgagggggcaaaatcagctggtgcttctcggattattggcatcgacattgatagcaaaaagtttgatgtcgcaaagaactttggggttacagaatttgtgaacccaaaggaccatgacaaaccaatccaacaggtcatagttgaccttacagacggtggtgtggactacagctttgaatgcattggaaatgtttctgttatgaggtctgcattggagtgctgccacaagggctggggaacctctgtcatcgttggtgtagctgcttctgggcaagaaatctctacacgaccattccagctcgtcactggccgtgtctggaagggaacagctttcggcggtttcaagagccgaagccaagttccatggctcgttgagaagtacttgaacaaggaaatcaaggtggacgagtacgttactcacagcatgaacctgactgacatcaacaaggcgtttgacctgctgcatgaaggtggctgcctgcggtgtgttctggcaactgataaatga

SEQ ID NO: 10107 - protein, 358 aa, Oryza sativa
MTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 10108 - DNA, 1146 bp, Oryza sativa
  CDS (1)..(1146)
atggcgggtcagatcccccaacccatccgttgcaaagcggccgtgtgcagggccgctggcgagccgctggccgtcgaggagatcgtcgtggacccgcccaaggcgcacgaggtccggatcaagatcgtctgcacctcgctctgccacagcgacgtcacgttctggcgtatgcaggatttccccggcgttttcccgaggatttttgggcacgaagccttcggggtggtggagagcgtaggggagcatgtggaagggttcgccgccggcgacccggtggtgcccacgttcctgggccagtgcaccgagtgcgtggactgcgcctcggagcggagcaacgtgtgctccacgtaccggttcgcggtgcgccccgggatgccgcgcgacggcaccgcccgcttccgcgaccgccacggcgccccgatccaccacttcctcggcgtctccagcttcagcgagtacaccgtcgtggacgccaaccaggtcgtccgcgtcgaccccgccgtgccgcccgccacggcctccctcctcagctgcggcgccaccaccggggtcggagcagcgtggaagctggctaaagtcgagccggggtcttcggttgctatctttggcctcggcgccgtaggattagcggtagctgaaggggccaggatttgcggtgcgtcaacgatcatcggcgtggatttgaaccctgagaaacatgaacttggaaagaagttcggtgtgacgcacttcatcaatccacaagaacttggggacaaacctgtcagccaagcgatcatcgagatgactgacggtggcgcggactactgcttcgagtgcatcgggctggcgtcggtgatgagcgatgcatttcggagctcccgagagggatggggcaagacgatcattcttggcgtcgaaatgcacggtgcccctttgtccattccttcgttggagatcctcaacggcaaatgcgtaatgggatcactcttcggaggggtgaaacccaagcaggacattcccatcctggccgacaagtatctgaacaaggagctggagttggacaagttcataactcacgaggttcccctgaaggacatcaacacggcatttgaccttctgttgcaggggaagagtctcagatgcaccatttggatggacaagtga

SEQ ID NO: 10109 - protein, 381 aa, Oryza sativa
MAGQIPQPIRCKAAVCRAAGEPLAVEEIVVDPPKAHEVRIKIVCTSLCHSDVTFWRMQDFPGVFPRIFGHEAFGVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGASTIIGVDLNPEKHELGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 10110 - DNA, 1173 bp, Oryza sativa
  CDS (1)..(1173)
atggagcagatgaacactgctgctgcaaagtccatcaggtgcagagcggcggtgagcagggtggccgggcagccgctggagatggaggaggtggaggtggcgccgccgcgggcgcacgaggtccggatcaagatcctctgcacatccatctgccacacggacatcaccttctggcgtatggaaggcaatcatccgtctatctttggccatgaagcagtcggtgtggtggagagcgtgggggagcacgtgcaggaggtggcggtgggtgacatggtggtgccggtgttcgccgcgcagtgcagtgagtgccctgactgcctctccgaccgcagcaacctctgctccaaactgcccaacgtcgccggcctcatgcctcgcgaccgcacgacgcgcttctcctccgtctccaccggcgagcccatccgccacttcctctccgtctccagcttcgccgagtacaccgtcgttgacatcacccacattgtcaagctcgatgttggattcccaccggcgatggcatgcctcctcagttgtggcatttccaccggtgttggtgcggcatggaaggtggcagcagtggagcccggctcgagtgtcgccgtgttcggcctgggtgccgttgggttagcggttgctcaaggggcgaggatgcgtggggctaagaggattattggggtggacctgaacccggacaaattcgacgttggtaagaggctgggcatgaccgacttcatcaacccgaacgataccggcgggaagaccgtgagcgaggtcatcaaggagatgaccgggggcggcggcgccgactactgcttcgagtgcatcggctcgacttcggtcatggcggaagccttccaaagcactcgaaatgggtgggggaagacgatcctgctcggcgtctccggcaacaaggcgccgatcagcatcccgtcgcacgagatcctccggggaagatcggtcatcgggtcgctcttcggcggcatcaagcccaagaacgacatcccgatgctggctcagaagtacctggacaaggagctggagctggaggagttcatcacgcacgagatggggttcgaggagatcaacagggcgttcgagctgctcacgcaggggaagagcatccgctgcatcatctggatggacggcgccaaggtgatcgacaacggcgagtga

SEQ ID NO: 10111 - protein, 390 aa, Oryza sativa
MEQMNTAAAKSIRCRAAVSRVAGQPLEMEEVEVAPPRAHEVRIKILCTSICHTDITFWRMEGNHPSIFGHEAVGVVESVGEHVQEVAVGDMVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGE

SEQ ID NO: 10112 - DNA, 1269 bp, Oryza sativa
  CDS (1)..(1269)
atgtctatcacctccgcttcccgccgcgccggcgccgccgcgctccccatcctccgacgaatcggcggcgcgttccgccgccccttctcgtcggagccggacccggcatcctccccggggtaccacgtcgccggcgggcccagcttcatgcgcggcgcggtgttctgggagcccggccgccctctcaccctcgaggacttccgcatgccgcgccccaaggccggcgagctcctcatcaagaccaaagcttgtggagtttgccactccgatctccatgttctcaagggtgagctcccattctccagcccctgcgttgttgggcatgagatcactggggaggttgttgaccatggtactcacacccctgctgagatcatcaacaggttcccagttggcagtcatgttgtgggtgccttcataatgccctgtgggaattgcttctactgtgttaagggccaagaagatctgtgtgagtctttctttgcatacaaccgtgctaaaggaacgctatacgatggtcaaacccgattattccttcgtagcaatggaaagccagtgtacatgtatagtatgggtgggcttgcagaatattgcgttgtgccagccaacgcactagcagttcttcccaactctttgccatacacagagtcggcgattctaggatgtgccgtgttcactgcatacggcgccctgaggcatgctgctgaaatgcgtgctggggattcagtagctgtgattggagtcggaggggttgggtcaagctgtttacagatagccaaagcctttggagcttccgaagtcattgcagtggatgttcttgatgagaaactccagaatgctagaacacttggagcaacccatactgtaaatgctgcaaaagaagatgcagttgaaaagattaaggaaattactgatgggaggggtgtggatgtagctgtggaagcacttggtaaggcattgacattttctcagtgcgccaaaagtgtacgagatggaggcaaagctgttatgattggccttgctgccacaaatgtgatgggggaggtggatataacccgtcttgttcgccgacaggtgaagatcattgggtcgtatggtgcaagggccaggcaagatcttcctcagatagtcaagcttgcagagagtggggccttcaatcttaagaacaccatatcaaggaaatgcaagtttgaagaggcgaacagcgcctacgaggatcttgaccgtggcaagatcgttgggcgagccgtagttgagatcatgtcgtag

SEQ ID NO: 10113 - protein, 422 aa, Oryza sativa
MSITSASRRAGAAALPILRRIGGAFRRPFSSEPDPASSPGYHVAGGPSFMRGAVFWEPGRPLTLEDFRMPRPKAGELLIKTKACGVCHSDLHVLKGELPFSSPCVVGHEITGEVVDHGTHTPAEIINRFPVGSHVVGAFIMPCGNCFYCVKGQEDLCESFFAYNRAKGTLYDGQTRLFLRSNGKPVYMYSMGGLAEYCVVPANALAVLPNSLPYTESAILGCAVFTAYGALRHAAEMRAGDSVAVIGVGGVGSSCLQIAKAFGASEVIAVDVLDEKLQNARTLGATHTVNAAKEDAVEKIKEITDGRGVDVAVEALGKALTFSQCAKSVRDGGKAVMIGLAATNVMGEVDITRLVRRQVKIIGSYGARARQDLPQIVKLAESGAFNLKNTISRKCKFEEANSAYEDLDRGKIVGRAVVEIMS

SEQ ID NO: 10114 - DNA, 1185 bp, Oryza sativa
  CDS (1)..(1185)
atggggaagggagggaaaggagccgaggcggcggcggcggcggtggccggagccggtgaggaggagaacatggcggcgtggctggtggcgaagaacaccctcaagatcatgcccttcaagctcccgccagttgggccttatgatgtccgtgtccggatgaaggcagtgggcatctgcggcagcgacgtgcactacctcagggtgatctgttgttcgctcacagaaagaatgaaagataatgtggcttatatatgtttgttgtttgagtgcgtgcaggagatgcgcattgcgcatttcgtggtgaaggagccgatggtgatcgggcacgagtgcgccggcgtgatagaggaggtcggcagcggcgtgacgcacctcgccgtcggcgaccgcgtggcgctcgagcccggcatcagctgctggcgctgcaggcactgcaagggcggccgctacaacctctgcgaggacatgaagttcttcgccacccctcccgtccacggatccctcgccaaccagatcgtgcaccctggtgatctgtgcttcaagctgccggagaacgtgagcctggaggaaggcgccatgtgcgagccgctgagcgtgggcgtgcacgcgtgccgccgcgccgacgtcgggccggagacgggggtgctgatcatgggcgcggggccgatcggcctggtcaccctgctggcggcgcgcgcgttcggcgcgacgcgcgtcgtgatcgtggacgtggacgaacaccgcctctccgtggcccgatccctcggcgccgacgccgccgtgagggtgtcggcgcgcgcggaggacgtcggcgaggaggtggaacggatcagggcggcgatgggcggggacatcgacgtgagcctggactgcgccgggttcagcaagacggtggcgacggcgctggaggcgacgcgcggcggcgggaaggtgtgcctcgtcgggatggggcacaacgagatgacggtgccgctgacgtcggcggcgatcagggaggtggacgtggtggggatattccggtacaaggacacgtggccgctctgcatcgagttcctccgcagcggcaagatcgacgtgaagccgctcatcacccaccgattcgggttctcgcaggaggacgtggaggaggcgttcgaggtcagcgcccgtggccgcgacgccatcaaggtcatgttcaacctctag

SEQ ID NO: 10115 - protein, 394 aa, Oryza sativa
MGKGGKGAEAAAAAVAGAGEEENMAAWLVAKNTLKIMPFKLPPVGPYDVRVRMKAVGICGSDVHYLRVICCSLTERMKDNVAYICLLFECVQEMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 10116 - DNA, 1140 bp, Oryza sativa
  CDS (1)..(1140)
atggcgacagccgggaaggtgatcaagtgcaaagcggcggtggcatgggaggccgggaagccgctgtcgatcgaggaggtggaggttgcgccgccgcaggccatggaggtccgcgtcaagatcctctacaccgccctctgccacaccgacgtctacttctgggaggccaaggggcaaacacctgttttccctaggatcttgggccatgaagctggaggcattgtggagagtgtgggagagggtgtgaccgaactcgcgccgggcgaccatgtcctcccggtgttcaccggcgagtgcaaggagtgtgatcactgcaaatcggaggagagcaacatgtgtgacctcctcaggatcaacgtcgaccgcggcgtcatgatcggcgacggcaagtcccgattcaccatcaaggggaagcccatcttccactttgttggcacatccaccttcagcgagtacaccgtcatccatgtcggctgcctcgcgaagatcaacccggaggcgcctctcgacaaggtctgcattctcagctgcggtttctctaccggttttggtgcaacagtgaatgtcgcgaaaccgaaaaagggccagaccgtggctattttcggtcttggagctgttggtcttgctgctatggaaggtgccaggctgtctggagcatcgaggatcattggtgtggacctgaaccctgcgaaattcgaacaagctaagaagtttggctgcactgacttcgtaaaccccaaggaccacagcaagccagtgcacgaggtgctgattgagatgaccaacggtggactcgacagggccgttgaatgcacgggcaacatcaacgccatgatatcctgcttcgaatgtgtccatgatggatggggcgttgcggtgctggtcggcgtgccgaccaaggatgatgtgttcaagacccacccgatgaacttcctcaacgagaagacgctcaaggggacgttcttcggtaactacaagccgcgcaccgacctgcccaacgtcgtcgagctgtacatgaagaaggagctggagctggagaagttcatcacgcacagcgtgccgttctcggagatcaacacggcgttcgatctcatgctcaagggggagagtctccgctgcgtcatgaggatggatgagtag

SEQ ID NO: 10117 - protein, 379 aa, Oryza sativa
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 10118 - DNA, 1113 bp, Zea mays
  CDS (1)..(1113)
atggcaccggtggaggcggagcagcaccggcggagggcgttggcgctcgcggcgcacgacgcctccggcgccgtctcccccatccgcatctcgcgaagggacactggagatgacgatgttgccatacagatactgtactgcgggatatgccactctgacctgcacaccatcaagaacgagtggaagaacgccaactaccctgttgtccctgggcacgagatcgccgggctgatcaccgaggttggcaagaacgtgaagaggttcaacgtcggagacaaggttggcgtcgggtgcatggtcaacacatgccagtcctgcgagagctgcgagggagggcacgagaactactgctccaagatcatcttcacctacaactcccacgacagggacggcaccgtcacctacggtggctactctgacatggttgtcgtcaacgagcgcttcgtcatccggttccctgatggcatgcccctcgacagaggcgcgccgctgctctgtgcagggataaccgtgtacaaccccatgaagcaccacgggctaaacgaggcaggcaagcacatcggcgtggttggactcggggggcttgggcacgtcgccgtgaagttcgcgaaggcgttcgggatgagggtgaccgtgatcagcacgtccccggggaagagggaggaagctatggagacgcttggtgcagacgcctttgttgtcagcggtgatgctaaccagatgaaggctgcgaagggcacaatggatggcattatgaacacggcctctgcaagcatgtccatgtacgcttaccttgctctcctcaagccccagggcaagatgatcctgcttggcctgcctgagaagcctctgcagatctctgccttctctttggttactgggggcaagactctggccgggagctgcatggggagcatcagggacacgcaggagatgatggacttcgcagccaagcacgggttggcagcggacatcgaactgatcggcaccgaagaagttaatgaggccatggaacgcctcgccaagggcgaggtcaggtaccgcttcgtcatcgacatcggcaacaccctcaacgcggcatcactagggagctcgccggtcccagctctgtag

SEQ ID NO: 10119 - protein, 370 aa, Zea mays
MAPVEAEQHRRRALALAAHDASGAVSPIRISRRDTGDDDVAIQILYCGICHSDLHTIKNEWKNANYPVVPGHEIAGLITEVGKNVKRFNVGDKVGVGCMVNTCQSCESCEGGHENYCSKIIFTYNSHDRDGTVTYGGYSDMVVVNERFVIRFPDGMPLDRGAPLLCAGITVYNPMKHHGLNEAGKHIGVVGLGGLGHVAVKFAKAFGMRVTVISTSPGKREEAMETLGADAFVVSGDANQMKAAKGTMDGIMNTASASMSMYAYLALLKPQGKMILLGLPEKPLQISAFSLVTGGKTLAGSCMGSIRDTQEMMDFAAKHGLAADIELIGTEEVNEAMERLAKGEVRYRFVIDIGNTLNAASLGSSPVPAL

SEQ ID NO: 10120 - DNA, 1101 bp, Linum usitatissimum
  CDS (1)..(1101)
atggcgaataatgatggtgaaatcgcagtgggaaagagagatggaggagaggaagagaacatggctgcttggcttctgggtatccaaaccctcaagattcagccttaccaactccctactcttggtcctcatgatgtcaaggtccggattaaggctctaggcatttgcggaagtgatgttcatcatttcaagactatgagatgtgctaatttcatagtgaagaaaccaatggtgatcggccatgaatgtgctggcatcattgaagagattggcagtgaagtcaagagcctctcaacaggtgaccgtgtagccttagagcctggcatcagttgctcaaggtgtaacctttgcaagaatggccgctacaacttgtgctccgaaatgcgattcttcggctctccacctaccaacggctctcttgccaacaaggtggtgcatcccgcaagcctatgctacaagctccccgagaacgtgagcttggaggaaggagcgatgtgcgagcccctaagtgtaggggtccacgcttgtcgtagagcacaggttggccccgagactagtgtcctgatcttgggagctggaccaatcgggctcatcaccttgctggttgctcgagcattcggatcccctcgcgttgtgatgaccgatgttgatgagacccgtctatccattgctaagagcctcggtgctgatgagactatccaagtctcgacagatccgaaggatgttagtgaggaagtgatgaaagtgcagaatgctatgggatcagggattgatgttaccttggactgtgttggatataacaagaccatgactactgctctgaatgccacacgttctggtggcaaagtttgcctaataggattagctcttagtgagatgactgtccctcttactcctgctgctgccagggaagtagatgtgattggcatatttcggtaccggaacacatggccactctgccttgatttcttgaagactggcaagatttatgtgaagccattgataactcacaggtttaagttcacacaggaggatattgactcggcgttcgagaccagtgctcgtggtgggaacgcgatcaaggttatgtttaacctgtaa

SEQ ID NO: 10121 - protein, 366 aa, Linum usitatissimum
MANNDGEIAVGKRDGGEEENMAAWLLGIQTLKIQPYQLPTLGPHDVKVRIKALGICGSDVHHFKTMRCANFIVKKPMVIGHECAGIIEEIGSEVKSLSTGDRVALEPGISCSRCNLCKNGRYNLCSEMRFFGSPPTNGSLANKVVHPASLCYKLPENVSLEEGAMCEPLSVGVHACRRAQVGPETSVLILGAGPIGLITLLVARAFGSPRVVMTDVDETRLSIAKSLGADETIQVSTDPKDVSEEVMKVQNAMGSGIDVTLDCVGYNKTMTTALNATRSGGKVCLIGLALSEMTVPLTPAAAREVDVIGIFRYRNTWPLCLDFLKTGKIYVKPLITHRFKFTQEDIDSAFETSARGGNAIKVMFNL

SEQ ID NO: 10122 - DNA, 1140 bp, Zea mays
  CDS (1)..(1140)
atggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccatgaggctggaggtatcatagagagtgttggagagggtgtgactgacgtagctccgggcgaccatgtccttcctgtgttcactggggagtgcaaggagtgcgctcactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacactgtcatgcatgtcggttgtgttgcaaagatcaatcctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaggaccacaacaagccagtgcaggaggtacttgctgagatgaccaacggaggggtcgaccgcagcgtggaatgcactggcaacatcaatgctatgatccaagctttcgaatgtgttcatgatggctggggtgttgccgtgctggtgggtgtgccgcataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactag

SEQ ID NO: 10123 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 10124 - DNA, 1146 bp, Zea mays
  CDS (1)..(1146)
atggcttcccccacccagggccaggtcatcacctgcaaagcggcggtggcgtacgagccgaacaagccactcgtgatcgaggacgtgcaggtggcgccgccgcaggccggcgaggtccgcgtcaagatcctattcaccgcgctctgccacaccgaccactacacctggagcggcaaggatcctgagggtcttttcccttgcattcttggccacgaagctgccggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccggagtgccacaggcgtaggtgtcatgatgaatgatatgaagagcaggttctctgtaaatggaaagcccatttaccatttcatggggacatcaacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcggttatgagggctgcactggaatgctgccacaagggctggggaacctccgtcatcgtcggcgtcgccgcctctggccaggagatcgccacacgaccattccagctcgtgactgggcgtgtctggaagggaaccgctttcggtggcttcaagagccggacccaggtcccatggcttgttgacaagtacatgaaaaaggaaattaaggtggacgagtacattacgcacaacatgaacctggctgacatcaacgacgccttccacctgctgcacgaaggtggctgtctgcgttgtgtgctggcaatgcagatttga

SEQ ID NO: 10125 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 10126 - DNA, 1140 bp, Brassica napus
  CDS (1)..(1140)
atggcgactcaaggtcaggttatcacatgcaaagctgcggtggcttacgagccgaacaaacctctggtcatcgaagacgtgcaagtggctccccctcaggccggtgaggttcgcatcaagatcctcttcaccgctctctgtcacaccgacgcctacacctggagcggcaaggatcctgaaggtctcttcccttgtatcctcggtcacgaggctgctgggattgttgagagtgttggtgaaggtgtaactgaggttcaacctggggaccatgttatcccttgttaccaagctgagtgccgtgaatgcaagttctgcaaatctggcaagactaacctctgcggcaaggttcgatccgctactggtgttggggtcatgatgaacgaccgtaagagccgcttctccgttaatgggaaacccatttatcacttcatgggtacctccacgtttagtcagtacactgttgttcatgatgttagtgtcgccaagatcgatcctcaggctcctttggagaaagtctgccttcttggatgtggtgttcccactggccttggagcagtttggaacactgcaaaagtagagcctgggtcaaatgttgccatttttggtcttgggaccgtggggcttgctgttgctgagggtgcgaaaacagctggtgctacaaggatcattggcattgatatcgacagcaagaagtatgaaactgcaaagaagtttggtgttaatgagtttgtgaacccaaaggaccaccaaaagccaattcaggaagtgattgtcgacctcactgatggaggtgttgactacagctttgagtgcatcgggaatgtctccgtgatgagagccgcattggagtgctgtcacaagggatggggaacttcagttatagtgggtgttgcagcatcaggacaagagatatcaacacgaccgttccaacttgtgactggccgtgtgtggaaaggaacagcatttggtggtttcaagagtcgaacccaagtgccttggcttgtagagaagtatatgaacaaggagatcaaagtggatgagtacataacgcacaacatgacattgggagagatcaacaaggcttttgatctgctgcatgaaggcacttgtcttcgttgtgtcctcagtaccagcgaatga

SEQ ID NO: 10127 - protein, 379 aa, Brassica napus
MATQGQVITCKAAVAYEPNKPLVIEDVQVAPPQAGEVRIKILFTALCHTDAYTWSGKDPEGLFPCILGHEAAGIVESVGEGVTEVQPGDHVIPCYQAECRECKFCKSGKTNLCGKVRSATGVGVMMNDRKSRFSVNGKPIYHFMGTSTFSQYTVVHDVSVAKIDPQAPLEKVCLLGCGVPTGLGAVWNTAKVEPGSNVAIFGLGTVGLAVAEGAKTAGATRIIGIDIDSKKYETAKKFGVNEFVNPKDHQKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNMTLGEINKAFDLLHEGTCLRCVLSTSE

SEQ ID NO: 10128 - DNA, 1140 bp, Brassica napus
  CDS (1)..(1140)
atgtctacgaccggacaaatcattcgatgcaaagctgccgtttgctgggaagctggaaagccactagtgatggaggaagtggaggttgctccaccgcagaagcatgaagtccgtatcaagattctcttcacttctctctgtcacaccgatgtttacttctgggaagctaagggacaaacgcctttgtttccacgtatcttcggacatgaagctggaggtattgtggagagtgttggagaaggagtgactgatctccaaccaggagaccacgtcctccccatcttcaccggagaatgcggagactgccctcactgccactctgaggagtccaacatgtgcgaccttctcaggatcaacaccgagagaggagggatgatacacgacggcgaatcgagattctccatcaacggcaaaccgatctaccatttccttgggacctcaacgttcagcgagtacaccgtggttcactctggtcaagtcgctaagatcaaccctgaagctcctcttgacaaagtctgcatcgtcagctgtggcttgtccactgggctgggagctactttgaatgttgctaaacccaagaaaggtcagagcgttgctatctttggtcttggtgctgttgggttggctgctgcggaaggtgctaggattgctggtgctggtaggatcattggtgttgatcttaaccccaagagattcgaggaagctaagaagttcggtgtgacggagtttgtgaaccctaaggaacatgacaagccagttcagcaagtcatcgctgagatgactaacggcggtgtggacaggagtgtggagtgcactggaagcattcaagccatgattcaagcctttgaatgtgttcacgatggctggggtgttgcggtgctggttggtgtgccgagcaaagacgacgctttcaagactcatccgatgaacctcctgaacgagaggacactcaagggtactttctttggcaactacaaacccaaaaccgacattcccggggtggtcgaaaagtacatgaacaaggagctggagcttgagaagttcatcactcacacagtgccattctctgagatcaacaaggcctttgattacatgttgaagggagagagtatccgttgcatcatcaccatgggtgcttga

SEQ ID NO: 10129 - protein, 379 aa, Brassica napus
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 10130 - DNA, 1140 bp, Brassica napus
  CDS (1)..(1140)
atggccactcaaggtcaggttatcacttgcaaagctgcggtggcttacgagcccaacaaacctctcgtcatcgaagatgtgcaagtcgctccccctcaggccggtgaggttcggatcaagatcctattcacggctctctgtcacaccgacgcctacacttggagcggcaaggatcctgaaggtctcttcccatgtatcctcggtcatgaagctgctggggttgttgagagtgttggtgaaggtgtaactgaagttcagcctggagaccatgttatcccatgttaccaagctgagtgccgtgaatgcaaattctgcaaatccggcaagactaacctctgcggcaaggttcggtccgctactggtgttggggtcatgatgaacgaccgtaagagccggttctcggttaatgggaaacccatttatcacttcatgggtacctccacgtttagtcagtacactgttgttcatgacgtcagtgtcgccaagattgatcctaaggctcctttggagaaagtctgccttcttggatgtggtgttcccactggccttggagctgtttggaacactgcaaaagtagaaccagggtctaatgttgccatctttggtcttgggactgtgggacttgctgttgctgagggtgcgaaaacagctggtgctacaaggatcattggcattgatatcgacagcaagaagtatgaaactgcaaagaagtttggtgttaatgagtttgtgaacccaaaggaccaccaaaagccaattcaggaagtgattgtcgacctcactgatggcggtgttgactacagctttgagtgtattgggaatgtctccgtgatgagagccgcattggagtgctgtcacaagggatggggaacttcagttatagtcggtgttgcagcatcaggacaagagatatcaacccgaccgttccaactcgtgactggccgtgtgtggaaaggaacagcttttggtggtttcaagagtcgaacccaagtgccttggcttgtagagaagtatatgaacaaggagatcaaagtggatgagtacataacgcacaacatgaccttgggagagatcaacaaggcttttgacctgttgcatgaaggcacttgccttcgttgtgtcctcagtaccagcgaatga

SEQ ID NO: 10131 - protein, 379 aa, Brassica napus
MATQGQVITCKAAVAYEPNKPLVIEDVQVAPPQAGEVRIKILFTALCHTDAYTWSGKDPEGLFPCILGHEAAGVVESVGEGVTEVQPGDHVIPCYQAECRECKFCKSGKTNLCGKVRSATGVGVMMNDRKSRFSVNGKPIYHFMGTSTFSQYTVVHDVSVAKIDPKAPLEKVCLLGCGVPTGLGAVWNTAKVEPGSNVAIFGLGTVGLAVAEGAKTAGATRIIGIDIDSKKYETAKKFGVNEFVNPKDHQKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNMTLGEINKAFDLLHEGTCLRCVLSTSE

SEQ ID NO: 10132 - DNA, 1140 bp, Brassica napus
  CDS (1)..(1140)
atgtctacgaccggacaaatcattcgatgcaaagctgccgtttgctgggaagctggaaagccactagtgatggaggaagtggaggttgctccaccgcagaagcatgaagtccgtatcaagattctcttcacttctctctgtcacaccgatgtttacttctgggaagctaagggacaaacgcctttgtttccacgtatcttcggacatgaagctggagggattgtggagagtgttggagaaggagtgactgatctccaaccaggagaccacgtcctccccatcttcaccggagaatgcggagactgccctcactgccactctgaggagtccaacatgtgcgaccttctcaggatcaacaccgagagaggagggatgatacacgacggcgaatcgagattctccatcaacggcaaaccgatctaccatttccttgggacctcaacgttcagcgagtacaccgtggttcactctggtcaagtcgctaagatcaaccctgaagctcctcttgacaaagtctgcatcgtcagctgtggcttgtccactgggctgggagctactttgaatgttgctaagcccaagaaaggtcagagtgttgctatcttcggtcttggcgctgttggattggctgctgcggaaggtgctaggattgctggtgctggtaggatcattggtgttgatcttaaccccaagagattcgaggaagctaagaagttcggtgtgacggagtttgtgaaccctaaggaacatgacaagccagttcagcaagtcatcgctgagatgactaacggcggtgtggacaggagtgtggagtgcactggaagcattcaagccatgattcaagcctttgaatgtgttcacgatggctggggtgttgcggtgctggttggtgtgccgagcaaagacgatgctttcaagactcatccgatgaacctcctgaacgagaggacactcaagggtactttctttggcaactacaaacccaaaaccgacatccccggggtggtcgaaaagtacatgaacaaggagctggagcttgagaagttcattactcacacagtgccattctctgagatcaacaaggcctttgattacatgttgaagggagagggtatccgttgcatcatcaccatgggtgcttga

SEQ ID NO: 10133 - protein, 379 aa, Brassica napus
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGEGIRCIITMGA

SEQ ID NO: 10134 - DNA, 1086 bp, Zea mays
  CDS (1)..(1086)
atggaggtgacaccaaaccacaccctgaccgtgaccgggtgggcggccatgaacgagtccgccggcaaggtggagcccttcgtcttcaagagaagggagaacggccctgacgacgtgacgatcaaggtgcagtactgcggcatgtgccacacggacctgcacttcatcaacaacgactggggcatcaccacgtacccgctggtcccggggcacgagatcacgggcgtggtcaccaaggccgggcgcaacgtcacgggcttccgcgtcggcgaccgcgtcggcgtgggctgcatcgccgcctcctgcctggactgcgaccactgccgccgctccgaggagaactactgcgaccgtgtggcgctcacctacaacggcgtcttctgggacggcagcgtcacgtacggcggctactcgcgcgcgctggtggcggacaagcgcttcgtggtgcgcgtccccgacgcgctgccgctggacgccgccgcgccgctgctgtgcgcgggcgtcacggtgtacagccccatgaagcaccacggcatgctggggcaccccggcgccagcctcggcgtcgtcgggctcggcggcctcggccacgtcgccgtcaagctcgccaaggcgttcggcctccgcgtcaccgtcgtcagcacgtcgccggccaaggaggccgaggccagggcccggctcggcgccgaccgcttcgtcgtcagcaccgacgacgcgcagatgcgggacgcggccaggtccctcgactacgtcatcgacaccgtctccgccaagcactcgctcggacccatcctggacctgctcaaggtcagcggcaagctcgtgctcgtcgccgcgccggaccagcccgtcgagctcccctccttcccgctcatcttcgggaagaggaccgtcagcgggagcatgacgggagggatcagggagacgcaggagatgctcgacctctgcgcccgccacaacatcacctgcgacatcgagctcgtctccacggacgggatcaacgccgcgctcgcgcgcctcgcgcgcaacgacgtccgataccgcttcgtcatcgacatcgccggcgactccacctcaaaactatag

SEQ ID NO: 10135 - protein, 361 aa, Zea mays
MEVTPNHTLTVTGWAAMNESAGKVEPFVFKRRENGPDDVTIKVQYCGMCHTDLHFINNDWGITTYPLVPGHEITGVVTKAGRNVTGFRVGDRVGVGCIAASCLDCDHCRRSEENYCDRVALTYNGVFWDGSVTYGGYSRALVADKRFVVRVPDALPLDAAAPLLCAGVTVYSPMKHHGMLGHPGASLGVVGLGGLGHVAVKLAKAFGLRVTVVSTSPAKEAEARARLGADRFVVSTDDAQMRDAARSLDYVIDTVSAKHSLGPILDLLKVSGKLVLVAAPDQPVELPSFPLIFGKRTVSGSMTGGIRETQEMLDLCARHNITCDIELVSTDGINAALARLARNDVRYRFVIDIAGDSTSKL

SEQ ID NO: 10136 - DNA, 1080 bp, Glycine max
  CDS (1)..(1080)
atggcagcacaagctgaaattgagcatcctaggaaagcattcggatgggcagctagggattcttccggtcttctctcccctttcaatttctgcagaagggaacccggtgagaaagatgtggcattcagagtgttgtactgtgggatatgccactcggacctccacagcataaagaacgaatggggtacttccatctatccaatggttcctgggcatgaggtagctggtgtagtaacagaggtgggaagcaaagtagagaagttcaaagttggggacaaggttggtgtgggatgcctggttgattcctgccgcacctgccaaaactgttgtgacaatcttgagaattattgtcctcaatctacgttcacatatggtgccaaatatagagatggaaccatcacatatggaggctactctgactcaatggttgctgatgagcattttgtggttcgcattccagatagattaccacttgatgctgctgcacctcttctttgtgctggcatcactgtgtatagccctctcagatattatggacttgacaagcctggtctgcatgtgggtgtggttggtcttggtggactaggccatatggctgtcaagtttgccaaagcttttggtgctaaggtcacagtaataagtacttcaccaaacaaaaaggaagaagcaatacaaaatcttggagctgattcctttctaataagccgggaccaagatcagatgcaggctgcaatgggtactttggatggtattattgacacagtttctgccgttcatcctctcttacctctcattggtttgctcaagtctcatggaaagcttgtaatggttggtgcaccggagaagcctctggaactgcctgtttttcctttacttgcggggagaaagatagttgctggcactctgattggagggctaatggagacgcaagaaatgattgattttgcagcgaaacacaatgtgaaacctgacattgaagtcattcctatggactatgtcaacacagcaatggagcgcctccttaaagcagatgttaaatatcgatttgttattgatattggaaacacactgaaattctga

SEQ ID NO: 10137 - protein, 359 aa, Glycine max
MAAQAEIEHPRKAFGWAARDSSGLLSPFNFCRREPGEKDVAFRVLYCGICHSDLHSIKNEWGTSIYPMVPGHEVAGVVTEVGSKVEKFKVGDKVGVGCLVDSCRTCQNCCDNLENYCPQSTFTYGAKYRDGTITYGGYSDSMVADEHFVVRIPDRLPLDAAAPLLCAGITVYSPLRYYGLDKPGLHVGVVGLGGLGHMAVKFAKAFGAKVTVISTSPNKKEEAIQNLGADSFLISRDQDQMQAAMGTLDGIIDTVSAVHPLLPLIGLLKSHGKLVMVGAPEKPLELPVFPLLAGRKIVAGTLIGGLMETQEMIDFAAKHNVKPDIEVIPMDYVNTAMERLLKADVKYRFVIDIGNTLKF

SEQ ID NO: 10138 - DNA, 1143 bp, Glycine max
  CDS (1)..(1143)
atgtctagcaccgttggccagaccatcaagtgcaaagctgcgattgcatgggaggctgggaagccgctggtgattgaagaagtggaggttgcgccaccgcaagccggtgaagtccgtttgaagatcctctacacctctctttgccacactgatgtttacttctgggatgcgaagggccagactccattgtttcctcgcatttttggccatgaagcttcggggattgtggagagcgtaggcgagggtgtgactcatctgaaaccaggtgaccatgccctccctgtgttcacaggagagtgtggagattgcgcccattgcaagtcagaggagagcaacatgtgtgagctactcaggatcaacaccgataggggtgtcatgatccatgatggccaatcaaggttctctaagaatggacaacccatacaccatttcttgggaacctctacattcagtgaatacactgttgtccatgctggatgtgttgcaaagatcaaccctgctgctccacttgacaaagtttgtgttctcagttgtggaatttgcacaggttttggtgctactgtaaatgtagcaaaaccaaaacctggttcctctgttgccatatttggacttggagctgttggccttgcggctgctgaaggtgcaagagtttcaggtgcttcaagaatcattggagttgatttagtttctgcccgatttgaagaagctaagaagttttgggttaatgagtttgtgaacccaaaggatcatgataaacctgtgcaacaggtaattgctgaaatgaccaatggaggtgtggatcgggctgttgaatgtactggcagcatccaagccatggtctcagcattcgaatgcgtccacaatggttggggtcttgctgtacttgttggtgtgcctagtaaagatgatgcattcaaaactgctcctattaatttcctgaacgagaggactcttaagggcaccttttatggcaactacaaaccacgcaccgatcttccatctgttgtcgagaagtacatgagtggggagctagaagtggacaaattcatcactcacacagttccattctcagagatcaacaaagcttttgatttaatgctgaagggacagtccattaggtgtatcatccgcatgcaagagtga

SEQ ID NO: 10139 - protein, 380 aa, Glycine max
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVGLAAAEGARVSGASRIIGVDLVSARFEEAKKFWVNEFVNPKDHDKPVQQVIAEMTNGGVDRAVECTGSIQAMVSAFECVHNGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 10140 - DNA, 1128 bp, Glycine max
  CDS (1)..(1128)
atgtcgaaaacctcagagattattacatgcaaagctgctatttgctggggaataggaaaacctgtgactgtggaagagatacaagtagaccctcccaaagccaccgaagttcgagttaagatgctttgtgccagtatatgctccacagacatctctagcacaaaaggattcccacataccaattttcctatagcacttggacacgaaggagttggtattatagagagtgtcggtgatcaagtaacgaatctgaaagaaggggatgtggtaattccaacatacataggcgagtgccaagaatgtgagaattgtgtttcagaaaaaaccaatttgtgtatgacatacccagtaagatggactggtctaatgccagataacacttcaaggatgtccatccgaggagagaggatataccatattttcagttgtgctacatggtcagaatacatggttagtgatgccaactacgttctcaaagttgatccaaccattgatcgagctcatgccagtttcatctcatgtggcttttcaactggatttggagctgcttggaaggaagccaaggttgaaagtggatccactgtagctgtttttggtcttggggctgttggattaggggctgtaattggatccaaaatgcagggagcaagtaggataattggaattgacacaaacgagaacaagagagcaaaaggagaagcttttggaataactgactttataaatccgggtgattctaataaatctgcttcagaattggtcaaggaactaagtggtggaatgggtgccgactattcttttgagtgtactggagtttccactttactctctgaatccttggaagccacaaaaattggaacaggtaaagcaatagtaataggtgtaggaattgaaattactttgccattgggtctttttgccattctgcttggtagaactttgaaaggttctgtttttggaggactcagggccatttcagacctttccattttagctgacaaaggccacaaaaaggaattccctcttcaagaactcttcacccatgaggtcacattagcagacataaacaaagcatttgagctactaaaacaacccaattgtgtcaaagttgtcatcaacatgccatag

SEQ ID NO: 10141 - protein, 375 aa, Glycine max
MSKTSEIITCKAAICWGIGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP
